United States Patent 7,868,149 (PLANT GENOME SEQUENCE AND USES THEREOF) - sequence listing, part 76

SEQ ID NO: 41218 - DNA, 7053 bp, Oryza sativa
cagcgtacctgataataagtgtggagtaaagcgttagtcatcaagcctaacatgcaccttttgttatgcaaccaccagatgtcaaaatcaaataaagaagcatcactgcgatagctgtataccgtgcaacattaacatcccttttgcatttattttgaagtgtacattacatgagctagcctaaggagttgcagcgttatgtccactcctgggaaatatacagggtctacagcaaataagggccagcaataattcaaaaacaaagaaccccatgctactccagacaaaaagggtccatctccagttccagagtattctcttgagcagaggtagttctgcctcaagctttagtgatgcggcatagatctctgggatgcctgcaccaggactaaattcagctcgttgttcaagaattatccttattcccattactggttctgaagcctctgtaatgcccctcatttttagtcttatgacctgagattctgaggaatagccagacaaaagagacacgcttcgcagaaaagtttctatgaagtgcatatgggcactcttaaactttagcatgcatggttgacttgaggtagagatcactttgccgtctgctgatagaaattctgctcttacctaaactcaatgaaagaagggaaatcagattgaaaatagagacatgctaaacacgatgttactaaaaaaagggtatctaatatgaaagaccaaaaagtatgcgtatgaaacatttataatatctcaactcaaaataattaaagaaaacttaaactgggtatatgctcccttgacacgctacagcagggaaattatatgttccgtcatgatattggacctttgagctacagaatgaaagttaacataactctctcattgataaccatattgtcccgctacgcaaccttatggacagaaaagtttcctctatcaatgccttattagccatgttgctagtgtaacacatgtctgcataaagctcactcaattacccaacaattagcatttgcagcataacgcagtgacaccacatgcaccacacctatcatgctcaagattcatctgtatggcaaagttttttttgtgttagatatcaacattttagagtaggtgtcacatgtccaccagattcctttgagacccatattatattagaagtaagattgtatcttttctagtgtataatttgttttgctattggtctctcaaaaaaaaatttctattggcatgtcttaaattgatacagtaataagttgagggaaaaaacagtataactatcatgctttatagatgtccttttgtgttcctaaaaatatttaggttgtcataagaaaactacggctgagtgaaatagtgaaaactcaaaacataatgtcccctgttgagaaccgattctacagaacaacacataagccttttaatcctgctaacttttcactaaacatttcaaatcttcaaattatataacatctcagtgcacaactgagttaacagttggtatcttctcatttgtgaagtatgctcagggactatgtcataaatttttacagtttagaatgttaatatgggtttctaacaacatttactcgacactgcttcaatcgaatatcattttcccttttatcaaaggaatgaccaatgcaaaatcaatctgacaaggacaaacagcaaaatgtacctggaaaactccaagcctccggttgtaatccgattcaggcagcgtcaggaacacctcgagctgcatccgctgattcggcggcaccaaccgctgtacaggaacaaatgccacggggctcggtttggtgtaatcaaaattcagggtctcagtaacctgaatgggctcctccacaactttccccaccaagagccctcctccgaggaacgccataaccagaatcgagcacagaacaacgcagacgtacaccgcccagagcgacccccacgccagcctcgccaccatgcgccccaccccttccccgccgccgagacgcgcggccgcggcgcccgtggcgtgcccagccacctcgagcgcccaccccctcgctcgccgcaccaatccgagagggtccgtcacgaggaggaaccaccattgcagcagccgaatcgggaacgtgaggcagctgatgagcgcgctgacttggaacaccaccgccttgatgacgagcatggcgagggactcgagaatgcccggcggcggaggcgtcggcgtcggtgccggtgccggtgccggatttagcttcgcgtccctcgcctccacctccccctccacctccccctccaccgccgcctccgccgcatcctcctcgtcttcctcctcgggaggcgggggaggacggtgtgagcttgtctcctcggagtcgggcttgacggcctcgtcgacgacggtgatggtggatgaatcagagaacgtaggtgatgcggcggtgtcgtcctcgtgctgcttcagactccatccgcggcgcgggcggcggcggcggagggtggaggaggaaggggtgtgaggaggagagggtggggaagggagggagtcgagggcgtcgaagaaggagtcgtcggagtcgagggaggtggaggcggcggcggcggccggctcgtctgcttccatggccggggaatcggagggatggtcgtcgtcggagcatggggaggaagaggattccgtgggaaggggaagaggaattgtgaacggtgggagaagagagagacgatgggcggggtatttttcagttacacccttgttcttagcatctatttcttcaggtagtataacaagacaggaatttttggacgaaattcaaccgcatggtgctatctgtaattttcgggaggatggaggggggttattcgtgatgatccatgaatcctcccacgtggccacgtccggtgttgtgtttgttgccacgctaacgcaacccgtaccttcgctgggccagccgttcctcgtgtaaggagcccaaggtgttggcctactacacaaggagcccgtccactccgtgcttgttgcgttttgggcctggcccaatattgcaaacgacgttagcgggcttcatcgcctggacgccttgtgcgatgaagccaactactccctccgtttctttcacactgtaagttattctagcattttccacatttatattgatattaatgaatgtctagattaattaacatcaatataaatatgagaaatgctagaatgacttattgtgaaacggaggaagtagccaattgaggaccgtgggttcttagggtgtgttcattaaatacaacaaaaattaacctattatggtttggtataatatttaagacatgtttagattgctactttcttaaaatttgataacagtaaaacctggtaaatataaaaatgatggtgaagtgaataagcacttacggtccatgatcatgtgcacttgaagtgacgtgatatttttatttaatatatgtgggctcaacaaaatatggatccacatgttaataataagattgtgacttcgaagtctgaggagcctaaccactattccgatggtagtaatatctgcttcaattagctttgcagcaatgactttcatatgtaacatctggttgggatgcaagtaaatagtcatttattattttcttttacgggaaaatagtagaagaggctcatactgtaaatatattaacatgagaggtttaattacatgagagtttatagagggaggaggtatgccctatacaaaattagccatttactaatttgcaaatataaaaggcatgccatatacaagatgagttgatgaacatgttatagatactaacttttttccttgtgtcatttaaccgttttatgaatattacgagcatcgtgataaaaagaacacgacacaactctaaagtctaaactgcaacaattcattaatatgtgaactttagtaatgatgacactacataaatagaaatgcctgcaaacatcgttatatgtaggttttttttctcaaaacaaggtagaatacaaaatctatcaaacaataaaacagagacactacttacatgtcttggaattttgtagtagttacgagaattcaaacaccactacaaagaccgaccaactccagcacccagcactacaaaagcatatagacgagtatttagtcaacaaacaattattatatcttctacacaagctagacaagaccataacacaatttaaattgttcgtttataacaatataaatgttactcacaatacacacttctcgtgttgtctatctttccctacttaaaaaaagacaagctatttatctatgaaaaaaggcacaaaactaacacatggttaatatgcattttgcatggatataattttttttatttatgtatctaaatttagtatcaccagaaccgatagaaaaaacggaagacgtgtagagaaaatgctactaataaaattatagataaggtttctttaagttgcaccacaaaacgatggaacatgtgactgctagaagtagagtgccaagatttgtgcagaattctgccaagaatttccccccgttggcacgggcctcccattaattgcaacccccgcactccaaaacggcaaacagccgggcagccagccagccatccggatctatcccaaaaacaaaacaacgcacacgcgcccgcacactatccgggccaccgcatcgagggggaaaaaaacgagagaggaaaaaaaaaagaaaaaaaacaaggggagaaaaaaaccctccccgtgttctccgatcggcggcgaggcgaggcgagggcggcggagatgaggggggcgaagcggccgctcggcgcggtgatggcgtgggtgcggcggcagccgcccaaggtgaaggccttcctggccgtcgtcaccggcatggccgcgctcgtcttcatccggttcatcgtccacgaccacgacaacctcttcgtcgccgcggaggccgcgcacgcgctcggcatcgccgtgctcatctacaagctcaccaaggagaagacctgcgccggttcgcccccccctctcggctcacgtgtacggtgttgccagttccgtcgcgcgcgcgtgcgcgcgcgcgtcgatccgtcgagatcgccggatccgcaaccgcgtagctccggagtaggatctgtttgtggatttttgtgtttcgtctcgtcgaccgtgaagtcgtttctgggagaattggcggttttgctaaggcgaacatctaggaggcgatgggctctgcatgttctgaaattcactcgatctgtttgatttctgaggctccttcctgtttttgtcggaaaatgtttctgacagttcacgcttagttgtgattttccgcgagcagatttgtatggagcgggagatacacgtatcactgtgatgttatagggttttgggtacgggagaaatagttaattgctgatctgcaggttgtgccatcttatgaagcagtgatagttgattaattcattaggagatttggctgcacgatgctttcacatggctgggtaataagctatatagtcctcttgcggaggatggtgcagtttgttgagaattaaccaaggaacccggtgtattgtttaccctgtcctgttttagaaacagaatgtaggtatagtcatttagagaaaccagctatacctattcctatatttgtgcaaggtttctggaacagaatttttacattcatttctggttgcaacgggttgcaaacccaggtaccattttgcaatgagtagcatatgccactgaatgtgtgaatcattaccgatacatataagcatatttttttttaaatttctttatgatttcattccatgattatgccctcagtgctatctgatcatccgattaatcatgattaatcatcctgatcggtcccctgactccgatcagggacattcattcgatcagttcgatcagaaatctgattgtccaattaatcgttgatcaggcacgattaatcgtccgatcagagcacctattgatcactttttgaaaacgtcttagggtttagtacatgtgaatatgtgctactactgctggttgctttatattgtgattgctttatactagggcaagtaagtgactatcttgccatcaattattagtactatgattgttttattagtactggtatacatagtactgatcaggtcgattaatcgaggctgatcgacgattaatcatcctgatcagtcccttggcgatcaggatcgatcagcgatcagataacattgatgccctgtcctgtcctgttttagaaactggttgtgggtaaagtcatttagagatagatgtatagttttgttttgattactgtaagattgagttggtttgtttggagcaatattttgtgctttggctggaatagaatagtacttcctccttttctttttgtttgacgttggagctcaaaattgaactaaccaacatcaaacatttggaaatggagggagtagtatgtcaccattcttttattagagaaaccagctatttctatatttgggcaaggtttctggagcagaatgtttccattcatttcttggttgcaataggttgcaacccaaagtactgtttcatagttttgttttgaacaagagaagtgactaatgagttgcatgccactgtatgctcgacgatacagagaagcatatgtttgttatagcttctttatgatttcattccatgattatgtgatttattttttctgtattaatgcacggataactaagaatattaaaagctcggttatgatcgtatctcttgcaggactatccctcaagtctcaggatttaactgcgttgtttctagctgttagactatactgcagcttcgttatggagtatgacatccatactgtgctagatactgctacacttgcagctacactttttgtaatctacatgatccggttcaaattgagaccaacttatatggtggacaaggacaattttgcattgtactatgtggtaagaaccactgaacttctattacatataacatacatgtttaggttgataagcataatctggccggggtgatggtcttacaaaattatattg

SEQ ID NO: 41219 - DNA, 19147 bp, Oryza sativa
  unsure (1)..(19147): unsure at all n locations
gattttgttgtagttattggctcattaagtatttatctataagtagttgttgtttcgcattctgacgactcaacaaaatacaaacgttaagaggaagtatcactctggttgtcttgtgccgcataaactgctgaagacgtgatgtacttatgtgaaaccttgtagatatcagtcagtaatgggtctgtagaagtgttatcactttatttattactcactgaaaatgctgaacccataatgtgtgccaaactgttttgcttgtgaagtcagctgtaatgctcataaatctcttagttaaaatggatgcttacttatcgggttcttttatttattacttttttgaaggtggtaccttgtgctgtgctagcactgcttattcatccttcaacatctcataacattgtgaaccgtatcagctgggcattttgtgtttacttggaagctgtctcagttctaccacagctgcgtttgatgcaaaacacaaaggtaaatagcatgcattttccttgactgcaggggcgaagtttcctgaacatgttttccatcttttgcagattgttgagccgttcacagcacactatgtgtttgcattgggagttgcaaggtttcttagctgtgcacactgggttcttcaggttcgtcttctaaacaaaccccaagcttacttttatatgtgttcccctgtttattgattttgtcattactttctttgtttcttctgtaccatacccagcgcacagaatcccaacacttaatttacaataatgttttttttttgaggtttggcatttcttgtctgttttatggtagccgttctactttgataaatgaccttattatgttagttttctcaactcatgtactttagaggtatcatcaatgaacaacctggtcatgatgcttccttgtttaccttgatttgttttttctagtataattgcatcatcttaaaagctctttttttaatggttaaggacatcttggggaaatttctgtacttgttcattcaatagttgttactcatgggttttcagaaacaaaaaactatccacaatgttgaatttgacactttatatatgcatggaatttatgttaatttaaagacaacaaattcatcctgcaggtattggatactcgtggtcgattgttgactgctctgggctatggcttgtggccatctatggtgcttctgtcggaaatcgtgcagacattcatccttgctgatttctgctactactatgtgaagaggtacatttagggtcactagtttaactatttaatttgattgtgaacttcatctaatgcatgtttgctgggtgcagtttggtcggtgggcagctggtgctacggcttccatctggggtggtgtaagaactgtagaaggatacaaagcttccagcttcacccatttttatgtactctgaataacagttatgttctagtgtccgaccttctgtgtctcttaccaagaccgagaccggagccttttttttacttgatattttgaggtataactattaatgacaagtgcactagagtcttcttaaacataggtcgttgaatgactgtttatagttgcgaatgtgctgatactttggttcaatttagcttctgggtacatggttgtcgtgattttacaatgggaagttggcgtgtgaactgatgatggtgtcttttgattatgttcgtgtttgcaatgtggtattccagtcctggtaaaatgagccatggtcttcaggccccatttttaattacaacaattttgtagtaggaactatattgcttaccgggcaaagctacagagcgattcttgtggtacgaatttttgtttgcagagaagtttcataaagatcgcctagtcgtgttacattgaacatgtggggatcgtcaaagccgccccgtgctagtccactcaacatattgtacgcactggtttactgactggttatgtgcatacgctacgttatctggttgaatttagggagtttatcagttgcctcatgcttagtagcttgcatctcacatcagtttcgtgtgcaaatccttttgtttgttgaccaaaccagaatacggccgggcctgagaactagcgaaaagaaaagttgacgacgaccctgcttgtgtcttgccagttcattttgaaaagctgactgggattaagtttcatcaaacacgcttgcattatttggtccccattgttaaaggtttaccttctttgcttccgcaggaacgctctgtagcggtattctacagacaacttatcagaaaaggagttatctatccaacaaggcaaaatttactatagggcaccaaaaaattacggtttttgctatgagacatccgaagatcgtgaatcttttcgtggacactgtaaaaaagtggacactcctcctattattttattatttccagtcaaaatggagagagaaagagttatgtaagtaccaaaatgcacctgctctctctcttctcttttcccctttttcttcctcgcgcttagtactgagccgagcagacgcgtgacgcgcgcagccaacgctgccggctcgagccgggacggctcggccacggcggggcggcggcgcatcgccggggttcaccgccgacggcgacgacgcacggcggcatcccggcgcacggcatggcgatgcacggtggcaccgagctctcagggagctcggcggcggcgcaatggcgactggcccggcagggatacggtggcgcgtgcctcaaatcgagggtgccgcggaggggtggtgaatgccgccggaccagttgatggtgatgtcaaagtcgccgtcgacgagcgatagcgatgatgttgacgtcctcgacttgcaggacgtgctccagcgattcgggtttcataccatctgtatggtggcgttcgggcacgacctgccctgcctcgccgacggcggggtcatggaggatgccaggtcggatttcatgcactccttcggcgaggcgcagaaccttgtcgtcggacgcttctttgatctcatcgaggtctcctggaagatcaagaagtggctcaacgtcggcaccatacgccgtctgaggaaggccatcgccgacgtccacaccttcgccatggacatcgtccgcgcccggcgccagagcgcgtccgtgcaagacagagacgacgtcctgtcgaggtttgtggcgagtgacgagcacagtgacgaggtcctccgcgacatcgtcctcagcttcctcatcgtcggccgtgacacgacggcgtcggggctgagctggttcttctgtctcttgtcgtcccggccggacgtcgtggcgcgcatcgccgacgaggtccgcgcggtgaggaagccgaccgacacacgcctcggcgagccgtttcggttcgatgcgctctgggagatgcactacctccatgccgcactcacggagtcgatgcggttgtacccgccggcgtcagtcgtgcgcggcggacgacacactccccgacggcacgctcgtccgcgccggttggtccgtgacgtacagcgcatacgccatcgagcgaggactgcttggagtacaggccggagcggtggctcggcgaggacggcgtgttccagccggcgagccagagaaagagagatgccggcgagccagagaaagagagattgacaagtgagcccgtgggcataattttttcagtagaagatcttgccatactcctccttcatgacataacctaaataaccgttttcttagcaaacacttgctctgtaattctagattctgaatgtcaaggccgccgcactcctttagcttgcatggaacactccattggtgtttaccccttgccccgtacccacaggtcccacatccatgcgtaccaccatatgtccccttcccctctcctctagtgatggcaatcagcgctttacctcttgcattttcgtactaattatcgaggcttccatggctaaatattaggtcaaataggcccaaaccagtgcatcctcgaatgcatgttggacttaagacgagcaatcatggagaaagtctaatggtaagagaggtaaaaaagaggtaagggtttgttaggttcaaaatttttggcctaacaaaattaccttgcaactgttggcgctaccaagttttggtagcatagaatttccaattactataggaaaaaaactagtagcataccaaacatttgtcgatataaaaattagcttcaatccaaataatctcacagtttattttttcttttacatgaaaagatggaaaaagaccatcatcatcatataatagagtaagctagagcagtactctctctgtccccatagaaaacaacctagtaccgatatgacacatcttaaatttatagtactgcaatgtcatatttggttctatattcgttttttataggacggatggagttcagttaaacaggtggaagcagaaagcgctcgaggacagttcgtgtttgcgccattagcatattggccctccatcgatggaactcataaagcaagattatcataggaatgatcactatgaaggccacggccacaagcacggctaacgctccattcaagtagttgttttcgcggaagaaaaggccagccacgcataagaacagcacaccgaggacgaacaaaaacgccacataaccgatgttccccttggtcgacccgacgtattggtaggtcgcgtgaacctcggcgatggccgccgcgatcctgtcgacgtcgccctcgcccagtcgctgcgacgccagcagcctcggccgccactccggcggcattgctcccgccgcgaacgccgcgtcgatctcatccttgatgttgctagtgccgctgccgctgttgctcatggtgatcgatgcctctgaactgaattgctgatgaatggatatgatggttttgcatgtatcaatcgattgtcttctttctgcgtccctgcgtactattccttccttccaggcagattttgttgcgatacctccgcctagggcaaatttataacgcgtgctgccatattcaactcggaatattcgtgcaaaaaaaaatccaactcggaatagttgttgcaactaaaaaaggttacagtacgtactaccgtgaatccgagcccgattgccgtttacgcaatgggcccatcgttctccttgactagttgctgagtctgaatcgtatctttgaaccgcacaatactcacgacccccccaactattaaacggtgcaatttaatttttagacgtttttgaggggtggtttttgctaacgtgacgtcatgtgagatccacatgtcatcatctgtttctccttcccttcttcctcctccctctctctctctctcccctttccctctctctttctctcccctttctcttccccttagtccgtctacggggggtggggagcagggagcggggctggagcgccgacggaggaggtgtaggagattccagggcgatgatggcgtgggcagtgacggtaccagagctggttgtgggcacaaagccacaaaggcagtggacgaggtcgatacgccagcggaggtggagcgggatggtggccaccatggcaaagagggaggaagttggcgcatgagagggtggcaaggtgatggcgaaacggtctagtggcccgaggtgacacgggcaacgggatcgtggtagagtcagcagttactctgtcacgggggatcaaacccaacccaactacgtggatggatccagcgagtgtcgagggtcgagctcccctgtgatgattggccgacagcgtgacaccggcacagtgtgtgtcgaaggctttcgatggtggtggtagcggagtgtgcagtagtttagttcttgggaggggtgaaaatttgggcgaaagctctgccttcgggctggcaacaacgacgcatgcgggtgccgctttccttttggggtgttgctgcattttcttgtctctcccaattactttcttcaggtgagaaccttgtcctggctccccgggacaagcagcggaggcgctcttgttgtcgttcccttttagaggcatcgtcttgaagatctcctgtttcgctcttgcagcgggtattgttgtagacgcgtagtgcggttgtttttttttcttttttcctgactatagtcttccagactataaacttgtatttttctcttgctatatcaatacttgaaacttgtcctgtcttatactgttcgtttcgaaaaagaaagagagttttcaatatcgaggtgaaggacagcgtagcgcaattttatcctcctctccatttacacacggtcgagtacgcgaagcgagagccaggccgtcgctccatgctagcgtctgattgataccttctccctcgctagcaggtgttcgatggggaaaaatatttggtggagaccggctgcaaacagctcctgtgcagccccaccccccgatgattgccatgtggactcccgcaggatcggacgtctcgctcgttacgtcttccggtgcaatacaaatagtatggatctgtagggtttctcttactgtcggaggtggagttaccgcactctggcgattagcatagttaccgtatggtaaccacggtaaccgtggcaaaccgtatagaatttatcacaaaattaaattagtttataaatttatttgatgttaatgggttatcacggttttattttgttgtgccccgacggtaggcgtgattattttttgtaggcgtgattatcgtgtgggtaccactggttttgtaaacctcggtgtgtatgagcctcgcttgactcggctcacgagctcaaatccatcgctgatcggcatctctcctctgtagccgcagccgccgcctctcttgtcaacgtctactgtgtctcgtccgccgctgcagcctttctcttctctcgtccgtcatccgcttggcggcgatggcgagcgcgaacacctctcgttggttcaggttcacaccttgttgacaatggacaccacccactatactgcagcaggtcaccacccatgctattgccagcgggagatttgccagttcagagcttgaggatgatgatgcccatgctgtactgtaaacgtcagtcttggcacactcgccttcttgagactgcacgtcatgccatccgaaaatgttagtggcactatcattgccatccgaaaatgttagtggcattagatttttgggtgcatgcaaaacgagataaaccattagcgtataattaattgagttttaattattacaagaatgtggatttatttggtattttaaagcaacttctatatagaaagttttcgtactaaatgtgccttttagtaatttgaaaagcgtgctaacgaaaaccgagatagaatttacatatttatcaaaaaagaacatgaccaagtatgcagaattttttttgggaatatgcaagaaacacatctttgtattaagagaaataaatgttatttataaactgaacaaacgaaaacttgaagcgggacgggatacctgagaggtacaacaaaggacttgaagctataatctcacaaacgatggtgacggcctagggactcctgaaactagagaccaagcgccagcactgccaccctggccaggcgccataactctgcttctacagccatagctttcgctacttccgcctagggccgctgctggagattgaacacccaactctttatttccttccagatcatccaggtgaccagcgttgcaatagtatgaaatccccatcagagatccttcgcgactttcttcctactttcctactggtgcaaagccactgatggaaggaggcaggccgactgattaatcaccctaagaacccaccatcagaggtgtcgggattccgggcaagcgaccaagatgtgatctattctcttcatgctggtcgcatagaacacagcggatggggtgggggagcccccaacggagtagacgatcagcaatccatcatctattcatcatattttcagttcatatagatgcatgaaccccaagagatgtactttgagtgcggagcaaatttgtttagagccagaaagcataataatgccagcaaagcactgctgttaaacaaaagtctgccatttaatttaccattttttcacatgtgttgatctaattaaaaactgcgttaattcctttaactgagcatgaaactctattactgaaatgtgtgcactgaccaagtaaccatgaagaaatgaaatgctcaatttagtaattgctatgggatatgtttattcttatggctaaataaaatataccagtctcctaaatttttagatgtatcaaatctacatgatgaaaggttaaatcaatattagcattgttagaatctgcaaatgttcagactacgcatcttctgaaatgtagcagttaacaactactccctccgtcccaaaaaaaagacaaaccctgggtttccgtgtccaacgtttgaccgtccgtcttatttgaaaaaattatgaaaaaaattaaaaggataagtcacgcataaagtattaatcatgttttatcatctaacaacaatgaaaatactaattataaaaaaatttcatataagacggacagtcaaacgttggacacgtagatccagggtttgtttttttaggacggatggagtataatagttgggatgtagaagcccaaattgaactagctaatcaaatcaatcttgatcaatcatgtaatcccgcacaatgctaggaagaagcaagccgtggagaaattgggagaagctgccgttgtgcaggaagtctaaggttatatttagtaaagctccaactactaaacccagctccaccctacagtttattttgtaagagagtttcactcagctccattcctattttagataaaactgactctacatatcgtaagacgagcagcttaattgccgctattgggaccgactggccgaggacccgcgcgaggtaataggccctcagcggcagcaggttggggtggcgtatctcgcagctcgatcgccatggaggcatcgatgcctatctgcacaccctgcaactggtgaacatataattaaccatgcatatataatactagtacatagcatttggccatttgcaaatgcaatcagcaagagacaattagcttgatcatttatgtatgtcttaatgaaaatgcttattgataatttgagtgcaagaaagcagcagcattatgatcaagagatctgagcctatgagccgagacgggcttggtagccgagtcgcgagcgaggctcatacgtgtcctatttgcaatgggcctggagccaaaacgagcgagacgtactccaatgacaagattgattaacttgaggtatattacttcacaatcatatagatttaaattcgagttacaagttatataaaaagaagagatataacagtgaatatattcaatttaatttgttccttttcttagacctggtagaagtgaaatttaaacttgcatgttcatatagtgatataatttttttatatttaagtaacatgcaataaattaacgagggaatgtctccttggataaatgaaaatacatatgttacttgctgtgattggtgacggcgaattcagttggatctccatcaaactatcttgatctcgtgttctattgaatcgtgttgtgggtgctggatagctaatacgtagagataatgggtagtcccgtaacccgcataaaaacccgcttgctagtttattttctacataatagtataaaatttagaagaaaaaataaactagaagtgagataaacgggctaaaaaaacccgcttgcccgtccggccgccccgcatccctactactaattacacgctggcaatgctcagcctcctcgagctccaggcgacgacgccccgcgcataagccaccatccaggtcctaaacctgttcgataccggccgaatgcaagcacgtcgatcggctcgaagccaggggcgcagatctacagtaaaaaagccggcgggtctgacaccgacgataaaacctatagcgaaactgtttatccatatgctataacatcatgatctaagtatagttagtatactataacaccattagataagttctgacaccaaacaaatcgattttactgctcgaagcggtaccactagcgggtccaggacagcgacaaaggacatcgatcgccgcatcgacgacgcctgcacgcaggtgaactgggggcgtcaacgtgttcacctccatctgccaggtcgacacatcgccgatcgaccacgcggcgccgcgccttgaacgcgaagaacatccacgtataccgttgcatggaggacgtccccgccggccctactgctggtgccataccacaaagagcgcagcgcaagatggccagctagctgaaccgcgaggtgctcgagcgtgccccatggaccatcggcatctttgccgaccgcgaggtgctcgaggagcacttgttgcgtcagcctcgagcgccgagatggcggcgaggatgaagacaaagggaaggatgtagccgagccccacagcgcgccggtaccaccccgccccccatccaccaccaccacggcggccctgacaccccccgcgagcggcgagggcggttatggctacggtgccacccacaccttcatcgagtcgatgacgccgttgctactcgggatgttgnnnnnnnnnnnnnnnnnnnngatccgtagctgcatcctcctccccgccaacgacgggagctctgactccggtgacagtggtggcctagggtctggcaacagcgacggcggcaaggcggtggcattgggtgtgacatgctaattgcgcatgtggtgatatgtctaaattggcaaaatttgctacatgacactcatagtttatggtctatgctacaagacactcaaagaacgtgtaaaaacatgtaaattagctgttgaacaccgaacaaattattttattttatccggtgcaaatggagagagaaactttaagaaaagacaattttgtctatggggcatgtttgttttaaacccattcaggtctagttctaactgaacccatactaggggagtaaaaatggaccgggtcagaggagtgagaatggtctgggtcaggtttgcatcggatccaatcaccttacaacctatggacacgggggcaaattggtgcattccacactgtttctctctacgtttgtactaaatataataaaataatgcgtctagtgttcaacagctaatcaccatgcatgtttttacggtgacctatagcaaatatgtgttttttggatatactgcagcaaagaccatgaacttttaagtgtcccgtagtaaattttaccaactaaatatcacagcattagttggcatgcgtattgcagaacacccagtagcggagcagccgcactatcgacactgtgccacacacagcacgataccacttaaaacgaaatccgctgcgtcactgcgtcaattgcaacttgtttctctgtatgccgtccgtgaatgcacaagaggtcaatagctctaccgtcactccgtccgctggaaccggagagtgctgtcaagtgttcgatgtagttcttgatcatcacctcagtgagattccatccacgacatgtgctggaacgcatttcatgctgtccatacattccatatttttgtgcctggtattgctgatgaatgctgtgcaaactttgccgatccgctggtatcatcttcttgctttccgtggtgacatgctccagttagggatttatgttctcttcgcaatcggcttgatatatgcgtgtctagccaaacagtcttcgcgtcatatcgtgtcccatgatcaagagatcaaaatccctcaatcccagactgaatcgagcaaaaatacatatataatgtcgatgtcgcgtcgtttcttcttaagctgctatatggctggccgccatggccatagctaggttgatgcggctgtcgtttcaaactgcacagcgccacagatctcaaagcttatagcgatgtaagtatgctgtactccctccgtttcaaaatatttgacaccgttgattttttagcacatgtttgaccgttcgtcttattaaaaaaattgtgaaatatgtaaaactatatgtgtacatgaaagtatatttaacaatgaatcaaataatataaaaagaataaataattacttaaattttttgaataagacgaatggtcaaacacgtataaaaagtcaatggtgtcaaatattttaaaacggagcgagtaaaagccaacgaggacgggtggcaccactggcacggtagctacgaggaagaggaacagaaggaggatgcaatggcgctcctgggcaaagcgggtcgcctgcatgtatcaatccgcctctttggattttggaagcgggttagcggatgtgggtagtgggctagtggggcgggccaaccaagcgggttagcggcacaacccgccccaccttgaacccgaggaaccaatgcaaggcgaccagaagaaggtggggacccacgtcagcgcaagaaagcccgtccccgatgatgttggtcgcgatcgccgtggagacgtacggcgaccgagccggccgatatccgtggcccgcaacgagatcaaggcaggtggcgacgctcgatcgatcacgcgtacgtgaccgtggtgcaccggtgcatgtcgttccagatcgatctggaacatgtagaagagatgcgcgcgcctcgatcggctcggagacgtaccatccgcaccctctacgctctggacgtcgacgtcgacatgaacaaatcatgtctcgtgcaggagggaggctagctataccccccatgcatgatatccccgcctgccgcaagaacgaccaagttaatctcgcccgcccatttctaatcagatggagtacggacagattccgagaagaagatggcgtgggctgcgtggcgcaggagcgtgaggtagatgaacttgcggagcacgatgacacagcggcggcctggatgacgaggaggaacagcgtgtcgagggacacgttctgcacggcgcaatcggcttgctgcccgaatgccaacaacattatattaattactccatctaattaactagaaaacttattattgtccatgcggtacaacggtatttcaatttacaaaaataaaaattaacctattattaccctcattttctacgcttaatttatatataatatagttgttactaatatatatatatatatatatatatatttatatattggcctcacagttcttttttcttttttataaaatgtaggagttggtgatgaggtggttgacatgtggaccctctaatttatgtgttatatattattctctctttttttttaaaaaaaaagtatagagttgtggtgggagtgttatttaccattaatcaccatcataacttttttacaggatttgtagaacggctcttaaaccaacttctgttaggtatttggcatggagagaaatgatgagagagcgagagcctagggagctcgtcaacctgagcgccggcggggcaaccgtcaccggcgcccacagccctgcgcctctggtcactccgaccaggcggccaccgcacaaccgcgctcacctcccccagtcacgccttcgccccaagcaagtcaggcctcgccactgctatccgagccccttgattggggaacggatgccgaggaggatgaggatgacgtcattgctctggagctacaccaacattcagcggagacattcaatccgcagaccgccaaagcacgcaaagcagcttctccatctccggcgtccaaggctttccatcaggaaatcaatgcccgaagccaggaagaggagctcgacattactgcagagagaggagagggacggagcgccattacgccccctcccgaaaaggcacaagaggaagatgcagagaagaaggccaaaggaaaagcaacattaaagtcgataatcgtagccccggcaagagctacaagcaagtctcaaatcgaggcagaagaacaagatctttcatcaaaatggcaagcggtaaaaccaaagttttggtggcggaagcgcaaaaatccttcttcatcaaccttcaggccgtcttcaatcgcccagctgcctccttcaatccactaaatctcagagaaaagttcaaggagatcttgcacggcaagtgcttccgctgatttgtattatcaaatgttccatattactagttatgatgacaatataacatgtgaaagttaatttgtctctattttgttgtttaaggccacggccacttttatccaacaatatggttcaatctttggaggaaccatatcaatatttcaggcagcaatcccaataatttacggtgccttgaagggtagatacttgctgacgcttcagatcaccaggcagcagcttgcagggatcccatccgctgctatacttgtagacgcagtggacacatctccttccgctgcccaaacaaatcaaagcaacccattcactcccgcctcaccttccccaagcaagccccctccattcaatcccgactcatcttcccaccacttcccagcaagaaccaacagcaaccaacaacgacccgccctggtttggttttccatcgtttgcacaaaccagcggtgaccatggatcacatacctggtctgccgaatcaacggccggcagtcggctatgcaatggtgccgatgacggagctcatgtagcacgagttggagcgccttcgctatcatggcgcactcatctcggccgaggtcgagggacaggagacatcccccagggaggtggtgcgtgcactgacccagcaggttgggatccccatctcagacttgcgagtcacgcgccatcacccctaagatttcttcgtcttcttcgatttcccagaggggtaggccgcggcagcgcggagaggcttcatcactctggatggaggaaggttcaccatcacgccatggagcgccgacaggcatgtgcaccacccgaattggtggtttcgcgtgcggctctgcctggagggattgccgcagtacgcatggaacagggcaggattggagggcgtcatgggtcccatctacctcttcgattgcatcgagcatgagtcggttcagcggcagaacacggccatcttctcatgctggatgtggatgcagaatcctgatctcctgccatgaacagtgctctccaccttcttcccgccgggagctaggcgtgtcacctccggcatcacaccgccgcttccggacgagatcgcgccgccgccgagggggaggctgccgcatgtcatagtccatctggacgagatggaggactggactccaggaccgccctgctcgccttcttccggggtgagcggactgccctcctcggacttgtctgatttgggaggcccgatacccacggtgcgcaccttccagtggtacctgggctgcgccgacggaacccagcctcctcggcgacgggcggcagcgaggcggggatgcagggcaccgccgcagagaagagaagacccggaggatgatgaggatgacgacgggcggcggcgccacgctgaggatattccaccacgccgccgctcgctgcgcgatgtcatcattggaaggggccagtcggttgagtcgcgggcggcggaaggggcgcgacaccggagccgcacgccgcatccttccggccgccagcgagcgcacggtgatgggcgccaaggccgctcacggaccaggcacaactcccgatgctcctgccgctgtagatcccgtcgcacgcgctccccaagctccttgactcctcgcggtcaggacggcacgggcgatgcaggcgacgcaacaaccaaggtggtcgctgtcagtggccaggctgatggcgaccagtagccagtcgacgctctcgtgagtctccccgaccctctgatccagatcctatgctcctcacctctcctccccttctcagacgaacagggggaccacgacccgatgctgccgctcctggcagagatcgttcccaagtcttcacgggaggcggagaacaagacgaagaggacgggtggggaagaaccgatactgggagaggataaggtggagtcggcagctgagttgggccaggagaagatgggccatctcggcccagatgcgcagcaggcccccaagatggacctcctcgctcagtccactcaagatgacgaggcccaagcttccacaggagaccagcccaccctggtgcagcaggccgattgcgaggagcaacaccaggccacggtctagactcagcccatccacggaggagaaggtgaacgtgaaaaggtcgtcttatctcctctgttctcgcagctgcagccgccgatcatcctgcaggcgctgctcgagctggcgccgcccgacgcggccaagacgaaggggtgcggacgcaaggtggtgcagatgccgtcacggcggagcggccgtaaggcgcgcttctcgtcggtgccggtgtctaagtgcgcagaagtgcgcctcatggaggagatggggcttctcaccccgggtgaaccggtcggggatgcggcggtggaggcttatgcaaagtccttcgacacaccgcttccgtcgcatgtcattgccggtctgcgggtgctcacacgcctggatggagtgcacgacatcccggtgccaggagaggaaggaaccaccacaacggcggtggtctgaggcacgcgctgccgcgccctgagagaagtcgtcagctgtcatgattgtccgcatcagtgttagagctgcagaaatggtcttccatcatcatctgcatgtatcctttacatttctctgcggtcttaagctgctgctcgctgtatggtcgatgcgactagcgctcccatgcagcaacggccttaagccggagctccttagtcggttgatacgaatagcgctcccggtagacaccggccttcagctggttagtagcagagtagacaggctagaagatagtgaaattgcttctacatggtcatgtttggtttgtagttgtaggtcatggaaaaaaatatatagccctctatctgcttatgaactaattcatttggaaaacactatgggatcgatcctttaggaaaaaaattgtgtgttatacttcgcccaaatgttacagcatctgagaattctcagttggaatgttcgcggactaaataacccagcacgaagagaggcagtcctcgaagcagccgagctggccagagcaggcatcctgtgcttgcaagaaacaaaattaagtagtatagaccaatggatcggggaaacaggttgtcgaacttcaatttccttcctgccaatggaactcgtggaggaattgccatcttctgggatgacacaattgttaacatggcgaatttctcccaaggaacacaccatctttcggcgatggcaacgaccataactgataacctcagcttcatcgtcacagtagtttatggaccctcagaagactgtgacaaggaaaatttcctcgctgaattagtcgcagccaagccaccaacagacacgccatggttggtcatgggggacttcaacatcttatacgaggctagggataagaataaccagaatttgaacaggcgtctaatgaggagcttcaggtcaaccttaaatactttggagctaaaagatattagattgcaaaacaggcagttcacttggagtaatgagcagggaaacccgattctaagcaaattagataggattctgagcaatagtgagggagatattcttttctctgggcattccttgctagcattatccacatcttgctcagaccactgccagttgctgctagcaccaatgcaagaaccaaagaggaaactgaggttccgatttgaaaatttctggattagagtgtaaggtttcctaggcgtcgtaacccaggcttggaacgagcctatccaggaaggtcaccccacttggcggctaagtcaaaagctcagaaacaccgaagcaaccttgaggaaatggagcaagcaaaagtttgggcaatcaaaattacaattcgctatggtacaagaacttatctataggctggatgtagccctggaaacaagaactctgacagcagaggaacaccaattcaggaaagacctcaagataagaattttagggctagcagcggtggaaaaggcgaggaagaagcaagcatctagggtaaaatggctaaaagaaggtgatgctaacacaaggttcttccacataaagatgaatgctcgaaggagaaaaaaattcattcattgcttgcagcaagatggaaataccctgcacacacatgaggacaaagcagctcaccttcatgcccacttcaactcaatcttagggacaagaagacagcgtggctgcacattaaattgggaagcattaggactgagtacaatacaagatgatagcatggatgagccgttcacagaggatgaaatctgggaagcaattaaaaactctccaaaggaaaaagcgccgggcccagatggtttcactggagctttctacaagagctgctggcacataataaaaaaggaaattgtggacgcttttgcaagctttcacaacctcacaggagggaactttggaagcatcaacaaggccatgataacactgctgccgaagaaagacttgccacgctcggtgaatgacttcagacccattagtctgatccactctgtggcgaagcttatatccaaaactttggcaatgagactggcagcacggcttggtgatttggtctcgcatgcccaaagtgctttcatcaagaagagatgcatacaagataacttcctctatgtgcgcaatatggtccggtccttgcacatgcaacggaaaccatccctcttcttcaagttggacataacaaaggcatttgattcagtatcttgggaataccttgtcgaaatgctgcagtggagaggctttagtcagcgctggagaaattggattgtgcttctcctatcgactgcatcatccagaattttactcaatgggatagcgggagaaccaactacacacaggcgaggcctccagcagggtgatcccctctcgccctacctcttcatcctagcaattgacccgattcaacgactactcaataaggccatgcaagaggggcttctatctccgttatcaaaccgagcagcgcggttcagaatatccttatatgctgatgatgcagcgatctttataaacccgatcaggaatgatgtcaacaacttgattagcat

SEQ ID NO: 41220 - DNA, 898 bp, Oryza sativa
tctttatctttgaaaactcgtctgttcctctcgcaccagatttcccaactcaagagcatgtgcagtgactgcatccccttactttgacatttgctttgttgctttgttcttgattcccaccagtcaactaggctctcgtccggattgtgcaccgggaagggttggttgtggttcattctagccattattttgtcccaaatttctcgcgtgaatggacaatccttgaataaatgttgcgccgtctctaagttcctgtagcagagttggcaaaagtagttattgggccattgtcggagttgcaagcggtcggatgtccatatcctgttttgcaggacaagccatgcaaagtttttgcatttggatggcgcccatgtcttccaaatcaaagtggcggcctttgagtcttctctaccggcgaattgggctaaataagccgattttgctttgtatttaccggtatttgtccatctccaggtgatggtgtcttcaactccttcctccaggtttgtctcattatcccagataaggtggaacactgcgaagaattctcggatcagtggcatggacagctcatgcctaatatcctcaatccatttgtcattggttaacgcatcctaaaccaagcgttgctttcctttagagtggttgaaaagcgttggcgctaggtatttcagcggctggtgtccaatccatttggatgtccaaaattttgccttccgcacattaccgattgttacctttgttgtggccgcgaagatttgctcatctaactcatcgcaggtggggtgttgtcccaacccgaggtttgtcagggcactcccactcaaaccatagccaccggagtctctaagctctcgcgaatttatcaaggtccaacacgcctagtcctcccatcttt

SEQ ID NO: 41221 - DNA, 1728 bp, Oryza sativa
  unsure (1)..(1728): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaatagatcctcgttacctcaacagagcattcttgctgcagcaaagaaggcaaagtttaacaatggggaccaaacctgttcaagtaagagggtggccgttcgaaaaaacaatggggaccaaacaatgcaagcgtgtttgatgaattttaatctcagtcagcttttccaaaccaactgacaacgcaagcagggagtcatcgtcaacttttcctttcgctagttccctgggccgggctttattctggttggtcaacaaacccaaacatttgcacacgagactgatgtgagatgcaagctacatggcatgagacaaccgctaacctccctacaattcaaccagataatgtagattatgcgcataaccagtcagtaaaccagcgcgaacagtatgttaaatggactagcacctggcatttgacgacccccaaatgcccaatgttacgagaacacgactagccgatcttcatgacacttccctgcaacaaaaataaataatgtaattcctgcaaaattgttgtactcacttcttccctaaatgtttgacaccgtagatttttttaaacatatttgaccattcgttttattcaaaaacttttgtgaaatatgtaaaactatatatatatatatacacataaaagtatatttaggaatggagggagtatttcataatgaggcctgaagatataggcacattttatcatgactggaatatcacatcgcaaccgcaaacataatcaaaagacagcatcatcagttcaccgccaactttccattgtaaaatcacgaccaccatatactcagaaactaaattgaaacaaagtatcagcacattcgcaactataaacagtcacatcaacgacctggtctatgtttaagaagactctagtgcatttttgtcattaatagttatacctcaaaatatcaagtaaaaagagctccgtcgagacgccgaaaggaattcttattcagagtatataaaaatggtgaagctgataaagttcactatcaaattacatatctacactagtgaccctaaatgtaatagcagaaatcagcaaggatgaatgtatgaacgatttcgtaatgtgcagtgtgctcccagtaaattaaagtgtaaacaaagagaactaaaaagaatagtcactccaaaggacatagatgattctacgtcagtgggacgtcgttcaactcacgatctccgtcgaccgtcgcttgcacatcggacggactttgtcgatcttgccatggccggaggccgatagtcccagtgagctcagtaaggctcctgcttgcttactctcacccaacacctcctgattccagtgaatccacagcatatgcagttgacggcggctacgtacttctttgaatgaaagattgtctccagtgggtggtactctccgacgaaatgcatccatgtcagtcaaacgaccgacg

SEQ ID NO: 41222 - DNA, 13370 bp, Oryza sativa
atcaccatgagcagcagcatcaaggatgagatcgacgctgcgttcgcggcgggagcaatgccgccggagtggcggccgaggctgctggcgtcgccgcggctgggcgagcgcgacgtcgacaggatcgcggcgtccatcgccgagatccattggaacctgcagctcgacgggtcgacccagctgtccgtcgcttgtgtggcgttctggttcgtcgtcggcgtgctggtcttatgcgtggctggccttttcttcctcgaaaacgactacatgagtggaccgttcgccgtggttggggccgtgccctgcgtagtgatcactcctatagtaaccgtggcttatgagcgccgtcgacggagggccaagatgctcatggtgcgaacgcgaactgtcctcgagcactttctgcttccacctatttaatctgtactggtctagcttactattgtattgatgatgatgtcttttcatgtaaaagaaaaaagaaactatatacgagcttgtttggattgaagctaatttttatatcaataaatgtttagtatgctactagtttttgcctataataattaaaactagtcacatagtcacactttgctcgacttttgatcccacgaaaaaacttctatatataatttattagtttagttagcttttaagaaggttttgacgtaagttcatttatctagtaagtataaattgtctaaccaattatagatttagctaaattatactagagtacactccctccgtaaagaaaaacaacatagtatgtgagaatttgataccacttaggaaaatgaatctaggcatgatgaatcactagaaggctcctgttttttcatcgtaattgcccctctctttctttgttcatgagtttaagaggtggcactataaacctccagaaattttcatatatttagctcatttgtgtttttctttaaatgcatatacttttttatctaatggccattgtttattcaaactttttatccgacggtcaatacgtttttgatgatgtgccgtattcttgtgtaggaaaacttgttgcttttacttggtagcgccaacaattgcaaggttttagtactaccaaaattttgttaggccaaaatttagctttgaacctaacaaacccttacctcttttttacctctcttacgtatcgccattagacttcctccatgattgctcgtcttgagtccaacatgcattcgaggatgcactggtcttggcctgtttgacccaataatatttagccatggaagcctcgttaattagtacgaaaatgcaagaggtaaaacaccgattggcatcactagatgtctagatgtaaggggaaggggacgtatggtggattggtggtacgcatggatgtaggactgtggataaaccaaagtagtgcggcggcctcgacattcagaatctggaattatagaacaaggagaaaacggttatttaggttatgtaaatagagtagtatggcaagattttcttatgaaaaagtactcacacttctgataagggttgatgggtgttaaggctgatatcttaaagtttgggacttttgatatatagaacaacactcagctgagattttgataacaacactcagttgagaggatcgtaggatagataactcctcttttgttaagttgtctgtagaataccgctacagagcgttcctgctgatggggaccaaatcatgcaagcgtgtttgatgaaccttaatcccagtcagcttttcaaaatgaaatggcaacaaacaaaaggatttgcacaccaaactgatgcgagatgcaagctactaggcatgaggcaactgataacctccctaaattcaaccagataatgtagagtatgcacataaccagtcagtaaaccagtgcgtacaatatgttgagtggactagcacggggcggctttgacgattcaatgtaacacgactaggcgatctttatgacacttctctgcaaacagaaattcgtaccacaagaatctctccgtagctttgcccggtaaacaatataactagccgtgccccccgcgcgatgcgccgacatcatccaagataatcttaatcataaaaaaaaatcataatagtaaaaaataagcatgattgaaaacaacatagcacataacagagctacacaacaataataataataataactcgatcagaaagagaatatcacgatgttctcaattttgagtgatttaattggaccataatattttttatataatcaatgttacacgaacaacgggtatctcggtgcataatacaattacatcaacaaaagtaaaataaacaacattagtatttcaatacctagcagagtagcagttcccaggaagaccaatcagtgggcgatgattaatttggaaggatagtcaaacaaaactatgtccacagcacatcacagttgtgtcccctgcgcattgcgcgggcatatgaggcaacctataataactcaagatcagaattgggcatatcacaagataacatgcaacactgttccacagtaatagcgcaatatcaaaaagggcatataatctaacaatgttctcagttttgaagtgatgtaatcaaaccaaaagtttttttaagagcaatcttacactaacaaacatggatctcggtacatagtagacaacattcttaattcgataccagcagatcctaggaaaaacgaatccttgggcgatgattaatttggaaggacaacggacatcacatcatatatatggcagtggcaactcatattgtatatgttttacaatctatacaaattggccattagcaataacaaatagaaattaaggtttactgctccatgacccagaaccagtgattttatagccaattctggagatatgagagttcagtattctcgccagcttgtcattaattagcatcgatctattttagccaccaataagaaaaggaaaatacatccacattttaaccttgatgaagagcatgcatatcccacactgtacaaacaacaaagcataatttcaacagaataaaacagtttctaatttcctaaatgtcacgcccagaaattcccgaatagaattccaagcagaatgtgtattaaaatccccgtccaggaccagccggggtacacaaacgacaatgttgacattcagatccacgtcttacaaacatcataaaagtcttacataaatgcagcggaaaaacgaaagataacaggagctaagccttgacttgatctgcagcgggaacaccactccacaggcatcctcgacggcacggacgaagcctactcctcggagaaaccaccatctgacacatactcgtactctggggttggggaaaatggagcaagactgagtactacccactgtactcagcaagtcataccggaataggggtatgatgcagggaattatcataggagagctagagtggttcatttgcataaagcgagcatttataaacagaagtttaaagaaaaaaacagtcgcaataattaatcaatattaatcatctgctgtccaacgctatcccacgttgcaacaagcccaaccatccacctaaactatccaatttcattagactaaactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagagaaaagctacactacaagcccagccgttgcccacgctggcttgtggtaagtacgataagttcttccagggcatcccgcgaaccggtccttaactgccatgggtgcgaccaacaaaaccatgcacccacagcccaccatgtgatttattttaattaaccaacaccgaagcggtgtcactactccaacattaccattagaacctacagtctaaacattaataggattttccccattgtgtattagttgaactaagcatggctaagcaattcctagtccaaagtctattcatgttataacccaagctaacaaaggagcatggtatcaaaatagcatggctgtaacaataggtaaacatcccatactaacattataaaacaatgcagtatttgaagaaaaacaatagagcatttgcaatataggatcaacatgttcaagtaacaggcatgacttgccttgctctgctgctgaaggaacctcggcgactatttcgaagtacaccggagcgtcggaagaaccggaatctaagcgacatacaaagcaaacaatgcaaacaggctataagactactgaaacagagaacaaaaccatttttaatggattctacacattttccttgatttactgagacttgaatgggcttaaacggagcacggatgaattagttatgaattttagaagattcactgtgtttattactataacaaaaagtccttaaataatttattgcgcagttaattcccagggctgacgtcatcaagggggcggcggggcccgcatgtcagcggctcaagggaagagaggggcgccggcaagtggggtccccgggtcagcggcccaaggctgccggtccaccgtggaccgagaccacgagggtggtccacgcccggggccgatcggacgggcggcggcgacccggctcagttcggctcaaggccggccaaccggccacggcgatggcgacggcccgcgcgcgcgcacgcgttgctggcgacggcaaccggcggcggaggcggcggcgcaaaggcgacgcgaaggcggcggcgctaagcggcggctaggaaggagagggaggggaatagaggggagaggacgcctcaccaagggtggccggcgcggaggaagactacggcgaacgtcgacggcgaacggcgacggggaccacgggcaaacggcgacgacgggcggactaggtccggaatgccctatgggacgaaaagataggttagagggagggagactaaccacggcgaccggcatccatggccgaaggggatgagctcaccgagcgcgaggggatgcgggttccggcgactaatctcgaccgaggaagggcggacggtgtggatctcggccacacgaacccgacggtggctacggcgccgcgcggtggcgagtctatctgctgctagaggctgtctgagtggccgtaaaggcggcggcatgcgggtgcaccgtgcgggagcgatggatagctcgggagagttctgtgaacatgggaataaatatagagggggtggcggcggagcttaaatagggagagaaggggccggacgtggccgggagaggcgggaatcgccggccgacgtgggggagtgggagaggagagagaggcgggattcgaaaattgaatcccggtcatctcagacgcggcgcgagcgggagagagggggaagcgggtgcgggagacgcggcgcacgaccggggcggccaacgtggcccggagggggcgggacgtgggcgcggcggcggtttcggcggtggtggcgacgtggggtcaggcggccggagaaaggggacgaccccgacaggtggggcccacctgtcggcgtcccggggagagagggaggcgggcggccggcccgcgcggcttagctgggcctcagccttcggccggcccagcgggaggagggggagaaaaaggaggaatgggccgacggcccattcaaaggaaagagagaaaagaaaagaaagaaaaaggaaaaagaaggaaaaaggatttttcctgggattaaaattgcatgtgctcaattttaattggttaaaattatttcgagagctctgaaaattccactaaaaatcttgttagcgtatttcggcatgtaaaactcaagaaaaattccacatgccaattccgattattatttgcattaatttattaaggtttactcttgcttgacacaggtattttcttgagaccatttataacttcaatttaggcttgggaaagaacttcggggtgtgacactaaagcatgctaagtaatatagcatcagtatataatagcatgagaaagttgaaattacccggactggcggtcacaaaagcatcagtgaaagcctgtaggaagccataaacccatgagctatataaaatacgcaacaaaccactaaaatgccatcacaatattcagttatcgtgttagctaaggtccaatgtttgcctcatattgtggtctctgccatgcgcccatgcctgaaaacgaaaatggatgaaagtggtcagtgagatgctgccaaatataaatattgacccatgcaaaaatatatgctacagtttagccgaatactggtttatatgataaaaaatagagtagggaaggtcgtttatcaaaacaactaattaaataatgatcatgcatagggatataacaattggacaacaaataagacttcccaaggaactacccaaaaaactgaaataataccaggcaataacaggtagagaaaccctaaagagcaattgccaagtagctggaagccttgaacctgaaatatgaaaaacataggaattagcaaacgaagccactcaaagaagcaagtacactattagaaaataaaaaaagataaatgaaacgaaatatgcccatgtgttgttgtggatgattgaaaaatcgtatagatatatttgagataggatgatggcacataaatatgtagctaggtatttaaacaaaaggagagggaaactgtgttgcatatatctgttttagtagtaactgagctactcatcatatagtattgggatcacatgtaccaaaacaaaataaagttaaatacctgaggcaaggaaaatagaatatgcatttaagtgtatggcaggatgatatgaaaaatagcttttaagcaatactacactacaacaggaagcaagtggatttgacaaactttggtagagataggacagtactcttcatcaactttacattgaaatcatccatgcatttcttgggcatagaacaatggccatgtaaattatcaattgtagagtaaaggatggtgaaataaattaattggacaacataatgataaaaggggatcagggagctgacgaaccactgtcctggattaaaatgaagatatgcaaggaaaataaataaaatattcattagatattgatgccagacattaatattgttttggcagtgagaagtggccaaacggcaacaatcggaggacttctttttattgaaaaatcgtatgacttctggctggatgggcctagcccaaacctgaatcaagattagggcctaatccagatagaaaataatggggagatcatacctcactatcccaaggaaggtgacggcagcacaatggctagaagaacacttgctccactccatagcttgtacccaaaccctaactgactcacaagataggtcatccaaattgacgctgcaaaggatagaagcaaggatgctgaagatggagaagcagattgagttagggcttggcttgctctgctctactccatacccataccctaactacagatagattcatcacaaaataagtcatccaaattgatcgctgcaaaggataaaagcaaggttgctgaagataagaagcagatcaggctagggcttggcttaccagactgcacatgttgtcaacaccgtgcgaagaggtggacgaaggcaactatggcagcgggcgtgcacccttcgtccaccttgagaaattggccggtcgagcaagcgaatcaggcggaacggtggcggcgcttgcaggtggctcgcaagaaggcgacgaccccggccgctagctccgcaagaaggtggcggcggcgggcttcgcgactcgcaaggggaagatgaagatttgagtattttgggaagggaggcgcagaggatgtcgaggatcgaggggattggggaagctatgccgggcgcagcgatgtgcatgtgaggcgtggacggttggatcaaatcaacgcgtggacatcggacggtgcatgctgggtgatgactgtagtactgtagcatcttttcctgggctgaggttgatcaaatcactgctagtagtgggttgtaaaaactaaggatttaatatgatatgatatgatatgatatgatatgattcctactacaaaattgttgtatttcaaaatggggcctgaagaccaaggctcattttaccaggactggaatatcacattgcaaacacgaacataatcaaaagacaccatcatcagttcacgcgccaacttcccattgtaaaatcacgaccaccatgtacccagaagctaaattgaaccaaagtatcagcacattcgcaactataaacagtaattcaaggacctatgtttaagaagactctagtgcacttctgtcattaatagttatacctcaaaatatcaagtaaaaaaaaggctccggtctcggtcttggtaagagatacagaaggtcgaacactagaacataactgaatgagtacataaaaaatgggtgaagctggaagttttgtatccttctacaactcttacaccaccccagatggaagtcgtagaaccagctgcccaccaaccaaactcagcacaaccggcggctcaggtgggtaggccggcggccggcaaagaggtgagctctctccacagccttgtccagagacggtgtcgacttgtgtccaccaggcactagccgactcacgcggcagagaagttttgcagggtaagcaacctgaagctgctttcatgcagccttgcagatgtaatgacagaaacatacataatacatgcaaaatcatgatatgtaatgctacaggagaatcgaataaggttggcgcttggaaagaacaacatttttaattgttggtaaactccggttacatttttacagcaagtgtatttggggaagaaaaaaaaaagggggaacaaatgtctgtcctgcagtcctggactaccgcaaactcagaacatcataatgtccattaccatcaaaaagaacctgtattgcattccgtccatactcctttccgtatttggtgaataccctcaaacctccagttttttccaccacgaacacggtgatgggcatcctagcatagtaaaagtgaatccatcaagcccaatgtacatgcataagcattccaataggataggatactgaactaatatgtactgcatctgaaatatggataatttaaaaagtatcaaaaatcatggctagtactcactttaaaacatgtgacgccatagagatttctatctcacctccccacacatgaggtttcctcatctctttgatataggaatggcagtcacctcaacaagcctgcaaattgatgtctcataaagaagcataagaatgcataactcaacaatatttcaatatttagaagcagagaaaccaaggacaggtagaactaaccagggtttgtcagcacattccttctccaacgcatcacaaacctaacaatggcaccatttaaacagatcttttaaatgataaattgacagagaaatggctgtgttgcttccagtatttaagaaacagtatagattcacattgcaagtaaatctgaacattacaagcataccttttttcttaagtcatcagccatatctttctcaagattatcatcaggtggaatcatcattagtttaatataagcaccatgtactatagatcggaataggcatcttccatctccacagattcctgtaggttattatgtcagcaaaacacgaatgatcagacgatgcatgcttcatattgtaatttttttattaaaaaaaatcctctcaccggtaacagaaaatttagtattaacttctctctcttcactgctttggagcctgatagcattctccttcacaggaaggatatcaaccttttgctttggggcacatttgttcacttgggatttgttaggtagctcgtccatgatggcattctccttcatgatcctctccatgttagcaacccagctgtactcgccagtgactggacagcaggaagagtccaccacacggtcagaaaaaacatccctctccactgtgtcaacgagcacctccttcatcactatgctcaaattgtcaaacttctcatcaagcttcagtcctttggtggcagagatgagcttcttgccctcaaactccatgaactgaccgacagcgtactcatcaatggcatcaaccatgtacaggacctcatagtccttcagcttctcaaggaagggggagttctcaacagccttcttgctctcaccagtgatttaatagatatcacgctggccctctttcatccgggctacatagtccttgaggctggtcaactcatcaccactcttggtggagtggtacctcaggagctcagcaatcttcgtcctgttggtagagtcctcatggatgccaagcttgagatttttggagaaggccttgtagaatttgttgtagtcttccttgttctcagcaatctcaaagaacagctcgacgcatttcttcacaaggttcttgcggatcaccttcaggatcttgttctgctgcagcagctcaaatgagatatttaggggaaggtcttcataatcaacaacgccctcgacaaagctgagccactcagggatcaactcctcacagttgtccatgataaacacccggcgtacgtacagcttgatgttgttaagcttctttctggtgtcaaagatgtcaaatggtgctcccttgggtacaaacaggatggccttgaactcaagctgaccctccacagagaagtgcttgacagccagatgttcctcccagtcgtttgtcaagctcttttagaaggctgcttccttggtgatcacctctgatttcctcatccagatggcttcctgcttgttgatcaagttgcactcatgacagacttccttgatcttcttcccttgttttttcttctcttccttctcctcatcaacatcctcaacctttccctctttagcttcctcgttctcactagtaatctcctttgaatctgagagaggtttctgcttgttcgaggaatgccactcatgagagacttcattgatcttctcccctttcttttccttctcctcatcaacatcctcaacctttccctcttcagcatcgacttcctcatcatcacagatttccttctcaatctttttctcattcagggagatagggtagctgatgaactcagagttcttcaccagatccttgaggcgatgctcctcaacatattcaggctgtaagtaaatagcagttgtgaacaaacagcatagggtgcaaataccaacaacatacatcgcagcaaataaaatcatataatacatcactaatagctggaacatggttcacacaagtaaaagtaaaaacgtgttgtttcatttcagtgttgacggaaatcacaatatatttacacaacaacaacacaacattaataattggaacaagaccttaagcaaataatttcacttatatatgcacattgaataatactttaatcctaattgcagaaaaccacaaataaagaaaactatatgctcactcatatagataaatcgaatggtgttcaaaggaaaaactagtgaaccaaggttttacctcataactgtcttcagatagtgaatccatttggagttgcaaggtcctagtggggggagatcctcttttgatagatcttgaataaatatgacttctcatcctctttgaaaaatgaatttccttgtcctagagaaaagtggagtaaggtcagaaagcaggaagaacaatattgtaaaacaaaatagaatgggaaataccctcagctctatccatcgtcgctttctttgtaagattgttattcttcttcttttggttgaagcagtatcctacggaaaagtgcacagtgagcaagaaaatacaaacaaaacatgtaaaacagaatgcaggtgaactatacgttgtcgctgtgttttctttttccttggccaaagagcccaggcggcgcaggaagcaaataaacttccgtgaaggtcgttttcttctctgccctgtcctcttgacgctcattgtgatgtttcttttgcccatcaatctttacaattgcttgattctcgatatcgattgcttcattgtcagaatctggattatctgcaaattattgtgttcaataagtgcaaaccacaaggagaaaaaacaagtgaagagttttaatagagccctgtatacttgagattgagagttacttgtaatcattgcgcgaatcatgacagggagctcaatcacatagaagattgtgttcaaaatgtatgagagctaaaaggagaaaaaaaaacaaattaacaacatgactggtatcacagactgttaaagatgatggttatcctgtcatggcctcaggtcgtgacacttacctggacataaattttcatgctgtactgcttgtagacaatcaaaaccaattcactggcagcaaatagtatatttggtacatagaacagtatgaaaacgtgaatttctagtgacagagttgagtaccactgcaaattcaaatgagacaataattaggaaactagtatactctttgattgaaagaattcaataagtcacttaccaagttattgatctgaactagatggcacaaaacaatcataacatttcccagtgatccaaataaatgctccagcagtctcaatatgtcgtctcccacatttgtttccagcaaaaccaggattaccagaaaactgatgcatataaaacttacaagacaaattgtcttgtagaacaaaataggttagaacgtgaatgctctaataacaaagggaaaaaatatttgaaaagatacttacttttttcctttccttgttgtgtctataaatagacagcaagtggtagatgttcagtccacaagcgactgaattagtcattaacattgacagctcaactcccttattgacggcagaatagatcatccacgtcgtgtttcccaccaagttaatgatcgtaatgctagcattccaaagctctagtgtcagcaagtatctacccttcaaggcaccgtaaattattgggattgctgcctgaaatattgatatggttcctccaaagattgaaccatattgttggataaaagtggccgtggccttaaacaacaaaatagagacaaattaactttcatatgttatattgtcatcataactagtaatatggagcatttgataatacaaatca

SEQ ID NO: 41223 - DNA, 1503 bp, Oryza sativa
cgtcaagcgccatgctcccctcggcgaccagttgcgcctccccgccggcaccgccgccgctcgatccgcaccaccgcggctccggctccggctccgccgctcaatccgcaccaccgcggctccgctcgcctccgccgccgcaacctgctcgtagtggtaggccgcgctcggttttccagtctgggccatgtccaaattgggccggccggcccatcaacccttcctcctcttgcctcgtgactagctttttctcgccatccatggcgacgaagacgacgcagtgcagttctacgactagggagtacccactcatcagccggacgaagaggagagcagctaacctagcacaagcacgaggagtccccattccttatcgaatcaccatttctgatccccttcctcatctggagtgcggaacaagcacgatgtacgactacgagtcccccattccaacgcgaatcaccatttcctcgatcgatcgcctccctcatccggaggccagaacaagcaccctcatccggaggccagagcaagcacgactagtcccgagtcctacgcgaatcaccattcctctcgacccccttccgcatctggaggccggactggtcaccgagctagcttagcgcccaacgcgtcctcaccgagttttcgcctaggcccgccgcttccgcaagtatgtcgtaacgcacgccgtccccttcacctacacgcacctactccgtcgatcacctgcgctctactccgtcgatcacctacggcccggccgactcatcagtccatctatcacccttgcgtgaacgtacctcattcatgactgcgtacatccttagcgacgaaggtgacggcaaaggtgctcccgggacgccgggtgatggcccagtcctcggcatgccgccgaaaatccgacgagacgcccgagctggagtaggcgatgaagcgatccagggggacgaagaagcgaatgtcgtagagaacgccggtgtagtagaaggcgacgccaccgccgtccatggtgaggaggaggacgccgccaccgccgccgccaccgaccgcatcgccttcctcgccgtcctcgccgccgatgcagagagagatgagaatattttgagtcgaaccattctggagaggagggggcgaggggcgaactagttgtgagttgtaactgggagatctatctggtttagcttttatacccacagcctctccctccacgccggccgggtccggacccctccacgcaattgtctccaaatttcaaattttgaaattgcgtccaccgtgtaagaatttcatcgacgcctggctgcattatgtgtactcctgtaaaaagttatttttttgaaaccttagccagcttagctggttttatatttcagaagataagcacggtacaaatgccaccaatggtgacaagggggaaagacagggggaggagagcagaaaaaaaggaaaattacaacaaaggatgagaggttaaggcgctattctcgcaagattttttgc

SEQ ID NO: 41224 - DNA, 1125 bp, Oryza sativa
gggaagattgaatgaggcaggcaatttgtttaagaagatgggcaagaaggggttcaagccaacaatatacatgtatgaggcgaagatcacttctttatgcagggaaggcaggttggatgaggctgtgaaggtgttgaaggaggaattacccaagaatgatctcattccgaccgtcacaacatataacttgctaatgaggggactttgcaactcgatgcaatcaatgagggcactcagataccttggaaggatggataaacagcttggttgtgttactcggaaagagacattttcaatcttgatcagcggcttgtgttcagaaagccggttcatcgacgcagcacagattatggagaggatggttaagggtcatcatagacctgaggcaggcgaatttaacaatgtcattgaaggtttatgttctgctggtagaacatatgatgcattgctatggcttgaggagatgatcgaccatggagaaacacctgatgttcatgtttggtcttctttggtttcagcagctttaggattaggagaaggccttacaactgctgctacgcattaagtgggattgggccaagtacattctttaagcacaaaaacatcactggtttgagcgtacagaattagcctcttttgtatgtaagtgaagtaacatttttatcatcctgttatttatgcagttccaaaaggaatatctgtaagctaattatttctgcatgtagtaacaatatatcttaaatctactttagtcttaataatggttgcgatgaggaaaaacagtaagctgtttttatttactatacttaatactacatgttatgagttttgagtccactgcttagacgttaaacagagcattaacttgtcaatgtgatgtataaaaccatattgaaggttgattatattgttgccacaagatacgagttaaattaacaataaaattagcatgtggtattttgtacattacaaaattgccaggattacatcaaggcagaggtacaaaattgccaggtggctacatatctgatggatcaaccaagcagagtttacaaaattgccggatcttctccagactactaaaactgctggatcaatccaatctaacctacaatattatcgggt

SEQ ID NO: 41225 - DNA, 2270 bp, Oryza sativa
ccacgttcgtgacgatgctctcgtcactgcccgtggcgatgaactggacgggcgcgtccatgaagttgtcgctggtgctggtggtttggtaatcgaacacggttgtgtcgatgtagttgccgtcgatgtcgcactcgatgtcgatgtaggggtgaccagctgatggcacgatggcgttgcacggctcgccgtcgttgccccatgtgccggccggattgtgccagcagccgttggccgccggcgccggcgccggctgcatttggttgccgtagacgccaatgcccatgtaggggtcaccaaatgatggcacgatggctttgcacggctcgccgccgtcgtagccccacgtgcccggatcgtgccacccgccgttggccgccggtgccggctgcatctggttgccgtagacgtcgttgccggcgatgtccatgtaggggtcaccagctgatggcacgatggcgtcgcagggctcgccgttgccgtcgacgacattgttgtaccagcattggaggttgccgtacacgggctggacgaaggtggcgttgcatggctggaagcctccccacgcgagccggctgtggttgttgctgccattgcccggcatctgcatctgcagctggtagccgctcatgtccacggcgccatggccgcccatgtactgggcgttgttgtaccctggctgcatcagcgtcacgccggcgttgtacggatggaaggggtcacatgtcgccggtgcatgcacctcctggtgctggtagccgtgtacgccgacggagttggttccggcgacgtcggcgtcgcgccgccggccgccgccgtccgcgtcgtcgtcggcgccgggcagcaacccgagcgcctcccgcctcttggccgtagccagcagcgtggcgtcgatggacgcgagcagctgctgcagctcgtcctgggacatcccgtccagcacggcgtccggcgggtcgagctcgccggggcggcccttctgccgcagcctggcgagcttggccctctccttgtcgagctcctcctggaggtaagccacgtgcgtgtgcctcgcccgcttctccgccggcagcgcgcggtacctctcgatggcgtcgccgccctccggcgacacccacacggtcggcgcgccgccgtcgggcccggcgcacacgacggcgacggggatgtcgcacagcgtggcgagctccccggccttcttgatcagccccgccttccgcttcttgtaggtcgtagcgcgcgtctgcgggttcgcgatgagggctatggatgtcttccggcgagacatcgctggagacgggagtcgatcgatctcgatggcgaggagacgacgggtggattttatgtggtagtacgtgcgcattatcccagtccgattcggacttcgtatcggcgaaaatctgagtccgcattggattttgttgcagatcacgtatatggatcagacggcgccctgtactcggctccaggctcacccttgcctgtgcgactatggctcagttctaaccccaaacttcaacttcctcatttttttttgttagtttcaagcttataattattaatgcttgtgctaatgaggtttaaatctgtcttcaaagggactgcctatacatttgtcgacaaaattttcaccaaaaaattgacagatgtaattataatataatcgtagtgtaattacactataacttatatgtaactacactgtaacttacatgtaactacagtgtaacttatatgtaagtgtcacataattttgaatcgttagatctattacacgatttgttttggtgaggaagaaaacaaatcatagcacacacatatatgaaagaatttgttcccacgacctccattttaccgaaataacatgttacggagagatttttgaaagttacatacaagttacactataggtacagtgtaattacatacaagttacagtgtaattacactacaattgtactgtaattacatacaagttacagtgtaattacactacaattatactgtaattacatttgtcaaatttttggagaaaaatttgtcgacaaatgtataacaaaatcggtcttgaaaacggacgatcgaaagcacctctctccggatagtccggtgagcccacaccaccgttaaggcgttaggtatcgtgaggcccttcctttaactttgcaacgcgtatcctattcgatctgttctgatgcctcctaattttgctatcttgacaagatttcgattaagatttataacgagctacgatcagtggaggtgcataa

SEQ ID NO: 41226 - DNA, 10873 bp, Oryza sativa
gctcagcttatctcaaaaaaggtttgtgtcaatcacatgatagtactagaaggtaactaagtaaaagccacttggtcatcacacacaagggcccagcaaagatgcacagattttggaacaaaacacaattacagtgtactactacttgccttcttcaccctgcagattagctttggtgagatcttgtacaggtcctcatccactgccgtctttggcttccacttctgctgctcattcagatactgctgcttccttcctccctttctcacacgcacagcattcgcattcgcattcgcgttttctttctcccctttcactcgaacaacgcactgcattttggtcacgaaatcatcagtctaaccgtttgttcttttgcagcaacgctatgacttaaaactgaactaaactgatatgataatagttaggtgaagaagactgaagaaaagttcaagttttttttttgtcagaccttcttgtagttgtaggggttggcagggaactggggcaccttgaagaggtcctcatctttctctgcttgtgctgtgaagaagaaagtccctgactcgaagtattgggtgacgggcatatcatcccatatattccagtcgccgaacgccgggatttggcgccacttgcagtcatcgagcgcctgtcagagaatggaacaatctttactgttaacttatctctgtaagcaactcatcctacatatatgtttgtgaaaaacagaaaagatatgcaggaagcagggacgttgataaagaggcatctgagaactgaatctttgagtcaacctctcattggataaggaaaactttgaggtgatcaggagattcagaaaatcagaacagtatatgccaatgcagcagaacatcacccgttcttttctccctagaaaaggctctactattaagagcagtacaaacaccacatctctacatggcaaaaaaaaggatccaaggctagatagtagaacacaagctagttttgccacaagaagccaagaactgagatagagattagtgaagaagagaaaggcaacgaaatgcaaagcatttctccatggctcacctccataacgcagtgacagaaaagaatcagatcgcgaagaggaggaggagacgaagaagacgatcgatgactcccaacgatttcaggagacaggtgagcagcagcaacggctcagtggtcaaagctgtagtggagcttgctagctaggcattggtcagtagcaacacggccgcatgcagatgagcaagggagctggtggctgtgtgcatgtatacatagccacgcgaaaaagctcgaggaggagagggggtaaagagaatgtgggggcacacacgtaccgaaactttgcagaaagcccacaagaaagcaagcgcccaaagcagccaagcagggcagtgtgtttagctgttactgaaccgaggcaatgagtgctgcactgccagtctgctactgctgcttgcttcacgctcgtacgctctcatctcacgcaccaccctattacctattactcccacataataggtgacgtttttgactttttatttgcaatgtttgaccattcattttatttgaaaaattagtgcaaatataaaaaaagataagtcatatgtaaagtacttttgataataaagcaaatgacaaacaaaataaataataatttcaaaattttttaaataagatgaatgatcaaacattgataaacaaaaactcgaaaagacaattaatatgggacggaggtattaccccttggcccttgctttacgagtttagtgtctttagtgcagtcataatactgttcatcctgtcccatcttgctcgctcactcttgtcaaggcccatgcttacttcgtttcaaaataaattaacttttacacataaatctaaatagaaggctatacttatatttgtgtaaaacttttttctaaataaagagtattttcagcttatcagcccgatatcattacagattattcatgccatgcatataaaacacggtttcttctgaaaactttctatgcaagcattatttataccaattattataggccatttgttatatttataagatatatggtttgtttggacgatggaaaataaaaatgatttcccgccattaaaagataactttaagttctagccatccaattttaccacatcatttcatccaagccctcatttctctctttttttttttgagtaaatttcacaaaactacaggtattttgaccaaattatcacaaaactacagatttaaggagttatatcacaaaactacatatttaacaccaaatttatcacaaaactacatattttaggttaaatatcacaaaaatgcatatttaatattgaacttatcacaaaactacaacttttggagtttaaatccttagcacccttgttatggtggagctataaacattattactttgtgattaaattggttctaaacctgtagttttgtgataatttagttactaaacatgtagttttgtgatacttcatcttaaatgtgtagttttgtgataaatttagtgttaaatgtgtagttttgtgataatttagtcatactatctatagttttctgaaatttactctctttttttcatgtcccgttatcccaacagacccataatatttaattctttcctacagataagcaagtagattatccactagtttctcatcccatctgcattattttacctaaaaagagcagcactctgtgtaaacacctctctatctgttaccacctgtcaacctctgagagggagagtggcagtaaaggtggtggcttttgggagcaagtcctggggctgtatgatgatggcaaacaatgagtgtgcgtgtccgatgcttttgtcacgcactgaccgggtgatagtcgatggagggccggggcggtggtcgtcccggccggccgcccggtcggcagcgcctgcccgcggccgggctgcggctggactcgaggacacgcatgtttagcgagaaagcagcgaaaggtggccgcttttctttccaaccatggccaaatcacaatgattccttggttggccggccccccctctgcacgctttgcccgcgccatgcgcctttaatttcccacccccctgcctttttcaccacttcgccattacggtgaccaggtccaggctttgattacagccgtgacgaaacctgcgtaatcttgtgtacttttgggtgtgttctttctccctttcctaatttctatagtactagcttgctttttgtgcgtacgcttttcaaactattaaatattattataattgctttgaaatcatagtaatctattttaatttttttaattagtacttaattaattatatactgatctgtttcttttttacaagtgtgaaggattagtttataatccactatacgaacacagtattaccgtggcatttggcgcttcctaactccaaagcttgtaaacggtgattttcctaaaaagaaagttatataaaatattctttaaatactttttagaatatcttttacgtttataagagttaattattaatttgtttatactctcagataactatagaaaaatcatcaatttcagctatctcaagcagtgcctaactgcctacttacctgtggctctgggctgtcatttcgataggaaaggagaaagttctgtacttagtagtactagtagatggaagaactagtacattacttattacggaaaacaagttacgaattgctgctgattagctcgtgtgtgtatagtcgtcgtacgttgagtatgagtcaggtgcgtgaggtcttgtactcttgtgtatgatgtgtgtcatgacccttttctgaaagtcattcggtgtgccactactagtcagttcgccagagcatgtatggtggtactatggtatgatgctgaagttacatgatggtggtactcggtagtacttgggtataataatacattcttggtaaagagaggagttcatgattatgtatgtatgatcaccccattggcaccatgtattaccacgcaatcagttaaagcaactttaatttagccaagttggtattactacctgcaaatgctttggatttttcatgtattgaggtttcaaattaggctatatactgcaccacaaactacaaagtttacaaaaggaattacttctggccggtctcagcaaagcaaatggaagcttaagtttactgctaatctaatctaaagttgttcttcagaaaacaaaaatctaatgtaaagttgtctacctaaagttacatagagcaatgatccgggccatgtacatgtggatacatctatatgggcctttttgttgggccagctaagaacctttcggaatctgctttgacaaagacaggtgcttaggaacctggcgaaaattttatacttcacggcccacatatatagctacccaacatcttcttccccttctttttccactttatctttctccaaattttaacatgtcttctcctccttttgattaaaagtttacagcctctctgtttaggcttttgatgtaccctctcctaatctttttttttaccttctttttgatgggtaggcctcctaatcttaggtacagtgacagtgcagagtgtcacaagtgacatctagatctgcttttcttgccagctatagctgctgcaggcagctgtagctaacagtaattaagcttctgatggttctcatctaccctactttgtgtaggtaatagacatggtcaatttgactttcttgttgtccattccatggcagagcataacatggggcaccgggaccactgctgtgatgcaaccccctgctttcgtttttggttttctcggttctgaagtttgaacaaaagctgtagcagtgtaaccgattattaatctgcagaggctgcaatgcagttctaagtcaccaggttatcaaacagtaacagtaatagaactgcatctgcatagttagagacacaaatcctagcagtatagtacaatactgtagtggagtagtagttacagtgagcatcagagcatcagttgcaacttgcaagccaaacattcatcagttagatcagtctgccttagtaatcatgagtttgacaggcatttcatcatgccaagatatgattataataattctgtaatgcaaagtgtcacagccaaaataggacttttgtgcatattctcccactcaaacaaaagaagacataatatagtttggtgatcagaaagaacataaaaaaaatcagaattggtcacgtctaaggtggtgtttacatccagggacttaacttaagtccctgtctttagacactaatttagagtattaaatatagactacttacaaaactaattacataaataaaagctaattcacgagacaaattttttaagcctaattaatctataattagagaatgtttaatgtagcatcacataggctaatcatggattaattaggctcattagattcgtctcgcaaattagtccaagattatggataggttttattaatagtctatatttaatatttataattaattttcaaacatacaatgtgatagggacttaaaagttttagtcccatctaaacagggcctaagattataaccactagcactcaggccaggccaacaaactgtcacagcctcacaggaatgcagataggttactttttacttcacttggcccggtccatgtcccattcccggacggaaaactcttttaatcactactagtaagtggatatccacccgttgattattatatcacctgaatagttacaaaaatattttaaaaaataataaaatagatcaatatgtaatatatcactccacaaacatgtaagttaaaatttaactttctataaattgtaatgaaaataacaaataaaactcaaatcagtatagatatatttgcagttaaatttgttatttttgttaagactcttataaaatttgaatttgaacttacatgtttatagagtgatatattacatatcaatttatcttgttaatttttttaaaaattgtttcataatcatttagttgacataaaataaaaagatagacgttcactcacgtgattagaatccatctccgaccgaccgcacatacaaagaaactcctacttggcgcagaacggcggccaactccagtccaattctaacccgaggccccgccgctgcatgccaccatcggctttcccgccggtacggccttgcgcccagcagcatgcacatggacacatgcaattgcaaacgcagcgcgcatgtgcaacaacgcgagcagcaatatatgagtatctcatcaaatcgtacgcgcgcctgcatgcatatggccggagccgtgtcttcacggccggcgacaagccggcgagcacatggacgcacgtcgtcacgggtcgccacggcgcgcgtgagatcccccatgtacgtacactctctatatatacaaggacatcgattgacagtacacatcgtagcctgcatcaacgcagagatcgatcgatcacaagaacagtaataagctagctaccgcaccaacagttaataagacatggccggcgggaagaaggcggcggtggcggtgctgctcgtggtgatggtggttgtgtcgttgtcggcggtggcgccggcggccgccgcaggtgcgccgttcatggtgtgtggcgtggacgcggaccggatggcggcggattgcgggtcgtactgcagggccgggagcagggagcgggcgccgcggcgggagtgctgcgacgcggtgaggggcgccgacttcaagtgcctgtgcaagtaccgcgacgagctgcgggtcatgggcaacatcgacgccgcccgcgccatgcagatcccgtccaagtgccgcatcaagggcgcgcccaagtcgtgctagagatctagctagctagcttcagttacgagccaatagctagctagctaagctcccgacttaattaattagtttcaaataatcaatggtccagtaagatttgtactcaatatttgcttcttggtttgtcacagtatttcatttggtattgtcaaactatatactccctccgtccctaaatatttaacaccgttaacttttttaaacatgtttgatcgttcgtcttatttaaactacaacatatatatatatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatgatgcccgggcaccatggagcaccaaacaaatttactatatatatatatatatatatatatatatatatatcatggaactttttggtttgcagtatatatggggactgctatatcacgagatcgtgtttgaacaagataataacaactacatagactattagtgatatctattaagtatcgatacttgtgaggtattaaggaccttaataggtatcgaatgatatccatcggtactagatctagtaccccattggtacttgttgatacccgttaataccactcgatactcgtcgatatcaggatgatagcaattggtaccagacctgaggaagagagagaagaaggaagccacgacattgtcggtaggggtaggtcaagagcctaggacaactcaaggatgacgaatagcctgggaggaggagcaactaggaggcgaagaggatgtcggtaatgacgaggagctcgctattgcacataaggagcggatctaccttgacaatgcgctttgcaaactacttgcaaccaacgaggagcttccccatgatctccaaccaactgcatatttacaaaccatatatatcagtattatgcctgtttcaatttgtacatgtcaaattaaacctatatatttgtagaatttgtagagtgatgtgtcattgatatgcattgaaaaccttttataaactattaagaccacacaaacgataactcatctccttaagagacaatgataacttatcaccgtcagcacccacaggagtgatagatccgcccagtccaaggatgacgggagtggcggtctcggactgggcagatccgccgccagtgcccataggagtggaagatctacccagtccgaagacggtgggtgtgatagcggtggcctcggatggcgggagcaacctcgaactaagtggatccgccatgggatagcggtggcccattggagcggttgatccgcccaatgggagcggttgatccgcccaatccgaccggcagctggaacgacgatggcggtgccggctgtgacaacgacgacggccacggtgacgacttcaggtgcaacggtaatgatggtggctttggctgtggcgatgatggtggtggctccgatgacgttggtagcttcaggagctatggtttcgactgaattagttttttggaattttattttttttcactgaaattgttttcacagacagacaacatatgtgcccacgtacgaaaaccccatatttgcacgctgttgcgcgcgctgcatatatgaaaatgtgttgattttggaatacacctaaatgcagctggctgcgcatcacccacatatgaaaatggattttggtcatctgcgaaaatcgtttttaagtagtaccctacctttttagcgatttctgctccgtcctgctgctaccgcgtacatatacagtaccgcctgaatctggtggccgccgcacgttccattcgcgccgaccatgaattaacttgttctaacaccgcgccgtccttgctctgatcgaagctctgaacaccacccagccagccggtcggtcgacgaacctgggtaaataacagccacttgatccacacaagatggcactccacacagatacgtccaactaaaattccagcctcctccgtcttgcccattggctgattggcttcgcgctgcagtcctcacatagggcatgtttgtgcagcttctaagcagcttttcatccagattctgagaagctgtagttataaaatttaaaaaatgaactaaaagccaaaagcggagaaactcagcttttctagattatgataagctggctactaatcagctgcttctcagaatattaagctctctaaatatgccgatagagtactgtaccgtaatacagacatgcatttcaccgtacgtgcctgcagtagcagacatgcacatgtacagatgtactagcgcagttgcgctacctgcatgcgtatatacgaccgtgtgcatgcatatgcatggcccgggaatccacggcgtctcgtgaacgtgccgacgcgatttgatctgagctttgcccatgagtccgtgacatagctagctaatggagacaaagctagcgcgcgagcacatgcacgtcacgggccgcgctaacttacccccacgctatataagccgaccgtatatagccatcttagctacgtaccacacaacgtacacacgacgaacccccacgacgcacttagctaagctagcgtatagtctctgatcgatccgatctccgacgacgacgacgacgatggccggtaaagtaagcgcggtggtgctggtggcgttggtggtggtggcggcggcggcgggcggcgcggccgggctgtcgatgtgcggcgtcgaccggtcggccgtggcgctgtgccggtcgtactgcacggtggggagcgcggagaaggcgccgacgaaggagtgctgcaaggcggtggcgaacgccgacttccagtgcctctgcgaccgcagggacatgctccgcaacctggagaacatcgacgccgaccgcgccacgcagatcccgtccaagtgcggcgtccccggggcctcctccagctgcaagtaatttacattaggtgatcgagatgatcactctagctagccagctgcaaaatcacactctagctagctagatgatcgatgatcgatgatcactagtgtgtttctagtggttaaataagtattgttggttggttaattaggggggggctaagtatgtgatcgatcgattgctagtagtggccgtgttatgtcaggccatcgtcgcgtcagctggatcttattttgttctgttgttttgagtagttcacgttctgaatgtcgccaggctagctgacatgtgctcgtgttgctcttgcatatatgcatggcgcagtctgcctgtctctatgtatcaatcttgtgattctcttgtacgtcattgctgtgtgtctaccttaatcgtgttctcataataaattttgctgcttgttttgatctaataattttgctatcttgtatatctgaaattggcccaggaagcattactgattaaacaatggcgagattaattggatgtttcagttggctaaaatcaaaattttcccatttttgcatgaatttatcaaaattcttgtttccatatataatttcttcgtgacatgcaacgtaagaaaatcataaggtatttagtagcagcaacataagaagaagaaatcaattccttggaatttccccaaatgtgttgtctaaaataaatttgcatggaattttcttttgataatctctaccaaattgcatgaaattcttgagatttctgatctctgaaatttcagaatgccccaaaatttggaacatcagttatgggcgaaaattcattatgtgtccatgaaattgtgaccaatcccttctatacctccaagttttgtccacttccttatatgcattttttttttttgtgcatcacttccttatatgcatttgaatgttggttttgatcccttttggacccattttgttagtagaccatttaattcctataaaactgttcattttgtccttatgtataaagaaatatgaaattttgtata

SEQ ID NO: 41227 - DNA, 15644 bp, Oryza sativa
atattatatgaaaggaatgctatccaaaactatgtttaccattttagaaaatgctctctctctctctctctctctctatatatatatatatatatatatatatatatatatatatatatatatatatatatatatatatatatatatatatatatatatatataatattatataaaacttcgatgtataatactttctcatacaacaaacttatgaatattacaaccacacaacaaattactatattcccaataatagatacaaatttctacatactccttgcacgtccaaggttaaaagcgatattttttacactattaaacagacaactaatggtgaattgatgggaaggctgtggaagggatcaaaaccaaaatataggagtatacaaaggagtgaagaaaattcaagggtatagaaaagattggctaagatttaagaggaattgaaggaattatctctttttctatttgttggaagcatgtaaaacacctactacttctgtgcaatcctattaattgggccagcacatggacacggggggaaggaaagatgtccccaatctcccaacatggacctattgactgttgaaaaataactcactcgtgtcctccagattaaggggatctctagaacgatgtgctatcactcgtaaccttgtaacaaattggttaggcccactatgcatgttgttcattgatagggcccatagtcaatggacaatgctacaagcctacaatggctcgattcgaagagcgtatggcacaggatttaccaggaatacatacttgcgaggtaatttataaaatgtatctctacaagtccaaagtctatgagtatgtccttcgatgtcgttgagacgttgattgtaaactcaagttgagacgttgttacatagaagtaacggactcaacatcaagcaattcataatgaactaaggccctatttgtttcagcttatgattattataatctagattattaagccagattactataagctggattataataagctagcatagaataagctgtgagttgtttgtttgtctggattattgaaggcatggattattgggtttgaaaagctaaagtctataatgccctcaactatatgttcggttgatggcataggtgggtaatttttctcaagtatgtaggggtagtgggtctttagccactcaataatctgaaaaaagctcctctagagcagcttatcagattataataatctgctataataatctacttgtttgtttcagtttactcctaataagctagattataataatcctaagctgaatcaaacagggcctaaatatcatgaaatcccttggagtacccatatgatgaaatctcctttgatgtcgactgggcactctctctcttttggagctcctctccttctctgtggcgagctatatgcctatataggtagagtggagaagatggtcggtcaatagcgaaaggctcgggctaccaagacgatatcgcctaattctagactctccttggctagatctggcaaggtggctagtagacagcgggtggggcggaggagacctaagctagtgcacaaaagtggcgacagggtgcgctggtggtcttgttggtggtaggactagaaatcagcccgcggaagggtgttggtttggtgtggtggagggcgcatgctgtgaacatttggatggtggagcctaagatagtgagtgacataccacaatgatacgattgtacagggttccaagcgaaagcctaggctgatgatttgttgggctaatagcgggtacacctttgggcatggtaatccccttgtggcactgttgaggtacctccttcctccctatcttgacaagaatttttaagtgaaaaccatgtctaggttccttggatgggtgacggcagcatccttggcatcgcaaccttcgtggtgactttttttttggagactccgctatgtggctatgtggtactgttgtaggcctaacgacaatcggccatgcatagcgatgacaggtttggtgcctgactcccctcttagtagcatgtgtttgtgtggttggcacatggttcctaggtgtaccaactgcccacgtgtgctctggtacatgaacaatctcaatagccttctgttgattacagtatttcttgaaactttttccctcgatcttaataacatttggattgagcactgataatctattagactttgttcgacaggatcctcaaatttgacaaggacctccgtggtaaccttgagttagatccagtgaagcaaccaacatttctgcgactcaactctaaatctcaattagtgccgaatccgtgaaagtagccataggaatcgttgacatgtcaagagggaagcacgtctatagaggccctagaatatgatagtcgcggcaatgccacaagtccccaacgattgcatcttttattggtgcatggttctccatgcaatctggaattttgcttccttcattcagtgtttttagaaggatggttctccaagtttattggtgtaatccttttgctaggcgatgtatcagggaatatatttcccgcttatatactttttcctcaagctttaaatacattttatgagtcctagaaaaaaaatatttggatgcctttttcttacgggttgattccgtcatcccgtaaggttacaccacgctattctagttacagaaagaatacttcgagggtctacctatagtgttcctttcttcctaaaaaaagcctcctatatatttggcgaatatttttaatactgaactgtaattaacgcgtagtgttaattagtgtaactttcggtactagatcatattcttaggtgctagaagggacacgtacctgcagggccgtgaagaaccccagttgggggaaccacagccaatcatctctgactcatcccagcaaccgtgaatcagctcagggaaaaactgcggaaaaacgtaatcacatatcaatgtcctatgctagtagcctgtggttgtgcaacatttcagcactctacgacatgcagaatcagacaaaaagggaaagaaggcaagtccctacaggcttcaacgcgtgaactcgaccataaaattcagtaacttctcacaggcagtaagaatttttacgcaccgaatgcttcattgcgtgcaaacatgccctgacctggaaaatcagaagcttgcagtccgcttgaaaaaacaatattgttgttagtttgaccaagtttagatccagttgctgtctcgtgactcggtgaccatcaccagcatctcctagtggtgactgcttcggaactgaaagcaacaagagctaaacattgcccatatccaccacgaccaacatctttagaaaaagaaatagactgatgcaccgcagatcagagcttccatcaattgctttctgcaagatatccaaactgttcatagtacggctctgatagtctgattctctgaatgttgtcccaagatccaggtgcagcccatgccgtcgtgtaacaggcggtaagtgccagtgatgaacaaacaagaggtaaccggccgcagaaagccagaaatgcaagaaccaagcatctccgtctcattgctttctcgcccatcctctgccaccccaatagtgcactgcatacaacttttatataaccagatgacacgccgtgcctgaatgcttctgcatcttcttttactgaataagttccaccgctgcttagattcgctgactgtatccgctgctcggatgttccatgattgctacaaataattgtcccctctttctacatgccctagttctgtagaacaaaaagaacaaagagggtgaattaaatggccaaaaaagcatgatatttgactattcatgttcaaaatgaagcaaataattacagaaaatacgatgcagaagagcacatgtataacggacaaggtggtgcaattgaaataatgcaagtttcagacacctctgctgtgattttatcctgtgtgcgcgtgcataccagggagatgagccatctggtggtctccgcagtccccactgctccccttctcgctatacaacactgtctgcatggtatggcacagggatatgcatatgcctggcatgagcagagccacaggggtgggcaggcacacacacaagagccattgcaccagcctccgatttatatagtctccagcatttgctccccttgtgttgcttctctaatccaggcacaccaccatcctcccattctctatccatttgtttgaagaagggttatggccaatgcttgccccacatctaccacaagctccttgcccctcttcttcctcttctgtttcctgctcttcagtcatgctcgttgcaatcaagggcaccatggcagcatctcaggtacccctttgcatcagattgatatcttgtcttttcttctgttctcctgcatctattaactgtgatttaggttgacatgataaaacctatgtatttaaatgtttcaatttcatatgatgtcaaggtacagactatggagaacaatatcctcaccaaacattacctgaagaacatatacatttgcaggagaacatcaaggtacatatgccatcttgctattacaaagtatgtaattaattgagttttgtgtttttctgttcctcaagtatgttttcttaaaactttagttttatgttttattatgttcattatatatgtcaaggaaaaaagctttcccccaactgtcagcttccttggcgcataccatatagttctggatggacttttcagtaggaagaaatggttgcatctatcaactgtgcactgcttggcatcttttgctaggatgagaaaatgattggtagcaacttgcctcccatcttttctcctaaagtagtatgaaaagacttaagaacaagaccaaacaaacatgaatgccaaagttaaatcagaaagtatgtaaatatctggaagatactatggttaagatgatcttcaaatgtatgccattaggttctaaacaaggagaggctgcccaaatatgcaaggagaatgttgattggttcgactgctccaatatgcacatacaacgagtgcagagggtgtcgattcaagtgtactgccgagcaggtcccagtggatgcaaatgaccccatgaatagtgcttaccactacaaatgtgtttgccacaggtgatcattaataattaagaggagcttctgttatgagtagtagtttgcatccattttattctctttttcccccttctacccttctaggctcaaaaggttcattttttccccttttgttttaacaagtggccagctagtagaggattagagggcattttgtattttaagatgttcaggttgtggactggtaattttggaagtaaatgttaaaaaatttgaaaaacagcttatttatactattgtgcagacaaaatgttccttgcttacgtattgcaccactgtttttagtctatgaacaaacctcgatagagttgtctgccagaatagccttggagctctcagctggatcatctggaactagtggtctgcaactgtgctagcctttcaaggcatataaatgtggtaaatgttctattgcatttgaaatttctcagtaccttcttcattctgggctgcttcagctctcatgggcttttgtcattcgtctttccatagtaacaaccatctgtacaatgagcagtaaattcatctagacaaatcacagaagaagttaaccaagagtaagggtaagcaataaagaagactttcgtgcagaccacactccttcattgaagtagacattgcattctaaattcaatcgagcagatatgtatgaggaaattgccaagactcagacaatcacatgcacactgaccttaaagttaccaagtaaacttatcaatagtattccagtaaaaagaatcaatagtagttcaaaaatatcaattgaaaccgtttcagtccaaacagggcatttattttgcaagcagagagcttgcagaggtgccttgtatttattcaacaaaatatttttagaggaattgtcttggtaagaaacacttattagctaacttcttttactggaggtgtaaggacaagagtaactcatgcttattagaggatactgacaaacgtagtcacattcagacagtactttccttttgcaagaagtgttctcttcagttttttttacccaagtcacataaattactacagtcttttataagccactgctcacccaatatactccgtagaagttttgcttgtgcatgagtgtgtgacatgactgtcaagctgcggctgcaactagagtgagacgagcaggtagcagaactatggtgatttgactgattggccacctaggatggctacgccaggtcttgtataatctatatatatggtttaccgaacaccgagatatgcacagataattatggtgttttatggtgtctgcttgaacattattcaattagtgaacaaaggaactggtgagcatgtgtccaaagaaatatatagtaatgtctcagttgactgaaaaacttcataacttcctagttcttatgcacacaaaaatcaaaagcccttctgggtgggagtgggacacatatactaattcttttattcagttggtaataggatacttgaagtcttgagctaagaaatagactgagcaactatttcaaacatggccagctcctatagtgtgacaggtgatgtgtacaagcccccagaactcaactttataaatggtcagccttgcagcaatggagacaaactctgcaagcaagtaaatcacactatttctgaccgattacatgtgaagataataacttcaacacaataacacatattcctattgtagcttcaaaaattcaagtggcttaaggaccagcattgctaatctcataatgagaaaaaaaggaaaatactagtagagtggtattctgagagtgacacaagagggaagatgcatatggtacaaggaacgaaagctgccacttagtggcctgtggctctaccgctccagtgctaccctttggaggtaccgtggtagaatgaggtcaccatttttcttaagaataggtcgtagttgctttctgtgaggtggtcctgcgtgcaaggaagaaggcattcacatggaagcaagcaggaggatccatctcgagctgttttgttttgcatgacagaagatggcagaatggtcccagtacgttggcacacgggtcatgcaccaaggttgacgtgaccacaacaccaagcatcatagccttgcaggctgtagcacctccgtatctccatggtgttcataattgttagtgccactaaaatataccctaaattagaatatgcttctagatcaggagcatacaggacaggctaattattttgacatcacgagtagatattctgggaaaagggatgtcatggaatagaagagatgtgtcatgcggaagcaaatcataggattggcgcaagctcaatggcataagaggttttctcatgtctaaatgtcagttactactatattttgcatgcggctaaattccattttcatcaacaataattagatggaatgtagaaaggaaaggaaagtaacttacagtattatatgcatattattcgacaccttcagccttaattccaacaaagtaaaaagatcaacgcagcagaggttcagactttagaggcttcttagtcaggattgaaattgtggttcagcctgaaatcatttcaaaaaatttcatgatcagaaagctgcagaaccacgctttttcaatatacccactgagacagatttcatagtaaacattagcaggatcatagcttcttagctcaaccatatgtttctagtacatatggaatctgaaaaataaaatgctatttaccatgtgaaagtaaaaaagaaacagatacgatggatcactccatggatgccaaagaactatatatgtttgggaactttgaatgagcctgcaactgaatcaagcaaaatgaaaaaaacaaagagcaccactatctgagtaactaagcgcctgcttgggctggaaaaacttatactatagtttgcttccatcagggtgcttaactacctggtacgattttcaaccttgtcgcaatctccaagttccttggcgaaaaaagccaaagttccaaacctccaaaacaacacttcatgttcctgaaccaaggaagccgggtaataatcaggagaactaactggaatacgaacacaaaaaagggcaacacagtacgtacttggataccttttcagtttgacttatcaagaaactcacaatggcaaacactcatcgttcagcttcagggggaaaaaaagcttaacaaactgggatataatgatgtttcaaaagctccctccagaattatagcgtcccatgtcaagaatgtcaaatcaatgaacagacacgataacaaaggatttggcacatttggtacacaacaaaggatcaaatagatgctgctatgttagataaattccacagcgtcaagtaaatttcctccttgtggggatgtgaactacctccattcacaaactcatgaatttgtccatccacctcaatcacactccgtccaatgttctttttcataccctcagcactcatcaacttcctaatcctgaaaacatcatcccacattccttcatcagcatagatattggacagaagaacatagactccagagtcatctgctccgagactggccagacgctcaactgatagctcagccagctccacacacctatggcttcggcaggaagcaagaagagatccccataattcaggagtcggttccatcggcattgtctctattgtgtttctagcctgatccactcgtccagcacggccaaggagatcaatcaatgcaccataatgttccaccttaggttctagtcctaaatccttctccattctgtaaaatatccccaaaccctctgagactaacccagcatgcgtgcaagaagtcaacacagcaagtatgctaagatcatccattggtgccctttcagtttccatttggttaaaaagcttgatggcatcaagtccataaccatgagttccaagtccaacaatcatcacattccaagtgaccacactcttcttgggcatgctttcaaagatcaatttggcaagatccaaacgaccgcatttcacgtacatatctatcaaagctgtttgcaccacaacatcgaacaacaccttcttcttctccaagtatgagtgcagccacctgccttgctccagagctcccagctgtgcacaagctgcaacagccccaactgcagctactctatcaggcttgataccacatcttagcatcctctggaaaaactccaaagcttcatttggctccccgaatctgacatagccatcgatgacaatactccatgagatcacattcctctcaggcatctcctcgaacagaaccctcgcttcatccattctcccatgcctggcataaccatcaatcatggagttccagcacaccaaatccctgtcaggcatttgatcaaacaactcacgtgcacgatctacaccacctgccatctctccgtacccatcgatcatggtggcccaggagaacgcatccctctgccgcatttcgtcgaacaaatcctgcgccagatccacctccccacacccaacgtaccccgccaccatagagttccaggagacgaggtcccgcacgccgtgatcgaacaccttcctcccggaacggcagtccccgatcctgcagtagaagctaatcagcgcgttcctcgtgaacaggtcggcgtccaaccccgtcctcaccgcctcgccgtgcaccaccaaccccaccctacacccgggcgcgcagccgcacgccttgagcacggccgggaacgtgtaggcgtcgggcgccacggcggctcgccgcatgcgcgagaagtagaggagggatctccgcgggctcgcggcggcgtggaggcggacgagggtgttccaggggaacgcgtggcgggaggcttcctccgcgaggtgggcgaagacggagtcggcgtggtcggcggcggagggggaggcggaggcggaggcgagggcgaggaggaggaggttggagaggcgggccggggaggcggcgaggtggccggaggtgaggaggagggcgtggcactggagcgcgtgggaggcggagctgcaggcgcggaggcgggagaggagcgtggcgagggcgtgaggaggacgacgacgagacatggcaaagtttgatttgggacgacgaggaagcagttacaaaacgactcgtttgtacatgaactctagcctcggcccctgggtcattttccagatgggccgtacctaaaatgatcagttgggccgaaaagaagggcaattatggttcattttgaatttcttgattcaaaaatggtagtggtggacatgctgcactctcatgtgtaaatgttactgctagctacttaaagtttactacatccgtcctagaatataacaacttttagctataaatctgaacacacagttgttcagattcatagctaaaaatatttacattttgggacggatggagtacttaagggcagtagccagtagattagaggatcaggttccattcagagtgtatgaatcgctgttggttcttatagaaaacaaaactgatttatgtcaaattctagtgagaatactgtgaatttcatggttccatctagagaattagccctgattataatgtgagactttgcattgactaataaaatacctgcttgttataacggatttctaattatatgtcttaagttgttagcttaaaaatactcagaaaaaaaacatatagaattacaagcaaatatccaaccaaaaagtttaagccacatgcacaaaaagaccatttatccatccttaaaaaatcatatcaactctagatgatgttagattcatcatcatcactagattattttacatagtagatatacggaagatggattgtttggtgtgaaattcttgcggaatttgtacgaaactcataaacccgcacgtttacatgggtaatatagatttagggacaattcagattaataccatttcaaatcataccaagttgtcaacgatgtacatacattaatttttttccaaactttgataaatactacataaaaaattctgtcgaaattttaataatatcatcgaggtttattttggatacaaaccctcaatgaagtcaggaatttatcgttggtttgtatatctttaagcgcgatgtccacagtgcaaacttggatgttagagtactttacggtgttcacgttgaaagacgagagaaagacgcttcgatttagagttgacggggcgcgggaacataggggccggatgaatccacagccaccccccagttatagtataggcaatgagcgcgggaggcgaccgacgcatgcagcttccctcgtcggggaagacgacgtacgaccccgacgtactacgcgcccacgcacgcacgacgggacggccggcctcctcacctcgctcgctcgcgccgcgccgctcgccggcaaatccaccacgccatggcgttccctgcaccctcctcctcctcccctcgccgccgcggccgcggcctcgcctacctcctcgtctccgtcctcctgctcgcgtcccgcgtgccgggcgccgccggcgcggactcggagttcgaggacggcgtctcgcccaagttccccggctgcgacaaccccttccagaaggtaagtaaatcgccgcgtcgatctcgtcggagaggaaggagatgacgatcgatcgtacgtgacggtggcatgcgcgtgtgtgcaggtgaaggtgacgtactgggtggacggcgacgagaggagcagcctgaccgggatcacggcgaggttcggcgaggtgctgccggccaccggctccgacggcgacaagcggaaggccgtggtccccgccccgaagaccggctgcgccaagtcatccgcgccgcttgctagctccattgccgtggcggagcgcggggagtgcacgttcctggagaaggccaagacggcggagtccggcggcgccgccgcgctgctcctcatcaacgacgaggacggtcagtacgtgtagtttttaaccgaacgactgcatttccatcgtgcattgtgcataccatgaaagtaattaacattgagaaattttatggtacttaaaaaaaatcctgagatacctaaaaatttggtacttagagatatcagtgtctcaggatatcaaattttacactaaaaaatatggtatcctccaatatttttttaaatggtaaaattatccaattaacattagggttcttcgtgtagatttgcagaagatggtgtgcacccagaacgacacggtccctaacattggcatcccggtcgtgatggtatcccagtctgccggtcgcaagatcctctccggcatggacggtggggcaaagggtgagaggctgaaaaaaagaattagtctgtcgagaagctgaattcatttcttgctgctgtttttgtgaaccatatgcttctgattttgcttaatttgcagttgacattctgatgtatgcgccggagaagccgagtttcgatggcgctatacctttcctctggctgatggccgtcggcagcgtggcctgtgcgtccgtttggtccttcgtcgtcgtcggcgacgaggtatatcaatcaatccacaaaaaatacgtttcagaagtttaattttataaattacgagtattatacgttttttgcagaagaaaaagagtgagacaaaatgcatcgatcatgtcacatcacatgcatttttcactgatacgaatggcgcatatttaaaatatgactttcatatggcgccgatattatttggtccagaataagaatgctcctaccctgggtggagaagaagctgctgactccgaaatagtgcacatacaaaccaaaaccgcgctcgtgttcatcgtcaccgcgtcgcttgtcctgctgttcctgttcttcttcaaatccacctggtctgcatggctgctggttgtgctgttctgcctcagtggtctccaggtgcatggcaattgcctactcaatctgacatagtttggttcagttaatcagtaaactaactaatactgtatagctttgtttcatatcttctcttgacggatcctttgtttttcagggattgcactatgttgcctcgactctaattgtaaggtgtgatcactgaaaccatgcaaccttttgtatcatcgcaccattgattctgaatttctgatagtgctattacttgcttgctggtctaactgctgcaaagttgattgacagaacttgtgatcggtgccgcgaagcaaaagtagctcttcctgtattagggaacgtgacagtggttacacttgtcatcctaccactagctttgatcttcgttgtcgtttgggctgtacaccagaattcaccgtttgcttgggttggtcaggatcttatggtatggtttgttgtgtgcaccaggtacagtgcaatgatgatttccttgtcatgtttgctcatggattgttccttttcattcagggcatctgcatgatgattcttgtattgcaagtggtccatctgccaaatatcaaagtgagatcatcaagaacatatgatgccttggtttagtaaatatggcaattgtaatcatcttttgtacactgatgtacttgagattattttcaggttgcaacagcgcttcttgtgagcgctttcatgtatgacattttttgggtgttcatatcacctttcatattcaagaaaagtgtcatgatcacagtaagtttgtttctgacaaagtgcaaataatgcaaatattagtgcaaaaatatcctaatccaattggtatgggcatacaggttgctcgtggtagcgatgagggacctagccttcccatggttctgaagatgccaaaggagtttgatacatggaatggctatgacatgatcggatttggggacattcttttcccaggactacttgttgctttcagtttcaggtcaaaaccaagattttgttctctgaatccgtcaatgcattcagttaatatcagagtctactggatacttctagtgatcaactgttcattctcctgaaaatttaccgttatttttcaagataatatttacctactgttcttgagttgcaggtatgacagagcaaatggaaaggacttgactgacggctatttcctctgcctaatgatcggttacgccttcggtacgtaatattatccgcatttctgaatcacagaagaacaaaatcattgacatcaattatcaacactgtcatctcaatgcaggtttgtcatgcacatatgttggcctgtacctaatgaagagtggacagccagctctcctctacctagtcccatcaacactaggtatcacatcgattcctctgctgagattttagtacagaaatcttgagctccaacacctgtttcttctctgaaattatgcaggaactattgtcacgctaggtgcgaaaagaggagagctaagtcagctctggaatgctaaagtatagcttgtgaaatattgatacttgcttgcagtcttgcagcattgtactagttagagaagcgatcattgatctgtatatgagaatatctgatggttgttggtaaatatatcatgccaaccatctgcacgaactttggttagatttcttttttcagtgtacacttaccatgaatggtggttattagtgcgaagcagtatgctctggctgtaaatgtcatggctgtgatgtaaatgtgaacagaattatattctctgtgtcttgatgtgttcttagctgggtgtaatataaaaaatccactttgtttcagaaacttcagatgttgctcaagtatctgtactccggtgttcctttcttctcgactgtaattttaagtgtcgtcaaattgaactttacaaaagggcaagagatctgcgcagatcccaatgctcagtaggttatctgcattgcagtcatcgtacgatagcacatgaactcgaccgtaaacgctaagatagtgcatgggtgtcattacgtttgattcttagcagtttgcaagaccaagctctctacgctcccctttcgtttttcgcgcgcacattttttaaactgttgcatagtgtgtttttttaaaaaagtttctatatgaaagttgtttttaaaaaaatcatatttatccattttcttaaaaaaattagctaatacttaattaatcatgtgctaatggactgctccgttttccgtgccggagggaagtgtttcccaaccaagagtagcgaacacatacaacatagtaaatcaatcgcgatgtttaaccaacttccaaaaaagaaaaaatagagggagtacaaacgatgaacgggccaagaatattggatctatatatgctccctctactttttaaatagatgacgctattaacttttacacacatatttgaccattcgttttatttaaaaattatgtaaatacgtaagatatatatcatacttaaattacttttaatgataaaaaaaatcataataaaataagtattaattattgaaatttttttgtcaaacacgtgttaaaaaacagatatagtatgtacacctcagtctttaagaaaaagataaatgcatattctgaatagatattcaggtttcattgcta

SEQ ID NO: 41228 - DNA, 4012 bp, Oryza sativa
gaccctaaacagttttatttcaaaaacttttcaactacaaagttgtatgtcgcgtggagggctataattttgatataaagtttgtcttcattagagttcacatgaaaaagctatgaattattttttgatataaagtctttagaccgtcttgtttatgcaccgaggtaacacaactggaaaagttggaggacctaaacgagtgatctgcaagtttagggaccgagatgacatagtcgaacaagtttgaggatctgaacgatcgatttgcgagtttagggaccgggatgacacaacggtgcaagtttagagaccggtgatggtctttactcgagtattttttatggagggagtacatgtatggacagacactgtatgaatgatgtatgtattgtatgttcgtactgtacaacgcaccggatgtccagagtcgtccgatccccatccaagcgcgtggaacagcaccaacgtgaatgcgagcgtgagtggatcagtggaaatgtatgttcgcatctgcgcgtcgagtccaattttgtgagcgaaaacaacccttaagattcagaaaatagcccattttgggccctctagcagttcttccttccgttccttccctctatctatcctccgcctcgtcctcgccacgcgcgaaggcggcgtcgatcggttcccccatttttctcatcgatccctcgtggcctcctccccgccgccgcgccacctcgtctcgaaggtattctttgtcccaaaaccgcctccttcgccgacgagccggtgtagggtggagatccaacttgtatttcatttctttttgttgggatgaactcctaggccatagcatccttggattgtctagggagttctgctccggtcttgtttgtttatgttttgtggggaggaatttttgtgtcgaattcttctttgctactacgcgattaatccgtcctttcttggtttgcagatttctttgatgcgtggtggcagtggcgtttggatcttggtgccgccatgagtccgccggggaggaaggccccggccggtgcgggcgggatccgtcggtggctctccaccgtcgtcgtgtcggtggtggctcttgtgctaaccctagtagtgatatcgctatcggtgggctcgtctctgaccggggcatcgctacacgagtacctctttgtcagacctagtgattcatccaagcttactgatgggaacatgaatggtactgccgttggtgttccattacaagaggaagtgttgcagggtggcaaggaagtacccgtggagcacggtgttcagagtggcggcgtgaattcgagcgagacgggtgaaatcgataccaaagtacaagatccagttgttaccgatgataccgcgtcagtgcctgatgagagaaatctccctgtctcatcggattcatccgacaatcttcagaagactaatgaaggtgcggtgttagtacactttcctgtttgttttctcggcagcactgactaacatgaatgagatattgttttcttgctattttagtgtaatggcttgtttgattattcatgataattgaatgactgggataaaaaatggtatggtgtaattgtacaggtagctgtgatctataccatggacattgggtttttgattcttctggaccactatacacaaacaactcttgcccgatcatcacgcagatgcagaattgtcaaggaaatggtcgacctgataaggattatgaaaattatagatggaaaccagaacagtgcatcctaccacgctttgatggaccaaagttcctggagttgatgagaggcaagacaattgcatttgttggtgattcagttgccagaaatcagatggaatccctcctctgcattctgtggcaggtgctgatactattcatgattttcttttggccatatgattagttaagctgatgacaagttgcccattactatatatgacaattttttgttgacctggatattgattattaacttaaaatactaggcatttttgttattcatgtgagttaggtttgttacaaacttgtggatgacaccatgaatttttttatatagttttgtgatgttcataacaacattatttcgatttatttaaaataaatggagaaagggtcaaagtcatttgttctacatgatttgtttttaaattggtgaaatctacttattttgtagtacatctgtcagccaagttttttgctcgagatactgcaactgtattggctggtgtgggttcagttgctggattattgatgttgtctgatatcaactagagaaaccaatgctgtcctgttgcaatctgacactgtaccaatcctatggtttctagaagaaaactgttttagagtttagatttcaatcggctctttgttttctcaatgtggacaaatttaggatattgcaagattagcctattgaaaatgcctaccaaagcatcagaacagcagctaataagcagaagaatgcaaatcaatgtcctgtagtacatgatagtcttttatagataagaaactgtatgagttagaattgctttgtgaactaatagcataccttgtggtctcacgtaggaaattttatgaagattgaagcagataccatgtttattacttttccttatcatgcagcagagtcttgtttttcaaacatctgattgagaaatcttttgtcgttatatagtggaacacatctggttgggctttcctccttacagtagcagaaatgtctcacaaagatcaacctatacctcttttcctatgttaaatgattttgtaagctatgtcattaagagacatgatctgttcttttaccttctttttggcaggtagaggccccagtaaaccgtggtagccgcaggatgagcaagtggatttttaggtcaacctcaacaattatcgtccgcatctggtcgtcttggttagtgcacaggtcaactgaagctgtggggtttgctcctaagggtatcgataaggttttcctggatatcccggatgagacctttatggaatttatcccacgttttgatgtgcttgtcctctcctctgggcactggtttgccaaacggtctgcttatatcctgaatggcaatgttgttggagggcagctctggtggcctcgtaaagctggaaatatgcagatcaacaatgttgatgcttttggtatatctgttgagacatgcctaactgctctagctaccaatccaaatttcacaggtatagctatcgtgcgcacatattcaccagatcattatgaaggtggggcttggaataccggtggatcatgcactggaaagactaagcccttggatgtggtggtgaggaatggattcacggacaccatgtatggaaagcaggtttcagggttcacaaaagcagtgcagaattctgggaaacatggttccaggttgaaattgatggacatcactgagccctttgccctgaggcctgatgggcatcctggtccatatagaagtactgacccaaacaagaagacgcaaagaggtccagatggaaggcctccacctcaggattgcctacattggtgcatgccaggacctgtagatacatggaatgagatgttgctagagaccatacgaagagagttcgagggagtgagaagctgaagaaaaacactcattggctgcttgatttctatcatgtgatacgacctgcaaaaactaattaagcttctagcattggtgtatacctcattacatatcgtgttgttgttctcccacagataggaaggaaatatagcttttggttggacaaaaaaacaaattgtaggcatgttgtcaacagtcgggatagaagtacagaggggtagacagttagagagagaggttatgatggatgatactgtgcaattgatctgtatctagttttttgtctgacacattcttggagatatgatccgttgacgaattttgtggaactacatatgatctcatatctcgagcacctgtcaatctatgaggcaaatgctgattttggtttataacaaatgaaaga

SEQ ID NO: 41229 - DNA, 8688 bp, Oryza sativa
gtttcgaaaatatttggtacaactcaaacttcacgggataagaaacatatattctctccgtttcatattataacttgttttcttagttaaagtttttagtttggcctagtttatagaaaaaaaaaacttctacatcataatgttaaatatattctgatacaatatttattttgtattaaaacgttactatatttagctacaaacattatcaaatttaagaaagtttgacttaaaaaaagatcaaactgacttatgatatgaaacaaaggggaaactaaatggccccctagggaccgggctctgttcgcaagagctgttcccaacctaaacagtatgcacggaaaatggaaccgatcctctagcacgtgattaattaaatatttgcttgggaactggctcttgcggacatagcccaaatcgagtagtgtgttagttctaggcccaacgtttctacggctaaaagcctgccagaatatggcccaaatttaacaaagttctaggacgagatgggctcagttcagaaggaagtcagaaacacacctccccttccacttccacttccacttccaccgacgagagcgacgcggcggcgcggcgccggctgcccacaccacacactcctccctgctcctcttcctcctccccgcatccgccatggcccatggccaatcccttgcccagttgcccccgtgcctcgccgtcccgctcgcccgcgtccgggaagccatcgtcggagggggggtaactcaatgcgacataggtagatctgcaggcgccgtgctgggactacgaggagacggccgcggcggcggccacctttgccccgcctcgacggggaacctgctctacgtcttctccaggtcccctatgcgaactttccactactatttcgactcttcgtgtattcgttaatccttaccaagttcccgtaacctaaaattatggtaaagcatcatcatattgttttttttttgtacatacatttttcgctgtagccgttttggcagaatagattggacttgatggcattacggggtagcgaaactcttgaagcatgttcattaagcaaaacatggatgcatattgttacttgttaggtgttcactgtttgtattataatgtacatcgatatatattgttacttgttagatgttcactgtttgtattataatgtacatcgatatatcttgatgtgcatatatgtcaatgattccatgtattctatttcatggaaattgaagctaggagtcgcatttttccactacgctttaagctggccaataaaattttacctacatttcatctttgctataggcattacagagctctgtatatttactgttttagcagaatatatgtgtttgtgtagaccactgtccttttagttagaaggacatggagaattggaggtcttacatgtttttgttgcttggatcagattggctcatcctgtgcaacagttgcattcaccatgaagccacaatacctcctacgccgtgaatcctcctactatgcctagcctatagcagaatgtgagccattcttgcttgcctcccttttcttctattctacaatggtacttgtgagtatatatatttattcatgtggtcatgtctcagggggataaattaaagattagttgttagtgacacaatcataatatcttcccaaggtccataaaatatgcaatccttttggtttctatttacagtggatgaagttgggtgcctcttcagttctttactttttttgactgaatttttgttgtcgattagcaaaggataagctttcagtatttgaattgtaatagcagtataggatttgagaccgctggctcatgatgtaaactctgtactgcaacgttctgcaggcaggattagcttttcttgatggaagtattttaaactctgaaagcttgaatacttgcgtggtaatcacagaactacttggctactacactggctgttctccctcaagacataaaaggttagggttcgtgcattgtaatcctatgtttttagttacagaaactttcctttttaattgccataattttacttacaagaagctggtgcacataggattttgtatgaactgtgcagaaaactgaaaggcactcttcgaaaagtgaaactgtcctcgaaaaacaagtctgatggaaataacctatcctataaatctgattacctggaatagttagcatcaaacgctatgccttattactcaagagaggttaaagcaaataatagggtaatgcactaatgtactagtctttcagagagtaattaacctagagaaaagatgacaggttgagttgttcaagaactgtaaagtagagaatattaatgtagttcctcatgagttatctttttgaaagggaagcaatctggttgctctctcactgctctgagaataaagtttcaattagcttgtttgttcattaggaaaagaaaaggaatgaaaagagtaggctccaaccaaattatattcccatcaagacttagaagagcttaaactattctcttgtgacccttcccgagtcagtaacgtcaattgatccaggaggaagataatatagttatatctaagtagttatctaagcttttgatctaatctattaggttaatcatatatgcttggaatatgccacattgcctttggctgtatattatctgcttctcaagatttgtcctaaagattactggtccagacattggtatataaaaagtatgaaacaactctcatatatttgatccttgtttggacttaggggtgtttgggtgagagggactccctctcaccaaaaaataagtctctagggagtgtttgggtgagaaggactaaactttagtttgtgcaatggtaccaatcactggtgctccttgctcttcttttgagtgaccatgtgaactgtgtgttaattatctaggttctactaatttcttttaatgttggaccacttcttgtgaatgtactatgtcagtacctcggcctttccattctgacaatgaattgaaacgtgcgacgagaaaagtcaatagaagcaaataaacacacgtgcttcaaaaatactagcagaatgcgaaaactactactccctccgtcccaaaataagtgcagttttacactattcacgttcaacgtttgaccgttcgtcttatttgaaatttttttatgattagtatttttattgctattagatgataaaacatgaataatattttatgtgtgactaaatatttttaattttttcataaatttttcaaataagacggacggtcaaacgttggacatggatattcacggctgcacttattttgggacggaggtagtactactagtagtatattacagcattatggagtagtatgttattggtgcaaacccatggatttatatcacagactaattcaaacaattgtatcaaatcaagtactgtgctgcatgtaaattgtataagccggagagatcaaaggataaattaaagaaagaaaacgaaaaaaaaataaaacttcaacgcggattcacatccaagtctgaaaaaaaatgcttaatcctaatccaacaaatccactagctgaaaaacaaatatccatttgattattcccccaataagctctctttcttcttgctttctcatctctgagcactgagatttcgcatgtattttccctatctttaatcccagcttgctctcccaatgctgtcacatctagctagccacatcaacccttttatcgttgtacacgtgcctttatatttgtgttgcacttaattaaatctccctagttttgtggtagagaagagagagatatctccgtgggtatactgtatacaactcaggcaagctgtgcccagcatgagtgcttgtaatcgcagtatatcagaatcagaccaggtggtccgtggccggctcatagtctcataccaaatctctctcaattttctcatttttttaaaaaaaggaaaaacacatctctctcgatctgaatgcatgtggcttgaaacgacagtacgacaccacatttacctggccagaatttgcaaagtttggagcaaaatcacaagcaaagctggaagatgcatctagtaggagtagtagggagggagtagagatagcaacggtacatgagtccacgtgtgtactgggcgacacgcccagtacaaggtccctttcgctagccgtggcggcgtttggtggtttcaccaagaagctcaagccctcctcgttgccacgtggatatctggtccaggacgcggcgggcccaccgcagcctcgagtgacaggtctccttgcaagtgggccccacgctattatttattatccgtaataatctgatggtcctggaccactgacaaattctttttctcctctgatcgcccttttccttatccgctttaaaattaaaaaacttcaaatggtatagtggattattcttgtttgtttgaaatggaattttcggttaaatttcaagcaactcgttactcaggatttaaagagtatttcgtggctaggtgatcaagggggagcaagtatgcgtatcatatgatcgacaatccacgatgctgaatcttgaagagagaaaaaaaataacgtacgcagatcacagcaacgagagaggatgattaggctgattgtattattattgttaaacatatcgtcgccgacaagcgccattagtaaagcataaacatccgtggcaccattcaatccacgctaattcaaccacacccacccgccgcgtacatcgtttcttgctttgttttcctgcaagatcttcatattataatcttttccctagctaaagatcaagttcaagtatgctacacaataatatatcatcaccttttgcaagaacaatttgctccttaataattaatctcgaccaaaaatatctgtacaaaacaaattcgagagcaactcaaagttgaaaggaactctcgctctaattaatctctacatctacaaacaccgttaattaatgccttgattatgatgtttcatcgccgagtctacttgatcctcgccgccggagcggccggcggcggcgtgaagaacccgacggcgcggcacttgacgtccatcccggcggcggcggcgggcatcggcattgctccggcggccgacggcgaggtggccgtcgacctcttgtaggggccgagccacttggcgagcatgtaccgggtcttgcgccacggcgggacgtgcaggccgtgcgaacggagcgaccgccgcgccgcgtcggccgcgacgcgcacggcgcgcccgacggcctcctcccgcgccaccaccaccgacgccggcacgggggccacgacgacggcgtactccgccgtcgcgcgcgcgacctccagccccgcccggaagtcccggtccacaatgtacctgctcttctgccccctcgccgccggcgcgaccacgtcgacgtactcgtacgtcccggccgtgatgccaccggaagcctcccaccgcgacttgcacacgccggcgtcgtacccggcggcccgcagccgccgcgccacggcgcgccggaacgccgccccgtacctcctcagcgccggctccgcctccatcgcggccgccacggcagcagccagcctgacccggaacgggtcctcctccaccggcgggtcgagcagctccctcacggactccgccgccgccgccgcgcgttccggaccgtcgccatcatcggagtcatacccttcgccgcccttgctcgccggcccggcgccgtcctctcccgccgcggcgccctccgtctcaagaaacgcctgcacgagcccggacaggcacgcggaggcctcgtgctcgctgccgctgctcgccgacgacccggcgtccccgcggagccgcgcgcggacggcgtcgtcgaggcggatgtagacggccattttcgccggcggcgtgcgtggatttgaggtgtctgagctcgcggtgaggggaggaggcgcacacccgggtgactcgtttttatagggtggttggctatgaggcgaactcgagagagaggaagggtttattcctttggatcattagtgattagtgggggcgcttaagttaggagcaacgaatttgaggaagttaaccatggaatatgctttcctgatgagagatggtaggcaaaagcagtgcgccaaaaaaaattacatatcaaagctaatttggtgctgccatgtactccctccagttccatattaattgaacttttaaattccatattaattgatcttttaaattctatattaattgatcttttaaacaagtttgaggttaaacttttataactttaaccataagtaactttaaaaatatttagttccaaaaaattagaacaacatatatagatttgtctttcaaaacataaacatatatttatttattatatatattataatagaaaaataatgtcaaggatatattttataaatcatgtcattgtctaaatcgttaattaaaatgaaacgggagagagtaaacagatagagcgtgttggttgatggctcgatggctgacatgtataaatgtttatctctgttttctttctaggtccatccatactgacagggttaatgttgttacagtgcattttctgctgccagaggtgacaggtgtacagtaattagcagctgttagcacgtgcttaagttgtttccgaatcaatggacgagttatttgcatcttttaaaaattatcttccatcttcaaccatgtagaatactactcacacgagagagctggcgttcgcactgtatatatgctgttttctactacagcatttgaccacgaaacgtccagggaatggagggaaatagcgtggaaaagcaagcttataatccacacgcactatacgaatatacgattatgcaaccaaatcactttatttatttttaaccttaagcccccgtttcaaacgtgacgcttttttcacctgtataaaaacagtaaaaagctttctcgaaaaaccgggtcgccgcggtgtgttggcatattgcactattgcgtgtgtgtgttgctgccgcctgcgtgcgtgccgtgcgtggcgaggatatgccgtggcatcccgaggctttgtcctatccgcactgtcacgcgggccccccaacctggctcgggcgacgtcgattgggccaagtcagcagcaggtgggggcgcccccgtgtttggcccttggcgcggccgcggggtcgccgtgggagggacaagagcacgagatggatggcgactatgctgcccattgctcgatcgatcgtctcggtctcgccactagactcgataatccatatccgtttctgtgatcgcctcttcctaatctctatctcgacgctctcttctcgccccgtctccgtctcgatctcgatcggggccctaccaggttcagctgtacgcaactgtttccaggagtatctacactgttgacggcatgacatttctttaatgaaacttttttacttgccccctggtcctgagctgacgctgaacttatcaccactcaccagaaagagaggaggcaagtatttactgtacgcttatcagctgaggggaacagagttgcgctgtgcgttggaggtaaatggtggcatacgagttacagttacttttgccgtattgcggtggagacaactcaccgacgcagtggagtaaaatctcgagcggagatgggatcaaactccgaagagaaaaggtcgcggtggaaacatccagggtcaaacggccaccagccagggcgtacgtgtaaacggcgtggtcgcggtggtacacatgcataggcccccgcgcacacgggggggcgagcgagatcacgaggacaccggacacgtaccggatcggagagaggcggggccagcgttatcaaggttggttactcgttgccgtcgcgaccggcccaccacctcccaactcccatcccgcgcgggatcctaatattcctgtacagtttggtcgagccaacgctgcgctcgcgccccccgcatcgacccaccgtttcgcacgcagtctcgctctcgcgcgtgctcgcgctcgcgcaggcgcagcaaacgcaacgaccgtaggccgggtaggtaaaggcacgtactacgccgcgcgccaccggtttgcgtcgcggaacgcccgcccgcccgcctctggtttttgctagaaacggacacaccccttcgcggaagccaaaatacccaaacccaagtggacgacgcggcccagcggagctgcggagggagcatgcggccgtggagggggagggcatctcgcccattccgtgcagcacagaaactgcccctgtcccatcgttttctttggcacagttgggtgtggttgcgcgtgatcaatgtgcgtgtggttgtgtagactactccacttgcttcccatgtaaattcgggtaatgagacccagttagatgacactaaaacttttaaatccctatcacatcggatgtttggacattaattataaatattaaacgtagactattaataaaactcatccataatcttaaactaattcgcgagacgaatctattgagcctaactaatctatgattagcctatgtgatgctacagtaaatatttttaattatgaattaattagatttaaaaaatttgtctcgcgaattagctttcatttatgtaattggttttgtaaatagtatatatttaatactttaaattagtatctaattatagagttaatgg

SEQ ID NO: 41230 - DNA, 9679 bp, Oryza sativa
ctagatacaatgaacctgtgcgtttcaagatcacgaaggagcattgttcgtcgtggttctttagcatctggacagaagtttgggtcaaattcaaggctgatagttacacaggaaccgttggtagcatgctgggataattttatggcctggtcgcgtgaatggcgtaagtccattataagaaacatgcagtccaccacgatacaaagatatcagcaaaccaagtgggtgacgatacgcggtgcggtgaaggagaaccagagagaatgaacaacgatggcacgccaagtcgccagcgggcgcaacgtggcacgtaggtctcatcatcttcttcgcctctcgatcttcggcatttttcttgtaccaaatgtttggagctaatagtatacgcgcatgtgatttcctacacctaaatattgattttgctcagctcggtgctggactttgtggatcaggaataacccaacaaatatgcaagaacaatgcacatacataacgtccctttcgaccatcggtgcttgtgattttgtgaatcattaccgatcatattagagtcgccgaagaaatctcgagcttcctattaaggaatcaccaccaaatcccatgagatttaatttgacggtgtttattacagactacaccatcacgtgatcccgtctctgtactcccaaataaactatttccccacgtacaatcaggttctataagcaggtgttttcccaacacctctttctcgttttccgcgcacatattttttaaacagttaaacggtacgtttttttataaaaagtttctatacgaaatttacttaaaaaatcaaattaatatattttttaaaaaaataattaatacttaattaatcacgcgctaatgaaccgctacttttttttttttacttccggttgaacatgggacactgaacacaccctaagtagagtactccctccgtcccaaaagttcagattcatagctaaaaattaaacatagattaacactgttaagtgatagtactagtaagcaactgtgtgtcccctcccctggccccgcgcggtcgcgaaaagcccatttaaccccacgcagcgcggcgcacgtacgactcgtagttagggctgaaaacggtatggaaacttttcggattccggatctattttcgaaaacggaatctgtcggtgagaattttttcggaatttttcggaaataaattcggaaatattttctcggaaacggaatcgaaaatgataagggcagtttccgtcggaactcgcaatcggtcggaaacttttcggaatttttttcggaatttcaggaatttttttcagaatttccagaaattttgtaactgaaataccctgggttctttttttaagcacttaatagagaataccatggtgttttgttgttattttcttgaaaatatttgttatgcaaatctaaaattacataagaatatttttttccttcattgggatttaccaacatcattactcttttaaatatagataatttatttcatagattgtgttttgtgatgtactattaatacttaataattagacttatatgattgtgttttatgatgaatcgttgaccgttgagatttgagaattggattaatcagtttgagagttttttttattccgataaattttcgttaccatatttgcgccggttcgttttcgctctgttttcggtttcgataatattcgattccgttttcgtatccaggtttccgattccgattctgatttaaaaaaaatataaaaataaaaacggtaaaaatggttttcgtccatttccgtaccgttttcacccctactcgtacacctctactcgtagtacgacattttttaccagaccggccgcatgcgattcttcaccggtgacagcgcaatgatgcggtggcctttatccagcggcacgcaggagctgtctgtccacgctgttcatgcagcttgcagatagtagatcgaggccgtgtttagtttccctttatttccaactttctattacattatatcacatagaaaacacacataaacttttaaccttttttttaaaacttttaacttttttcaaacttctaactttttttcagaaactaatcacactctcagacacacgacgtcaaatcgtcccgggattaggattaccaccgttttttcttttgtctcgctgtcgagaatcgagatcatcgtggacgtgtccgtgctaatccacgtcgaaatcaatcgaatcatcgtggacgtgttgctaatccaagttaaaccagccgtcaaatgacggccccttcaacagaaactcagtgagatatttccagtgagattagaaatatgttgttggtttcagtctcttttacttcccccgttcttaaatataaaggattttagttggatataatatagctttatatccagattcgttgtactaaccaaaatctcttatatttagatatagagagagtaatatgtgttagtttgttagaggatacattcatgggtacatgagtatgatgactaatgtgacgtgtatactgatatgcgcgtgtgtctaccgtgtaaaaacatatcttgaaaaacaaaaaacaacaacgagtgaattacatgttaggtcaacttggttacatatattacacattgacatatttggttgtcagggctacggcatatcgcaaccaaccaaaacagttctgcaagcaacaaaggcagttgcagccacagcccttgcctgctgaataggccagttggacaaggccctcgtctggaagtgtttgctgatacatgggttactggcctaaagtgcaaaatctggtatctaaacctaatccaacgtaaaaatattgatgatccatggtgagactaggataaaaataactggtccaaaattcaacttactcataataatatcatgcatgatagatatctaagttgccattatgtcattttacgtatcataagatttgtatcctgttatatgccgatactaccaaatatttgatataaaggattactacgtttcgtatcgcaataccatcaatcttatttatttacgacaatatactcagaaatgatgtgattatattatataattctatccagtttggaaagaacgacatatcagtctttttttcattttctacaggatatgagaaaaattccgtgttccaaggatatcaaaattaattaggtgcggacgtttgtgacgattttatatttcataaatgaagcacattattgcatctaggttttttctcttgaaccaatatacacgaaactgagtgacttcaacatcatgcgtggcgccatggatagtgaaggcagcaagatcaggagtgaagtttgatcctgtgtattattatcatatcatgcgcataacaaactagatgcaataaacatttttttctagccacaatataaacaacttattatgattgatgtccttgttaattccggcctaatgatcagcacatacctgtcattcctctaatcaggtctggcgaaaaataaagctaaatcaagttcaataatacaccctaaagtaaggactgggtgttaaagtggggacacaaacgatcaggaagatcacattgatacatctgctcctagacttgtttggtccttttctgattcgttcagatatgcactctacctatcaagtagatgaagaccacatacagtagtgatcaaccggtcgtagtgccacaagtgtaaagtgaacatcatctggataacgtggtgtgtgcatttctccgtttagtagtgtattgacttgatagaccatgaacctttcattatttttttgccgaagaaagttgagagagatatttgccactcccactatttttcatcattattcgttccagggtaatcctccaaagagagttgataatatatatagcaggtcaatatataggcatgctttttttaattatgttgccgtgcaattatgcgtttgtttagtgtgcattttgttgtcgggttagtgcgggttaaaactagtcagcctatcatttttactcctaaagatggtaactgatcgatcagctcgatcggacaataaacccactgccactaccactagtactaggttagcctagtcctagtagcatgtaggccttctaaagttggaagtttgggttaaaattgatacgatgtgactgaaaagttgcgtgtgtatgacaggttaatgtgatagaaaaagttgaaagtttggatctaaatacagccgtagcatcgcaaatcagacgagctagctagtactacaatttaatcatttccagcctcatcttttcacttatacttatcagaaaaaaatttaaaatttcaatcttaaatttgaagctgattttaaaatcttttcatcggagtttagtttttagcatttacttttaaatcgttaggaacacgtatataaaagttttattaacaaattacttttcgtttgcaaatatgatgtttgaacgatggggctgtttgtttatgcttattcgatccgcttactaacaatttaaatttgtaaataaaacatttatatacacgtccaatttaaaagtaaatgttataaagcaatctataaaaaaaccataaaatcaactccaaaattaaaatttaattttggcttctaggtataagcataaacgaaacaattggacttaaaaaaacattgtcaggcgagtttttctttagaaaaaagaaatgctgcatgacagcatcccattccgacgggatgacacctcatcttgtccaaatgtccaaatggggtatcaatcgatacctactggatatcatacgatatttgcgaggtatcatcccgttaaaatggggtatcagttgatacctactaggtatcatacgatatttgtgaggtatcatcccgtttgaacgagttatggttcaggagcatttttcgaaaaaaagaacatgggcaggagcaatcacccaacttcctggaagttgcagccttgcaggtgacgcggctagatgggcccggagggagcacgcggcgcagcctctcgtggacgaacggcccatcgcacgaccagagcccacagggatacccggcgcgcaggccggttaacagagatgcctcgaacgcaggtgcaggcctggacttgtgttgtagccctgcagcccgcaccggaggactagcgattagcgaagccgcggtcacgcacgccacgcgttcgatcgatcgatcatcgatcgcgaaaaccctgccactggagaaatcctattcattatcgcctagaaattcgattgttaagcttttatctgctaaatggagtatatgactactgcatgcgtcaccaagataagcataacgtacgtgtgccgcttcggtgctgctgcgttcgcgaaaaatcattgcgttcgtttcggtgctatgctgtgtacggccattacggtgtaccgtcgccgcacatatccacccacccagcacacagacagcagcgacacaagttacaacaatatccaggtgagctgggggccatgaacctacactccctagccactctcacgccagcgccgcgacaaccacccaagtttggctagcttcccaaccctgacgtcacgtaagcttttgccaattccgccaacgcccacgcccatgcgcgcacccgtctacgcggcaccgcgcacgcgccacccccctcgacgtgtcctcacaccacctcgtccctatccatgatcgcgtcccgcccgcgcgccgcgcgcgcgcgcgcgtccttccaaacaccaacccgcgagtccttgagtcctttccgttccgattcccccgtataaatccccgcgccaccgtaccacgggctcccgcatccatcgttctcgctcacttctcacaaacacaacaaaaaacatcgtcgcagacaaaaacatcgtgcacgttggttgcgtgtcaatggcggctcgttgtccggtcggtgtggcctctgtgctgctgctgatcgtcttggtcacggtggcgtccgcggcgtctggcgcgcgatccggcggcggcggcggcgggggcatacgggagttgcggggcggcggcgcggggaggagggtggggggaaggacggaggtgagggacgtggagggggacagggaggtgcaggagctggggcgcttctccgtcgaggagcacaaccgccggcgccgcaaccgggactgcggcgacgtccggctggagttcggcagggtggtcgccgcgcagcgccaggtggtgtccgggctcaagtactacctccgcgtcgccgccgccgaggagggcgccgcgggtcagaacggcggcgagccccgcgtgttcgacgccgtcgtggtggtcaagccctggctcgagtcgcgcacgctgctcacgttcgccccggccgcggactcgccgaacgagtcgtagcacgcaggcagagagaggcaaggtcacacaggacacagctgagctggtgtaagaataaaaaatgtaccaagtttcaggtgcagttgtgcaccgaacggggtactcgtattcagtagagagtgaacaaagtaagtgtacgtgtgcgtgttgcggcaatagatgttcgaaggctttttgtgtagagagacgggagagagtggcaataaagtactatacttgttctacatcttcttcgtttaatttgcatatgcttatgcttatttttttcccactcgatcgccaatcaggctcaggagctcacgttgcttaaataatgctgagaggtgatcgcgtgtagtgactagcttgaacgaacgaaatcatcaattaataaaagccctagtgctaccgattttctagttttttttttctcctcggaatggctgtcacgaaattaaattaaaaaacgaccttgtttcttactaactgagaaccagaaccttgtcttttcgcgatgcaaaaaaaacctttgcacgttaatatattagaaaaaaataactagcgcaactgtgatacaccgaggcaatcactggtcaacagaagggcataccccattacataagaaactggtttaaaccaagcaaagcttctaagctaagactaagagattaagaagttgcgataaactaagctaagttgtgtttcgctaagcatagtcttgtctggtggtcccatgcacaaaccaggcacataagaccattcacagtgcatctacgtggctttcatccctactgcgccccacgaggattttcgtctctacgtttgcaaccctcgtacctaacatgcaaaattatagacaccacttgagctatttcttccagaaatacggctgacagtatctttcacggcaaatatcccgagggactatctatacatttgtcgataaattttaaaaatttatcaaatataaatacaatataattatactgtaattacactgtaagtatagaataattacactataacttatatgtaattatactgtaactatagtataactacactgtaactttagtataactacactgtaactataataattacattgttacttatatgtaattacattgtaactataatataacttgcatgtaagtgagatgtacctttataaaacttatgtttggcactgctcacgtaaaagagggattacgaactcgcaatgtctgtttgtacgatgcgtgtggaggccatcattcatgcatgcatgttcgggtatgccctgccgctttatctctgcccttcgtctgacatctacgcgtgcatgagccgcgccagtgccggtagccagcggccgtcgaaagaaacaaatcaaaacgtcgacgcaaaagcacgaatcttgaggttcatcaagcggttcgaaaatcgacaaattctaaggaagaaatttgtcaacagatttatagcaaaatcgataccgaaataccaccccaagctaataaatctcaacatgcggcagccagccaggttttggtgaaacagtactgtataaaagcatcgcgtttcctttctcgttccccctctctttttcttccgtttccagtgcgagtacacggcaatgatcacccctttgctacttttcatatccatgcaacatgcatacaaaaagatggaacaaactccatccttttttctagtccacaaacgctagcttcgcccgcccctcgtcacgcaacgccggacaaaggccgagcttgctgttgcgcggagcagctgcagggtccacgtgatgccgcgccgtggcgccgcatgcacacacgcgcgcgtcgctacgtggtcacgcgaacacctgcactgcagtacacaccaccctacctatatcatctctcgcctctgtacatctgtgcaaaactgcgaaatccaaacatataattagctagcaagcgaaagtacaaaactatggcctccaagctgtattacgccgtcgccccgctcgtgctggtgcttctcctcctcgcgccgctatagtccgcgcgcctcgccgccgccgccgccgccgacgacgacgggcagtggccggcgggcggcggccgcgggaggaaggtcggcgggaggacggacgtggaggacgtggaggggaacagggaggtgcaggagctcgggctcttctgcgtcgtggaacacaaccggcgaggggggtcggccacccgcggccgcgggctggtcttctccagggtcgtggcggcgcagacgcaggtggtctccgggatcaagtactacctccgcatcgctgcccaggaggccgacgacgagctggtgttcgacgccgtcgtcgtcgtcaaggcctgggtgccgtcccgcgagatggtctccttcgtgccggcggcggagctgccaggatactgaatcggctggttatccatggacgcatgccttttgatggagatggaagatgggtgtgcgtcatcatctttgaggtgatctaatgtctaattagatatgatactgatgtaagatgcatacagcatgactgcatctaccatgtttggcgtaaattttgcttgctgcagagtccaacttgtgtaagatggtagcttatgcttctcagttttctctctttctgtagcatctgtaaatcctgttcctcaatgacacctatagctctgtacaaactaaaaaagagaaattcggaggaagatatgtccctccaaactttttaaagaaaaacttgtgaacattttttaagaaaaaaatgtaaatatgttaggaattaaacacaggaccttaaaattaaaaccacacatccattaccactatcaagtgcatccagttcagtacaaactgatcgtgtcgtcagctaaaccctagcgtgagctaaggtcgatgaagccactctaaccaaaaggctcctcctggaacggtaccagataaatgttgaaggatttttgtggaaaaaactttgggtgttctaaaagagctaattaagactcaaatttgacattagcaaatcaccgtagccgctctattatcgtctgaaaattcattgcttatgattttatcgaatcccactaatccgtaattcgcccatagctaaggttaataaccgcgacgatgaaacaattgccctcagttttgcagacttggcggtatatcatcattgacggatgcgtaccttgggaagagagtaatgaagcgggcaaagaatcgatcgctcgtttcctgcctgattttggcggtatatcatcattgacggtatatgctggcattttggaccaatcatcggaccagccacgtcatcaaccacaccaaactcaccaaactgcgcgtatgg

SEQ ID NO: 41231 - DNA, 4248 bp, Oryza sativa
atgcagcagagccacgggacatcatcaaaagttcagtcacagcaattcctgcagtaaggtgcgcccaggcatagcgttccagcttgcgcatgaaatctgcatagatctccaaatgtaattagtacttgtaaggaagaaagcaacaaaccatccacgacctgaactgccaccaatcttcaggtccacttatcacgatgacagaccagaccaacaacctgatcgcgcatacatgttgcagaagaaaaaaaaaagtatatatctattttgcatgcctttttttgactgtcgatcaattcaagaaatgtccaacaatccactcctaatattgataagaaagaatcaaccctctgatttacttgtctaatgttcactatgaaaagaatactctgcaaaactcagaacggggtgacaagaactggaagaaatatgatcccctagggagtcttaacacttgacgcaacagttttctatagaaagtcctacaagtatagtttctccccccaagatttctactagtttctcccccaagatttggacgcggacaactctttctcagtttttgtgcgttaagaaggtgaaaaggcttatgttacctctctctctgcagggtgtaactcatgttagctgtgtggtagaagccacatgaaacagcaagagatctgcctagttaactcatcttaataaacttacctcgtaatatttacacaaccacacgacccgctgattcttatctctcaaaatggaaattgtgcatcatcttctagcaccttaaaatgttgaggatgcctaccagagcaatgcaggttccacatatgtaaatatgccctctccagattctttacctgccatttttgtttacggaagtgaaaaagctaaccctgcaacagatatggacatggagttcaagactgaaaagttacccatcgagctgtatcaaacaaaggacaggtcatcctaacagccttgagcttgttggtaagagcttcgagtttcaatggattttctgctagagagactgccctttcttcatattcttccaggctggattagcaaagctgattaaaagaagagttcaaccataagggaaaaaacacaattggctgagatggctaacctattgactaccatctcttccccaattccagtagctagacacagtgaacctgcaaccctagttgccattttctctagtggaagagtgatcattgggagaccagcccataatatatctgtaccagtggtgtggccattgcacaacgggctgctcattcaatataattgagaaaataagagtatggcaggtaaataagaaaactgtcaagggcaataatggatggaaagtaaggttacgtgtcaagaaatagatctgctagggcactgcgtctgatgtgctcattttttgcagcaacatctgtaaatatgatttgatctgctcttactccctttgagattgcatctgccaaagctacaacgttagaagtggggagagatatagagacagaataggaaaatacgacattacatgcgcgcaatctcatctctccagctgctggaaatctcaatagccacaatgcactatttggtacacgcttcagaatattgcacctgggttgacaaaaagcaaaggaaaaaagatcaatacttccaacaaagcatgcatggtaggtattgtttcaacgaacacgtatggtcacatattataaatttaccataacaaacgcatatatagaaagaatttaccaggtgttgaatatgtctgggtccatcttgtagagttgattgaagcatgcaaaaataaatttgtcctctggcagaccatagtcagctcgcttgtgtgggcatacaggaccaagaacatctcgatttttctattttacaaatcaatttaaagttgattattaaactcataaaagaacaaccttattcaatctttggcctgttaagaatgtaggaatttcacatgaattttgcaggaataaagaatttctcaataatagtattatacaaaaagttcaaaggactcagtcctgaaccttatgtttttttatctctggttattttataactaaactaatcagatgagcgattatgtccccatattaatgcacacccatccaaaaaaaagaacccatcaacatcacaataggttggcccaaagacctcacatgtcaatgagaaagtcataggatgataagactattaaactgaaagttgaaaaagactatcaaactgaaggttgaaaaacagaggtgagcctaatgttaaaaagctgaatatatcttttgcaaacatctctggtaccatgtttttaacatacctgcttatagtcattcacaaagtaacagtggggaagatggacaagcttttctgagtatatatgtgaaaatttcagtggagaaacaaactgaaacaacaacaaatggccaatcaatttataggcagagcaacaatttgttgaaacaataaatggctataaatttcaatatttcacctcatcagtaaccaaataatcaatgtaatctgcaccagtggcccaggaaatcccatgtaagaaacctggattggggctggttgtaaagcgaatatttcattccgtgcaccctgaaacaagaagcaattttacgataagaaaaaaattccaagaacattaaaagttaatctcccacttgagacaacacatgatttgaaaactatacggtggcattcaaatatatcgcacacatttagcatgcataaagaaaatattacagtgcaatagtggcacaccaaaataacagctacatttctgaacatattgccatgcccaatattttataatttaaacttccctaaaagtgataaagttccatagaaaaactaaaggtaggattaataaaccacactaggataaagcagttatctatcacctaaaaaaactcagccccaaggggaaagatctcccctgaggccacaaggtattgcaactaagaagaagcatctaaaaccagggccgagaaaggtcacgaaagccggtcctcccaaaaatggggagtagccccctatgggttgggtcttaacccgtgctttgaggccactgccccatacacgagggcccaccctctgtaggtcaattcttaatccatgtttttagggaaccatcgagtgacctttttggtgcaaggccaggatttggatcctgttggtagcttcccgctgtaatacattatggcttttacaatccccaaaataagcaggtgattttataacaacagagaggatattgctaaatctgctgctgtaaaatactgattaaaatagaatgaacaaaaaaaaaaaaagaagccaagtgggggtttgcaaaagtgccatgatgagcagaaaatgaatagaattgtgatgggaagccttagtaagtccataccttagtatagccattaagattaataagaatttgtatcttatcctcattgataactttagcaatcatatcagatgacattgatgacacatcaatgaagtgctcagcttcagatcgaatacgctgcctccattctgtaccatcatcttggctcagggcataacagaaaacctgcaaccatatttataaataaccattccctcaaaatacatactctcggtgtgtataggctaacctcgatagtgtcttgattgtgcattccaaatatagaacccatcagatgagacaggggatgattgccaaaatcactactcacatacctaagaccaagttgaaaaattgatttcatcaggaagcaacaatcaagcacaatatgtagcaaagtagatatcataccctattctaagtcttgaagttctgccatcattgctgattggaacaggataggagtgtgtgaatgtaggaagcccaaaacgtgatgcaaccaaagagtaatgagctgcatatgttcgactgaaaaggggaaaagttgtaacatatggtctatgtagcatgattatcatcaaaacataccttataaaggttacagtgatcagtataggttaccaagagaagcctcacctgatttccagtgcaagagttgaatcaattggatatgctatagcatggaatggttgtacacttgggagagaggacatctggaacaaaatgaaaataagagcaatacatatcaagaaaagtattccttaggtaattcaggtaaacagtaatggaaataaaagctcgtgcctttatttgctgcctgatgattccctccacctccacgaatttctctgctcgatcatcccaat

SEQ ID NO: 41232 - DNA, 10324 bp, Oryza sativa
gaattcctgcagcccgaatacgttttttcatgtggctggctgtgaaggtccgttgtttgacagcggacaatttagagaagagagggtggcctcacaccgacaactgccccctgtccgttgtttgaagattgtttgcatctgcttgtaaactgtgattacaccaacagggtatggagattgatgcaagcctggatcaatgtcgacttccctatccctggaattgatgggctcggcttggcagactggtagatgcaggcaagcctctattttcggaccggctacagggcaacctttgacagcatcttatgatgatatgctagctcttgtaaggaaagcaatgagtgggtgttctaacaaaggtcgagaagaccagagcagctggtggaagacgtcaaagaagaaatcatggtgtggaaggcagcaagagttttcgcggcatgtaacgattagcggaccagccttggtgctgttgttgttctttgcttgttggagctgaggctctgcctcaataccggttcgacagccttctgtcgttgtaacctcaagtttgtatacttaatgatatttggtcggccggttccttcagccgacctggcaaaaaaaaaatctcatgtgatcatgcatacaattgttagcttttttattttattttgaatcttatagtatattcatttttcaccattgtgcaggcactataatagtaattataacatgattttaaacattataatctgcttgctacacaaactgaagagttactttttttggcatgccatttacttcaatgttttaccgctacaggaatcatcaaagaatgcacataataaaggaaagaaggtaagagtctatacctgtagagtgtgcaggagattgcaagtagcttcaggaaaatcttgacgtaattgtagggcctgcttgtaactgataattgatgcctccagcaagcctctgaaaataatagaaacatgttaaacatgtagcatcagaactgatgccctagaatcacacttcaccagaaaataaatgtggtagaaaatgcaattacgtgtctttgtaagcagccgccaaatttgcatgagcttcagccatagttggtctaattgtaacagcatgaaaatagtcttgaatggcttcagtgatcctgcctgcttctttaaatgtgttgcctctattgacaagacagtcagcagccattggatcaatgcggagtacttcattgaaacatgtaatggcgtgattacagtttccctttttcagtaacgaggaagagaattgtcattgtgttgttaaatggtataaacggttcacaaaagtataacatcaatataaacaaaaaggtgtatgaaacacgtattcgccgaaatcaggagcgtttggcatcacaagtacctgctgtttgtaaatcattgccaagttgttgtaaggtgcagataatccagttgtaactgtcagtgttgccatgtacagtgaagctgctatgtccatcatgttcctgcaagtactccaaaatgaaactcttgcacaatccaaaagaaatgcacaccatcaaaaactcacctttccatatatacattcccaaggtttgtcaaagcctgagggtgagaaggctgaagagcaaggcatgtctgcaacaagaaaaggcatgactcacatcaacgtaactataacaaaaaaaaagtaaaactattgaagacaaaattcagcagtttaatcttctatggtaacctggtagcaactaatagcctcttcatttctcccagcatcttttagagcatttccctatcagtggaaacacatcatataaggtcttataccaaaaggaacaacgatttagtaggcatacaagaatgaaaaaccaaccagattattatatgcttcaacataagatgaattgcaatggatggcttgtctataacttagaatagcaagatccagttgcccttgttcatggtaggcattaccaagattccctgaaaatactaaaaattaatccacatttccacaacagagccatcattcggggtcagttagtggttgctaatatgctaatctgtcttgtacttatttttcaataaattatgaaaaggcagttgccaaaataaaaacaaacaaactagagtccaactgttgactctactacacgtgatttgatatttgaaacatgataagatatccatttgaaacttatattaaaagaagtggagttaaccaaaatcacttttttaatgaaaaaacaggtcatgatacacctaaatgcctcaatcataaccaaaaaaaaaataatcgttttacaagtgtaccattcattgcagcaaacagtacctagaaattactgataagtgcataaccctcaagaacaatacctcaaaaataagcaattattcaaaaaatactgtgtcaaaatgctaaacaacaataaattatggcaacatatcaaatgtcgtaggaagcagctttggagcatgattatgggttcaatcatatttgccatactccaaccacaacaaacatctacactcaccataagctactgcattttctggctttgccctagcagcattctggaagcatacaattgcatcctgacgcattccagtaaccttaaaagtgatatttgttgtcagaaggatatttccacaatgaaaccagaatttatgatgaaatgaaaaataccttgtaaagatttcccaagttcaggtgtgcatcgtaaaatgctggattgcatttgattgcttcctgatgtttcacaaaatcttaaaagaatcagaatattgctggacctgtcattatcctaaagtatgctataataaaagaatctgcatgctgtagaacccctgatataattgattcgtttcagaaattttttgatataatgaattctgatcatgacaaaacagcattgtcaaggctccaatgacaagctatgaatgcatcaaagcatctacaacattaataaatgtcaaagtcaatgcaaaccgcataccttgtagtagagagctgctttattgaaatctccccattgcatgagaagtccagcaatattattccatgcatttgcaaaagtaggctttatgtttagagcatccaagtagtgactgtatgcctgaataaaatgcaaatcacataaatattgcaaatgaaaataatttgaccattcatcagtcatcttattactatcatcaattcaatgcagcataacaggccagcatcagtaatttttactttgaactgaattggaggatcctccactataattagaccctattctgttagttcaacagaattgttctgaactaaaatcacaacatagtgctacaaaatatgtcatttaaccagccacttatcaagatgctaggagaaattaaagctgtcatttagcaagaaaaatcagggtaacatcaggcatctgtgggcaataaaaagtgtattaggaaacatgctagattggtacaaaatagatcatgatggatagcaaaaaaaaaaagttacaaagtaaatttgatgaagagcttgtaaaaatgaaagaataactaatgatactacggacataaacaatttgatctgcgatttttttattttgctacttacttctctgtacaatccttgtgccttcaaaacatcaccaaggttacaatatgcatcagcctatagtcacaacacaatcaattaaaagttccacactgctgcaattaattgagaacatgtgattcatcagaatgcagtaaataaaagcgttggttaccagatgaggatttagtgcaagggcttgatggcagcactcagctgcctgactgagatttccttttcgagtataagcattagctaagtttgtccacgcatcagcaaaggtaggccggagctacagaagtagaatttgttagctcgcaagataaaaaaaaaatcagatagttacaatgataaaatgcatgtaccagcatattatgtgtgtcaccttagataaaaaggttaattaactcagacagtaaatctacctgtactgcatgcacataaaactgaatggcattatcaacatcgcctttctcctgcagcagacaataaagttgaaaacacgccaacacttaataaccccaacgattatggcctacacttttccaaaatgaaatggtctcaccctccaggcattcgcaatgctgttgaagcactctgggcaattcggctggattgcaacagcctcctcgttcttcgcgatgcacatgtcaaactctcgtagctaaaccaaatccccaaatcagtataacacccacgccagcaccggataaccacggcacccaaaattccgaggagaacctggtaatagacggcgccgagcagcaggaggttctccaagagcctcgggttcgccctgtacacggcattgcagtgctccagcgccgctttgtaatcccctgctctgtaactctgccgcgcgatctcgaggcgcgcgccctcgtcaactgaaacccaccaaaaccgcgacgggttaacaaccccacgacgaaaatgaaaatctcggcgcaatcgaatcacggaacagcgagatgaatctcgatcaatcatcagagaggggaagagaaggccaggggttcctgatcgacacgaacgaaacgaaccttcgagggggtcgagccggagggattcgaccaccgtgcgcagctgctgctgctggcgcggggtgagagggcgatggtggcgcaccgcgccgtgctcctccacggcggcggcgccaccgcctccgcctccgcagcgcaccgagagcatcgccggaaagcttctccgacgatcggagaaccaaaagtaaaaaaaaataaaaacctaacccgcgcgacggcgccgcgcggcctcgagctttcgcgtacgagtcggggagggggttggactctctcgggcgatatcgccttttcgccttctttttttttttcctttttttttcggatgcgtcgtcgcgttcgtggggattgggaaagcgtgtgacgcggtcagcgtgcggcgccgctgggtttggaaatcgggtgggtgagcggagcacaccggaacaccagtgctgcgcgcgacgtgcgtggccacgataggaggggacccagaccgtcggattgggtttcggtggtcgcggcgttttttggacggtcgtgattgagccgtgtgtggctgggctgggcttggggatgattcttctggtcaagtcatcgctgttgagcccatcaatggcacaacaagcccatttttagccttctctccctacagcgaggtgagtacaactgacaagtctgaaacccaaagaccatcacaaagatcgacctcttgagtccttgcgtgagaaagtacttcgtgtctgaggaactgagaggcagttgattgcacatcgtgcatgaggatccgtgaagctgtctttgatttttgttcggtttctattgtaaagttgattgtttttttagtactttccaggtcttgtttttatgcaaagtacgagtcggttgtacctcttttattgccctgtccgttctcaaacactcctaagtttttgagtatcgtatgaaactgaatctcatcatcttgactcattaatacatgcaagattacgattcggtatgtaaaaaatggcagtaacgatgtgtcgatgtttactttcgaaatttcagccccctaaatcctaaactatgtctgttgggaaaaagaaaggagtcagtactgtgtgcacaacaagaccagactagtagagaagcagcccggaggagaagtcgctgccaatggtttcacttcaccgggtcggatcaccacgaaaacgcgagcacgtacacggtacgtccaccgcgaaaggacggcacacacacacactgctcccgtccacacggcccacaaccaccaccacacacgacgccgcgcgcgcatggggtcgacgtttcaaatcaaatcagcgtcgtcgtcgtcgtcatcatcatcatcgcctcacctcgcctcgcctccaccccgaccgatatgatatgatacatcgtactgtacgtacctccccttactacgtgtccccggacctcaccgtgcaacgtcgcacctccccaccacagaacacgtacaccacccgcgcaaccaccgtgtcgcgcacgggaatctcgccggctcgatcgatcgccacccacccgctccctccccgagtccgagtcccctcgcgtcgtcgtgtgttcgtgttgcacgagagggcgggctactacggggattgtgtgccggttgggtgcgagagcgcccgcaataatgcgttcgttgcgtgcgcgcgcgcgggggcgcccacacgacacgacgaccccaacaccggcgtacgtagtgcgtggcgtccctccggccccgtcgtccgtctcccctcctcctgcccgatggcgacgcggcgcgaccgaacgagggggggacgactcgtctcacgactgctcaccaacagcgcgcgccctccgcgcgatcgcatactgtttcgtccccccgtctcgcgcgattgcttgtgtcgggcgaaacgcatggcaattgggaaaaacggaggaggcgacgaccatgatgacggcgacgatgaatgaatgatttagcgtaattaggagagggatctacatcacgccaactacgatccagtttgcgacgctcgcgtgggtgctagtgggcagacagtctagccattggggtcgccccggttactgcagcgccctgaaaccgatctgaaaccaccctgaactgaatgaacaaacctcctcctcatgtgggagtgctacttactacactgtctactaatcttgtttttatttttttgttcaggtacggagcaacttaattgtgctggagacctgtgtacgtacatccagttgttggagtggccaccttgcatggtgccctaccggcttagtggtggcaacgaacgccactgttatggtggatgtgggcatagcctcatatgtaggtctcaaactcctcaagcctcgttcgttttcgtgcgagacccagttgttctatgctgctgcacttaaattgcagtaatctcatccactgagatggatcacatggctggggtacaagtacatttcagagtctttttggtgttcattgttgcagttcaagatcatttccatgtaaatgcatagcaacaaaggttcaggattgaatgtccctgcaaagttgcacaacattttgatggcttttgatgatgctcgcataactactgaccttcgagagtaaaagttgtcagcaagcagacgcaagcatggctttatgattgattgcttgtgtgaatggatgctgcaagaatgatagtagtaccaccaagaaatctgcagtaatagttcagaattcaatgttctaaagaaaaaggaggtcagaaatcaataaatatttggggacacttaaagatttccagtaattccaggcgtgatgtgtgcagctagatctaagctcagcttttgacttctttgttgtggctgtcattgcatcacatctcccctttgtgatgcacaacgtacttttctctgaatgcgataaacaccggtgtttgctccaaagatataataataataataggaaaaactacatctcactccagttcccatccctggaagctgaaagaaggacgaacgaacggcaataagataatggccacctccttaacagtacacgcagcaccaaatctgaccatatcatgcatctcaccatgtcaaaaaaattataaaaatcatctttgtgtttgctaattgcagaggcatgatcttgcttgcaagatgcagtgcctactcctcatgacaaccacgatcttgcctgagagttgcactgtctgtccctccatgtacaaaccacgatctcactgtactgttccagtttcaccctttgccccccttttttttccatgggaccttctcatttgttgcagagcagtctctttcttgtacctcatgacattgtcaattcccatacttattgtgctgaaaaaatcagcaggagatgctgtcaggtaatcttgaattttcatctgtggtagtacaagagtaattatggtctggaactgagtaatccaagtgcatggatttgggattgggaccagtgaacactgttctaagatgttgtgacccaattagtcatgatttggagctacctgagctataaagataaacaactgctactacagaattgtttggtccaattcaagaaaacgagtgatcagaacaactccctccgctgattccgttttttggagcgtgatcacagcctggatgatttggacctcgctgaagtagattgggagctcgaattcttaacaataaaagggttgttcagagagagcagagaaagtgacatgcagaaataatagtagtatttcttttctgaacgtagctatagatgaacaggagcagaatagcaacgcagtgaatgccgttgcactgcctgtctgatgtacgcctagctagcatctctgcataaaatcaatctgataatatattggagttggattggaaggcctcctcagccttgtcctactgctgtctctatctctgggtacttatcatacagctcaaaagcagccacaaatccagtcccccagctcacaacttgattgttccttctgtccatgtccttttacatgaactatcttctgggataaacagattctaaaattcaacttgttttctgacccctcaagtactaaaccagaatttgcatacagtgaacttcagcatgaacacatctcttccgagtgaaaaaaaaaatgaagttcagcatgagcacaatgcacaaccaagaagctgaccattcttcagaggggaaaaaaaggggataatttcagcttaaggagatcgatccatggacaggaagaaggatcttaaagatatatatcagctacaaatataatgagaatacaaataatgatattacacgtcgtccctctctgcttgagagggtaaaagggtctgaatgaagcatcatatactgcacccgacttatgtacgatcttgtagcatacatatatatactacacccgactaccgtacatggtgcgtttcatttttgttcaaagaatcattacaccaagatgggaaattagaagctaaaacactgctagggcccaacattgttagggttgaatctcagagtgctgccgcggcaagctgacttctctgtatgtacaatgggcgtcagagctttggatcgaacctttatttggtcatgtcaaagctccattttcatgtggactgtttgcaacgatcctgatccatagcagtttacacatcagaattcagttaaggtgacgttaactatggcatcaggtaataggatgaggaaacttgcctaccattgtagctattggaagaggtggcgatctcctgactttgccccatatccatctgaacaacactttggagatcatcttgccagaaagcaccaacctgtaaagcattcattcctcatattcagcatcgattcattcgaacattttgtgagatcgagacattggtgtgcatttttacctgagaagccgcatcgctaaccccattgaggaaaggatggtgcgagcccattggccggcaaaatgccgggtccaatgggtgcatagaaccctggttgtccatgccgttcgtcaggccacaaccgagagggttcccttgctgaggctggttaatgtagggcagcggcgcacctgaggtctctagtggaaaatgtgagctctgtaacgggctgcatgactggtgcatctgatcagggagaaaatcggaaacacgaggtaagttgggaactgtatgattggcacaataagagaggaaacaaatgtagtaatgagatcgcataagcttgccctcacatctttagcaaggaggttaggcaaattgttgaagtccagctggggattcacagtggccaacttcatggacaaaaactgcaaaatggatgtgaaaggcaaaggttcagatggcgcacgcccgcgcttgctgcgctctaaatcggcaaaagctgcagtttcacaatcattctgcatctgtgaatttgacactggacaaatacctcgacttgccgttgcaacgactgcacatagtttatgatttcatcgagcatgacagcctttccaaccacctgaaacaagtaagcatttcccagtttccaatctgagcacaccgagcaactcaagtaacaaacaggtgggcgatgatgcaaatgatgagtgcttttcttcagttaccttgttacaacccggcacgagatcctgcagcagcttcatcctctggcttatcttctctcttctcacctgaattgatcgaacaagaggagatacacacagcatgttaatgcacagggaagatgatgatcagaagag

SEQ ID NO: 41233 - DNA, 2439 bp, Oryza sativa
ccccttctgttcgatgatgtctgtgcctttagcctgacggtgaaatttgtattttttgtgttactatttggtatcccacataatttcttcagctagcttttctcatttgtgccccacttcgttttgtgttctttgaatgtattcttgcactctcttcagtgaacacaatatactattctctactatcttttaaataaagcttgagtcgattcaaaaattatgttttaatcgattcaatcaggaagtaaattctaccagttcagctagacttagccgacatagttgcataaacaagcatgcaaatggcatggaatgcggacagaaagggcaagagctttatgattggcccgcgagatttgttcaactcatctgctattgtaacatataaatacgtactatactgtagtatagtactgtatactactacactgatgagagcattgaaaccactcggcagccatagcagggcagcaggcttaccagttgctgctgctgctgctgcagctgccgtagaacacaatttattactagacctgaataatgcatttgagcaactagtacaaaacaaaattcatatactaaaactatcttgatgaaaatggagtaatagcttaattacactgttatgagtacgggggcagtaataaaatctgttcttcagaagtttcagacaggtggtactccgcagtacctactggactgagatttctttcccctgccaaacaacatctatctcgagaataacgctaatgctaatcaaagattaatcatcaagctcccctttttttcgtggaacgggaatacgggaacattagcccaaatttgtccggacagtttcaaagaggacaatttgtacaaacagtagagctgcctcttgcagtatacaagccaaacagtggcgatcaatgtgtaaaaatctctgccctattgcaaatgtgtcgtaccatttctgtttctgtttgcaagaggatgtgaaaacactttagaatcacagggttggcaaggtaagctgatcccctttgccttaaaatgataaaatctttatggacaagtcatccaagaaggaaaaggccaagtcattcatgcttgcttctggaacactcatagtagtttttctttctcctttagctttaataaattaaccctacttacatctttacatccaccaccctttcttgggttaaaagcgtgggcctttttactgctgcaatctgcaagtaggatggtttttgtaggagacaatatctcagtcattagtgctactcatctttccttgcaggcggtcctcaatgcaactaatgttttgcagaagcaaggtaaatagataatatcacaatgtaaatagtaccaaatttactactgtaattaccaacaaaatgctctccctgcaaataatctgaacccaaaaaggcatcaaatttctactacgaatagtccccatatgtagttgacttcctggtattcctgatttcttggcagctgtggaaggagccgaactctagtgtttttgactccgttctctctttagttcccgttgttattgattccatccactcagaaggccgtatatggtctgccgcggacatcgccgtttttggggatttgctgagagcttagtgtggcgccaccccccctccctcttgtttgttggagtagttttttttcttttcgtagtagtccatccttttttttttcttttcgcagttggttgttggagtggttttctccctcccggcataggcttgtctggccgagtgcattgtgtaacaaaatatctattcttctaatatattgacgtgcaattcttttgcgtgtttgaaaaaaattgcattagcaatttaggctctgatcggttaagtagaaaaatgaaaaaaaaacaatttgtttgattttgctgtcatcgtttgttcatgttttatcatccgagctaaaattcaactttagagttgattttaaggttttctttattaagagtttattttttcagtatcaacttttataaactcatacgtgcaagttttgagtttatgattgtttaggcccatttaatttataaggaaaatatgaggaattcggaggattttaatcctatggaagaaatttctatgaagacattaattagaaataaagcattgaattatacacccttcgtcccataatataaaaagttttagagttggacacggttattaagaaagtaggtagaagtgaatggtggagggttgtgattggatgagtagtggaggtaggtgggaaaagtgaatggtggagggttgcgattgcttgggaaaagaatgttggtgaagaagttattatatgttgggacaaatcctaaagattaaaagttgttaaattttgggatggagggagtattacttttctttaaaacactcttatagagatgttaattagataaaagttcttaagattatctctctc

SEQ ID NO: 41234 - DNA, 2373 bp, Oryza sativa
caatttgaaaataatagtactactaacctttccagagtcctaaaaaaattcagttgagtttgcttccacttgatggtgtattgtggacggatcgaaatcgcagagcccaatcttttgcatgtattaaacaatatatactacttcgtatacttaattaatctttgcaaaagaggcaccaacatgccaggtatgcaaatgccattttctaattcctctgcatactttagaagccaaaagcacccaaattttgtattaagatgttgctctagttcaaacacctgtctcacagcatctttctgaatacgcctttgacagcaatataaaattatctaccaaactatgcttgccaattggttacagctctgcttgaatcctagatctggactactacaatttattttttcttttgtgtctgtgtgtgaataatggatactttttcttgctacaaaccattccctactctttgttttaaactgtcactgatccattagaagctttatatttatgagttgtgatgcatgcagctcattattgacaccaggtgcttgtcttttgttagcaacatcaacactaattgcgggctaatgaaaaaaatcgaaacacaagaagattggaagaataaaacagccaaggtcagacagatcaaaacacaaatatgttccattccacactcaagacatcctaggaagttgcttggaactcatcagtcctcacaagtcataggcatgcacaatgtccttaattccactcatacataattatctggtaaatttagtattatctagttaatttcctattttgccacttctagtatgtgaccaaattcattatatacttataaagaagagtatttgcccaaattgcagggccattgcacttttactgtctgccaatgtggccaaagttcagacttcacagacataccttgaggacggctgaccttaaaatttacagcaagcactaattaaattatagtccatcagttagccggtaacaaccgagggtttgtacggaatccatcgtaaaaagaattggcaaagacaatttctgactgccaatggtgcatggcatctactgctgggggcacagtactaatcccctgttaatgattgcctcgggaagcgtgattaaacaaaagggaggctgtcttatcagcataacaacacaacaaatcagcaagtgaccaatggcagcctagttttatctctgccatgtgggattgtgccatccatccttgcagacagggagtacgactaatcccaaaagataatcacgcttattagcgtccggtcaagatctaaccaccaccaccccccctccaccctctgcaactcgattgcatcttgtaccttcattggactctcacatttggcccccactagccagaccatatcacaagagattaaccaacaaaaaaaaatcttgattttgatttgctcagatcaaaatgtgattcacaagaaattaaccaacaaaaggtgttttctttttgcaaaacacatacatacatacactcacctcacaaatacacacatatacaacatatccttataaatatctctaaaaactgaaccagcgtatcttaaaattagcaaagtcatcgtaaacgttttacggtcgacggatacaccgcttaccattaaaatgtggttcaaagtttgtaacttcattgcaatatagcttggcaacaacttatctgaatttctctaggaacatgaccgtaacccatttggaacaaagaaattttggtgttctcgttggaaaacaatccacattgcttgctaatctcgccgcattgggtgcaaaagaagccgatgctgaatcagacgacgtcttccttttcggccggcccgtgtttacaactcatcacaggctgcttattgttaggaacacactatactatatctcaaacagtgttacgttatgtcaaagtgttattttagcagggcagctttagtagtgagtgaaggagtaagtttccagccgtgcaggcactagtgctccactggtgatgatgtggagaaaagaaagctgctttttaccggtgtctgtccttcactgtctgtcagtcacaaacttcttggtaacatgggctccaatcattgaataaccgaggagtagtagaaagttttcagtactgctgctgtatactgtgattactgtagtagtattgggcagtaactgcaatgcaagagaggcagggagatgctgtgacagagggagagaggtaggtgcatagggttaaataagggaggactcacttggactcgcttctggcagccacgacttctttcaaacaatttaggcttttttattataaaattatatagctgtaaaaatctagaaaataaatttggaaacaaagactaaaaa

SEQ ID NO: 41235 - DNA, 3812 bp, Oryza sativa
aagtcctcgtcaggatcgaaggaaaaacttaaggaatctagtagtagtagcacttgctggcgtggagcatctctgaatgtgtctgaacgattcctgtactgctggattctcccgccacgagaccaaagtccaaacacgagtctcatcattagcttagcactagtacccccgtgcaatgcatgtactgcgtgtgtgctgtgttttagtaatacgcttgaaacctagggcaggcacaccaccgcggattgccgtgcacgcgcgagcgccgcgcgttgtcccacgccacgccacggcgcgcgcgcgcgcgcggcagatcggcaacggcacggcgcccgcgcccgcgcccgtgcgccccggttgaattgactggacgcccgcgcgcgcactggcgcgacacagcgcgacgcgtcgcggcgccttccaagtgggcgtcggcgtcgccgccggcgccggggaggaacgtccatggcgcgagcgcgagcgcggcgcggccggtcaaaatcttctctctgctggtcgagccgtcgtctcgtctggtcagagtcacacatcgctgctgtcccttgggactctcgacacgccacgcagcgcttcctgccactgctgctgctgatgctgatgctgatgctgccgaggtgaagaaaaatccatggcggaacacgcgcgagcagtggcaactcgctcgagaccgtggtactcttggatgtgcagtgcagggcacacagtcgaggctgctgcctgtcacctgtgttgttgttgttgtggtggttcatcgatgacaaaccgcaaggattcggaacggacggacgcaagcaacgcagcgagctcgtgctctgtcgctggctgcgtgtgctgtagcttctggcacggacgggctcgtgtgtgtacagcgccgtgttgatgctcttggcagggtgggcagtacacacgccgtgaggtcagactcgttcagtgaggtcgacaagaaactgcaacagtgaagagtcaagctggtggtcaatgatcagttctagacaacttagtactacctccatcctaaattatagtagatactccatctgtttcaaattataagtcattttgactttagtcgtctcaagtttaatcaagtttgtaaaatacaatagtaacattttcaacccaaaacaaatatattgtgaaaaatatattcaattatagatttgataaaactaatttggtattgtaagtgttactgtatttgtatacaaacttgaacttggaatagtttgactttgaccaaagtcaaaacgacttataatatgtaatggaaatagtgcatagttaaaagttgctatattttaggatgaatgtagtactaagttacatgtaaattccacgctcatttcacccgaggatctgatgatctttgctaacagctgcagtgcaaatacgttgaagactccaagaccattgcgacaaggcagatttttcagattctgtcccatcaggggaaaaaaagttcagaggacatgaaaaaattgtaccataaattaaggatggtttgaacaatactttgaacttcgaagtaacacgatgaacatgaaggaaacagcatccttttttgactgaactcttaaaaggaccactgaaccgctgttttgaggaggcgctacacaagctaactcttcgttgtgtggaacatcaaagacgaccttagagctcactattgctagcaccaccggttgtctttccattgacggcgataagctccgtgtcaaagattagtgttgctccacctattggttacgaaaccgtatgtcagtattataggtaaatgggaaaaaacttatcacatgccctgttggcaatgtaaaatgtaggtgtgaaacatggtaaaatagccatgtcaaagttgagaatctacacatggataattctttcacaagaaaccatcaagcaaacaaacaaatattcagaccatacctggaatcttcggtggggagcctctctccccataacccatctttgcaggtatctttagcttcctcttttcaccgacacacatacctagtaacccttggtcccaacctatagataaaaacaacaatgtaggttgttggatatgcgaaggccattgatatgaactgcacagtccatttcctatttttgataacatccttggtcattcaagctacctcagtatggactatggataaatatggagaagttcagtattccagggaaaaggaataaccttttatcacttggccgtttccaagagtaaattcaaaggggtcacctctgtcatagctagaatcaaacactgatccatcagtgagtgacccctgcagcattatcaaccatttcaactcaatgatggaaatgtggaaataaactatgcaggaaagtaccacaatttttttttctttaacagttgtaaaagaggtcttttaacaaacatgacagggaaaccaggtaaaacacacaataaaagacagaatctacactgttcattcagcaatgtagtttatcactctatccacaaaactatttaatctgatccgttaaataaaacatgagtatgtacagatccatagtccaatggacgatgccttccattatatgcagtacaacacgatagagaaaaacaaaacttagttctagtccttaacatccaagttagtgtagttagctgcaatcactcgttctttgagtttcaaccactcaatcaggttttattttaaatgttggaagtttctaggattcatgtgggaatcgaaatgtttcaagttacttttcatattattaacaaagatatggaatacttacacgataatgcactttgattttgtctcctttgtgagcttgcagggtgcatgactctggcttgtactgaaaggaggatagccaaagaaaacttatgctatgcaatgcagtgaaatgcagaaatgcttaattttaaacgtaaaaacagaacaatcctaactttgcaatgattgtctttttcctgtaggaactgagcgttgaaatcaaaatatgcaaaaaacattcaataacaacaaccgtcccccccccccccccccaagcacacactttcatttgtgatgtactatctgctttgagccggtccattcagcacatgaatagatcaggtgaacataagcaatttaaaattcttatctttgttgtaaagaacaggttcaaatattcaagtgaaacaaagttcattcaacagccctttcatggaattggaaaagaccctaaccagtaaccatccatttcgcacatttcagatccgcacaacacaatctattctaccatatcgtccaagctcaacaacaccaatccatatcaaattcgtcacgcctggtacaaatcgagcttgtttgaacggattagcagatatacatcgaatcgacgaactcagcagtatcagatccactacaccccgaagcaagaatcgcaagaacaaccagaaaaaaccggttaccttcacaccgatctgaagctccgtgacatctccggacttcttggccgaagctgaaagccaaatcgagcaaacgatgtataagccaaacatatcaagaacaagaagagtagaaaaacaacagatctttacaagtcggctgagctatgagaggagatggggatggggaacggggttgtgcggataccggtcaggatgagggccgccgcgacaacgacggcggcggcgacggcgaagcggacgagccgccgctgctgctgacgcttccccattcgcttctccagtacacgatactaccagttgacgacttgacgtaggcttcgccgtatttgcacacggaatggttcgcgtgggcctacgactg

SEQ ID NO: 41236 - DNA, 3223 bp, Oryza sativa
agatatatatggccggtcaacacccgcaagctcgatcgttgagtgatgcatatacttatgttataggtgctgtccacgtacgcataaacatattttttattatattgtatttgcgtgaaaactatatttgcattgactgtctgttagtaccataacatcaccttaatccattaattagtagctagtattattaaagtttgccttctattgaggataaggaaaacacgcaatgaagtgaagaaagctgagtgtgcacttacttgccatccaagttaccaaccgaatatcaaacttaccgtggacttggcgtcaattaattaacagcgaccattattatgcaaagttatcctcgcctcatttttaatgtagttataattttttattcaatatttgaccatccaacttatttaatttttttataattagtatttttatttattattattagctaataaaactagaataatattttatgcatgatttattgttattgttattttttatatattttttaactgacggttaaatattagacaaaaaatcacatgtgcacttaaaataaaataaataggggggggtataaagtatctacttgaccgcctccagcccgagacctccgcgtaaaaccattgtccggccggcctccgcgtagtcttccctagcttcggtgtcccaacgtcgccgtccttcaccattaatgcttcaacgctctgtctttggtgactcctgtcaccacgtcagccatctcatcactactctatccctcttatcttcgggtgtgtttagttcacgctaaaattaaaagtttaattgaaattggaacgatgtgatggaaaaattagaagtttatttgtatatgaaagttttgatgtgataaaaaagttgaaagttttttttaaaaaagttgagaactaaaccgggtcttctttggctgtgccgctgcggtgccaatatatgtaccattgttattctctatcttcagtggctccacgcaaaactcccacaccctcatgatgtgtaatttcgttgagctccaaaactttagtatttttcgaatgttttaaaattggaaattaattctgaccaaattttaattaaactcataaaagaaaattaaaaaaaatcatgaaaataacggatgaaatagtgtcgtgctgggtggtgatttgtgtaccatagctaccttgccccacagccatcgatccaacatcgttacggtcatttctctaagctaaggaacacctcctattcccctaccccttaactcttcttctttccctacctaaccatttaatttaccaagattaaattgcaaggttaaaaatctatgtgatcccctaaccccaatcccctcctcttcacctacccaaaaaaaaagtgttgagtgatgatgtataatatcaggaaatatttctatcaaaacttttgagggaatgtcccatcctttcttgcatgtcatgcaaacatttatgaaaaaaataggaaaagttagatcaatactctccaaacatgcaaacttaaattcaacctctacaaattataataaaaaggacaaatatcaaactctagctagtatgtgtatattcacaccaaactttttttatttgtgtccttgtagaaattaaatttgaatttgcatgtttgtaaagtgatgtcacatatggatcgaattttcgaaatttctttatagttatctagataatatgtaagaaacaagagaaacatccactccgtgagtttaaaatccattcccatataacatctcaatatctcgacagttttgcatatatattattacacaccattgcaaacttgcactccaatcacacaggtgacaattaacaaaacatatatagatatataatagtacgtagtaagtagcacacagactgagtgtagccagcacactgcatgcacccagcacacagggttacacaatctagctacacaacacaggtggtagtacaagtttacaacaatacactctctctagtctctaatacctcgctaattactatagctatagtacttcatctccttgaagaagaaaaaccagtacttcttctaggacgtacggccatccatgaaaaatacatgacgtttaatttacacaaacactgtacaaccatgaacattattacatatttagcatcacatccgatcgatcgaagaactaaactgacgaactaattaaagttgtgtagatcgaactgtagataattttcgttcttggacacacgcattcattcatatagcatagctttcagagattcagagatgcagctgatgaacacacggacgagacgataatatggagcaaaacagagagcatgagtagagtgtcatcatcagtctttgtccagcccgaacttacggtcgatgtagccgccgacggcgtggaacgctgggccgaagaacccgccgccgccgccgccgctgttgcttcctgatccggatccagcgccgccgctcctcctcctgtcgccctcgctctcgtacttcggcgacggcgagtacgacgacgacgatgagccgtggccgggcggcgtgtggtggtagatgaccttcacctcctccgcgcggatgaacaccggcgccgccccggacccgccgtcctgcggcggcggcggaaccggccagccggttccgccgccgccgaagttgttgtggggaataggtgcggctccgcttatgatgatgctgctgccgccgccgtagggagagttgctgccgccgtagccgccgtctttaccgtaggacaatgatccgccgtaggaagtgttgccgccgccatagccgccgccgccgccgtagtaggagcctgaacctgcaacgactcccgtgctgctgccgtagtaattgttggggttgccgctgttaccgccatagctgtccttgttgtaattgctgctgttgccgccgccatggctgtccttgctgtggttgttccggtctttctcgtcgtccttgtgcttgtggctgctggtgatcttgtgcttgttcttgtctttgtcgtcgtcgctgccattgttgttgttgttgcttgtgtagctctggtaatccttcgtcttggtctccttcttgtcgccggcgccgcgcggcggcgacgacgaccgcctgccgccgccgccgccgcctcctgatccggcgccgtaggaagaggtgtcgtagtacgggctgttccacgacgacatcgtctcgatctctagcttgatccccaact

SEQ ID NO: 41237 - DNA, 9085 bp, Oryza sativa
agtgtgataatcggcaagatggctctacagtgtgtggccaagtatatgttcacaacttatagaagcccctgcagagacgtcaacgccctagatagaaaagtcttcgtcttcttccccaaaaatacaccttttttaattatcacagacaaccttccaaccacagttaagattaatatacgtaaccctatggcttataattgctgattagtgattcggattgaaatccatggaccaaaaataattaaactacgagtagctaccccacttatagtacgtcgtcaacctgtaaacttgcgtattcaaacacttcagctaaatcaactgatacctgcacacttcgatccattatacactgcgtatatttcgtggccagtgtaccgaattcgcaatcagagaaagagagaggttagaacttagaacaagactgtgtcagaggaaatatctctgaaattgcgcgcatgcatatgccgacgttagcattcatacaaattgcaatagcgataaaattgattaatcctagtttgactgaatatcatccagaattgaatcacattttcataaagatttttcgtgggccggaacgccggccgaatcctatatacttatatagttcatccccactaaatatagttaatgctatttctctcttctctcgttaagccacatcactctaattatttctagcttttaaataaaagatctatgatccaaattgtctcttctttcttctctctttaaaaacatacaatcttaattatttttaggctcaaaattatttcaaattgttttagttttgataattaaattacatcttatttgcacatattatgtaacttaatttttcgcagcaacgcgacggggtattcatttagttctattaagaatcaagagagcaaattaatatcatagtgatatacaggtctagatatatattgattgatctctctcccccagttagcaactaccggccgaatggcaggcagtacagcgacatttgcagtttaatttacatgcacgtacatttgcgccaatgtggtaaatacaatatgattaatctctcaacaacattcaaattgttacattgtaagcatggtcatttttcgattgggctggaaacctggaaggcagcaaaaattaaactccccatcttaacaaacttgaaccggatattagtaaaaaaaaaagttacagaaacgtttgtggtttaattaaatgaattgtggtcattcttcgtctgattggaccggatggtctacagcaaaatttaattacataggtagatagataagttgtaatcagattagtattaattcaactgtgatgtatgcacctagctcatgatcgagtcatgtcatattggacggatttctacggctcaaaggcatacgtaatttctgttactgatatgtggtactccctccggttgtaaaaattaaaattgacgccgtcgatcgacttttaacatgatattcaaacgtaactatttgatttttatgaccagtaaaataaatagtaattaccataaatagtaattacctttttttaacaagatgcatgatcaaaacgtaatgactaaagttaactgtgtcaaatatgtatgaacagaagaaacacttactaaatacagtagtatggaagcatattgagtagctagccagcagcacactgaacatacacacagcatacagatagctagagtacaacacaaaaaacagtctccggctagtacaattatacaacacaatactagctagctagctacccacatgtgtatatactatatagtacattagcaacttcatttttccttgaagcaggaaagccggtactactggtttacacttcttcggcagttgaaaaaaaaataacaaaactatagaatcacgagcactcattaccacaaattatttggcggccttccgtgattatttcttctgaataataacttaacttaactgaaccaacgaacgcttgtagaatttgagtacgtacgaattaagtatgtgccaacatgcatgcatgcgtgcacatgcagagttgcagtagatatcgatggagtcgatcgagatgcagaacggagaggagacatcgacgaattgaattgaagcaatttaggaatctatcaggctcagtcgaatccgaacctacggtccatatagccgccgacggcttggaacgtcggaccgaagagcccgtttcgtcctcctccgccgccgccgttgtctctcctctcgccggagttctcgttctgcgacgacgacgaccctggctgcgtcatgtagatgacgttgaggtacgtcggcgccgaccctgagccaccctcctgccgcggcggcgccggcgcaccccagccggaattagagccatagccataggaggcaggggcgctgccgccgccgcctccggctacgatggcgccgccgttaccataggaagagccgccgtagccgccgccgttgccgtaagtagagccgccgtacccgccggcgttgccgtaggaagggccgccgtacccgccgccgttgttgtaggggttgtagccgctgggggcgctgctgctgtagccctcgttgttgccgtaaccgccgtagttgctgtagctccggtctctctcgccgccgtcgtcgtcgtacttgtagctgctgctgctgctgctgctcttcttcttgttgctcttctttcccctgcgcctgttccggtcgccgtggtcgtcgtcgtcgtcgctgcccgtgccgctgcggttgtcgtcgtcgctggtgtacctcgggtactcctcggacgtcgtccacggcgagcggccgttgccgctgccggctgtccgtaccggtcgtctcctcctcctccggcgaacgacgagctgtcagagccagcgtagtactggctgctgctgctgctgcttttgccgctggatttcttccaccaggacatcgcctctcgacttcttgattgaacttaacttaaattaattatggtcccagctactgatcgagctagctagcatgtaattaacgatttactgattagcagcaagatatgatgcagtaaataaactcgaatgagaaattttttttgaataactcaagctgaattagcatgcatgcatactaacccgacagtagatgatcagatgataggccagataagcgcagatactcacaagagagatgcctctaaaaacttgatcttatagaagctcaaagacatcgatcagatcaaagtctcgtcaacttcaatataaaatagggcactttttaatttaatcatcacctaatgagacctaaacttcccaccaacagcagttacgcgtggatatatcagagataaaatgagacccaaggcggctgtgccctgattatgatccaaatctagggttccaaaattattagactacgagtccacttgcgaagtatggcatcacatctgacgtgtagacttgcatatgcaaaacacttgagctaaaccaaccaatccctacacgcttaattgcactgcgcactgcgtagatttttggtggtcagggcaacgaattttcgcaatcagaaaagcgaaacgaattaaagagttaactaatacaaatttagaagtagactttgtcacaggaaacatctatgaaagttcatatatatgaaataatgaaaacgttatgcatgcgacaaagagtttaacttagtctgactgaatactgtatatatccagaattgaatttgaatcacatcttttgataaagatatatatgtcgctatagcttgagagataatccccagttagcagtagcaattagcaattactagacggaaggcagtacagcgacacacacacacacacacatacatatatacataatatatatatatatatatatatatatatatgcagttttaatttacatgcacgttcactgttgtgtcaatctggtaaaagtgattaatctcagctagctggatccaagtaattaattgttacatatgcaaggtcatttttcaacagggtataaaaaacggtggcatttggctgttaattttggccggaaacctggaaggtagcagacactatccttaattaacaaacttgatctagctgcaagtagtaaaaaaaaatgcagatatgtactgtagtcaatgagttgtagtcaatatcttagtctgattaattaattggaatggcccatatatatgggacaattacgttcttccttttttttaaaaaaaaagaaatttcggtcatgattttaatttaccactggttttttaattttatgattttcctatcatttttaactaataatttcacacatgcccttgcattttatcatgacttttgcccctttttttaatatgaattcaatttttaaatgaaaatgtgaggacaagctagcataagcttgaaatgaattttaacaccattaagtcattttaatgaaatgacaggaacaagcttcagtcaaaaaatgagagcaaagttacaaagttggaaaagtgggtaaaatcataattggaagtctcaacagaggtaaccataaatgcctattaaatatacactgattgtctagaacgaaaacactatgtaagatgtaattagttttagcattaatatatagtttgtggttttttttatcacatgtatatagtttgtggttgatgtaatgtgatgataatcatactagcttaaattaggttgtataaaaaaatttcaagcgctgcttgcacttggcctcatcaatcatatctaacattggacgaaataatactataaccgttgtccttggtaaaactacaaatcactggacggcatattcaagcagagacaaaatttggcatatagcaaggtgtgctttaacagcataggatcggactaaaagtccatttatgatcagaacttatgaagaaaattaaaaattgcaggcttggctgcgctcggccctgcagtcccccattttatgatctggagtaacttttagtgtatatttaaattagaagaaattacacttgaatttaattacaaactgattaattacaatatgatgcaatcacacatacatacattaactgagcacaaacatacgtatatatatatacgcatgccgtacacacatacttatgcacacagtgtcacatatatatctcacacagtacatgaatatatacagagtacagtacatgaaacaaaccgacactgcagtcggaaaaaaagaaagaaaaaataaataaaaataaagccaattaaccacaaacacatacatacacgttgcggccgtatgcagatgcaaagaagaaatacttattagaagcgagcaattaataattacgtatacgcacgtaaatacggtcgtacgtatactagagctcgcagacggtacgtacgtacgtatactgatagtctgatgtacgtatatatgcatgtgataatagtacaagtttcgtgttaattacgcgcgtcaccgattaattagtataattaattaattagtcgctgctgtggaagccgaaccttctgtcgaagaaatggccgacggcctcgaacgccgggcggaagaacccgccgctgcgccgcctctcgccgctgccgccgccgccgccgtagccgtcgccgccgtcgtacggcccatgcggccccccgtacacgtggacctcgcgagtgttgatgtacagcggcgacctcgcgccgttctggggagtccagtacccggccggcacgccgccgccgccgccgtacggcacggatccaccaccggtgtaacctccgccgccgccaccgccgtagtacggagtaccgacgccggcgccgtagagggtgacgctgccggcgttgtagccgccgttgtaaccgtaaccaccaccaccaccgtagttagcgccggcgttggccttggtgctgccgccgtagccgccgccggatgctgcgtagccgacgacggcggcggtggcggcgtcgtcgttcctgccgctggtcttcttcaggcgcgacggcggcggcggctggcgcttcgccgacgtcttgtcgccggcggcggccgcttcatactgctgctgctgctgctgctgctgccgtcctcctgatccgtaggtgtcagtggaggaattggagtagctgctgccgctgaaggatctaccgctgctgttccacatacctatccagcggtcgatcgaacaaattaagctaataaaattgcacgtacatgtcaagaatattcagagattcgatcgttgcgttgttttatatatagtatatatatttggtggctgcagctaatacatgtaattagtatgtgatatattgcattcagctgacggtatacatgaacggatttgcaaacgaattaaagaaccaattatcatatactcctataacggatacttcagatatattcagaagtattcttgaattattgatcagctagagtttaatgaactgtgtctgacgaatttgattatgtcgatctggttagctagtggttgatggatgaactgtgcctgatatggtagttcttcaagcttgcatggatgaacataatccgctagaacagtaaaaagtgaaaaagaaacataaaacaaagtaaaaggaggatcatagataagatacctttaatttgtggaggagatgacacttaattggatccggtataaggcaccctctgcagttgccaaggggcgttctatatagagctagtacactcaagtcaaccacacttcgagtctccggttttgcaataaaaaaaagaagacacttgtcgtcttagctatagagaaaaagcttcaaattatctgcgtcatatttgaatgccacccacaatgattaccatattttgtgttaatgtaaccgggggcgaatttactgttggggctccaattgaacaggtaacaatgtgttagagcaagcaggaacaacagtttgcagtagaggagcaagtaagaaagaaactgaccaactggtttgctacgatgaagccggccaagcttcatagcttcagattttatccaatcaggtctggtagcatatagggtataggcgatagtaaaatatgaatatcaataatttaggctttaggtataaacttacaactaatttattctttattattaacactacaaatcattttactttcatttttggtgtttcagtactaatttgaaattttatgagcgttaaatttgtgttatggattgcgacctaagagccccaactcgattttcattctacattcgccactgaatataactaaagttaaaattaattaacacatattaattctgccaatgaatgattgatcttcttaattatatgatcatttaacagttaatattcgccactaacaatgatcaagtaatgatagattcatgatttgtgcgtgtgtgtactgacactgttcacccagctagctaattaattactctcaccagaaaaaaaaattaaccctcgtggtaattaatctctgcaccaagcgagaacctttgatcagaaattaatgaaaccaacaacggtcagatcaagctaggtctcatactgtacttagaaagtagaaaatgtgtcacgatctagtatacgcaaggctgacttctagggatatacgtgtgcttgcgagttgcaagcagccaagaggacgtatgaactgtatcatttcatgaaacagccaatccctaactagtcactgcattaattaattaaataattacagacagtagtctgcactagtgcagagagctcagatcaattgcgattatactccctcagtactcattaaaaaaatcgtttagaacaacgtttaagtcaaaccttaaaaatataaattatgaataactcttaagttgttgagtttgaaaatataaaaaatatataaatagatttgtcttgaaaaataatttcataaaaatataaatatatcattttttttaataaatatttttatataaataaaaagtcaaaattatattttggagaccgtatcactatccaaaacaatttcctttaccggagggatcgagtacagcgagagctgtggacttctcagacacgcatgcattaaaccgtgtgcacgtacgcaatttcggcagcctctctctctctctctctctgtagagtaagctaaacagtgacactgaaagagccatcaaaattaaatccatgccacatcagtctgatctggattactttagaggttagagctacattttcacaaccatatatttcatgatcgatcagatcgaccggtctagctaatgaacgcccatagctcacttaagtacctaacctggcttaatttgtagctttaattaattaacgtgcacttgcatgtactgtctgaatttaacaattaatgtggtaaatgatttcaattggcatgcaggcagctcgaatggtgtgtatgataataaaatgttgacaggaacagatactatagtgttaattaacccatgatcttgagcgtgaagttagtagcaaatcctggcttgtctctacaacctcttgcatctagctaacttggttcacacgtcaaaccaagtcgatagatccatgctcgattgacccttgacttgaaccaaattttattcagaaaagtagatgaaattacctgctagcgattgctacgtgccaaaatgacaattttagtatagtagcgacatttatattattatcgcaacctttctataaaattaaacgtaatctctccgttctttcattcgttaaaccctggtcaaagttggattatcgtcatgatacgttaagctaagtagatgaccataaccatttcattaaaacccaactaattgatattattgatctctccgatataagcaagtttaaaacgtttctaaactgtacgattacttgtttctttatttctagctagaaagttcgatggatcaactacctaatattgggatattcatggccactgtatattatattcagaggggattcaaacagatttagacctgtaattaggaaatgtttatatgagaattttacaccaacatgcagaaattcataagatatatgaatccaaataaggagacaagaagcgtacctaacaggatcttcatctctgtccctctaaaataaacagcatctcagaattcatgcttatcct

SEQ ID NO: 41238 - DNA, 3884 bp, Oryza sativa
  unsure (1)..(3884): unsure at all n locations
gatttaaaaggaattgcactacaataagctcttcaaataggccctaggaatgttagtaaaaagccggattaaccacttacttgcccccttactagtcatcacggtatcctgcaagccaacacgccgcactttgatagttcgacgcccgccagcaaagcccggtctctcagtcccaatcaaggaacacgttaaaaatgaagaccacctccagtagtccagcgtctggatagcatatactccaagttccacggtaatctcgcaccgaatttccacgcgaaacgataaaaatggcagattattttttgggggtttccaatgtcaaacaacacgtggctgatttaatccatctttggaaagggaatcgtatcgccaaacatgaaagcgtaaggggaagaaaaaacttacattttattattccagccagtttcagaggaagtggcaaccgagtttctagtgcccagcagctactgtatatccaatgtgggtaaatctcaaaacatatactccctgccagatgaaccgaaaaaaagcgccggcacacgcttctggaccacggtctcatcatgtacaaattacacatcatgtaataaacacatgtacactaagtctcgacaagaaattaccatgtgaaaaacgcaacaggaaaaagacccgcaaccatccacatctcatcccaaacctaccttctcccaattgggagggtaaaaggtcgtgtcctgtgaatcaaaaccaaatttacctcatgccctcatgtgccctgtgctgatcgaacagcatcattcattactggttcaccgatcaggcaatcaagaccatcttggaggcaaactccacttacccaatttgagcacgctgaacatatgctgtatattctagcctaacaagtccttgaatagaatagggttgttccctgtcggcgtcacaccaacttgccgggccgctgcgtccttctgcaaggcatcttgaaggctagggcccttctttgcagcgaccacatttaccccgagtgatggttctgtggatccactggtcactccagtttgtacatcatccgaaaagattgacataagatctggtgttttcgaagtgctcgaagctggggtttcagaaaccacaggagaggctgatgctggtccgagaagaccttctaactgtgtgaaaggatcagctaatggaggacttgatgaaactggctctcccagatccagaagatcaggtggtggggcagaagggattacttgctctttggctggctgcggtgttgcattagcagtagctactttctcagttgaggaactctcctttgctgtctttcgcccagcctgggtcttcctatcagctttaccaaagagtgaagcagccaaccgttgcttttccgctgaaacttcagtggcctgctgtctcttggaaccatatgtggattcccgagcctgtgaacttgttgaccctcccacctcagaactaacgcctccattggttgcttgttgactagatgttgaacttgaaggcgtagatgaggaggaataggctggtctcccccatttcttctgaactccatcaagacgaagtttgagaccaaattcaccagaaagagaatcgcctgatggctgggatcttgacatttggtgatcttccttatagtagcttggttctggaactggaaccaggtcagtagttggggaaatactggcctgtgaagctgctggaggtagctcataggcctcgaatctaagagcatgggcagatgtctcttgttgatcctgggccttgtagttgccaacacttaccactcctgagcgttcactctcaggaatgtagggtgcagcaccattttcaatggcttgctgcacataaccatttagaaacgagaggtttctgtcgatctgcaacataaatttagtatccgtgaaaaggttgcccttttactcttacgcttggttcaatttataacttttgctttaaagttgtgtgcttatgtagaaatagtgcaacatattaaaaatatatgtaagtgccagattgtttctgtgctgtcaccaggattttatgcatatgaggaagcagataaaatcaagttttcatgcattaggctcggttccaagaaagggatagcagtacctcaatatcttcgcagcttgcatcggctggcattacattctcaacagcctgtttgtccaaacctagcaaagcctgtagctcatatgcacgctgctgcaagtctgttgaatgcgaagctgacaattcatctatcaacgattggcactgcaaaggatcggagatgatttataaagatttacctacaaacaatagagtacacgaattctacaggaagagagttttgccacttcatggtaagcaatagtgttgatgttttctattctggacctcccaatcatgtggacagtattaatatcaaatatgtctctgtgctttccagtcatatggaacatgattgctttacatcatccagtggtgaatgatgttttaaaaatcagaagtaaaggtttgcttctttacaacattatatcaaataacgaaattattcacagaaaaaggctgtcacagaattatgaaacacagagataatatagggtagatggcaagttaaccatagtcttgagttttccgagatgactgttccaagtttgtattaggatatttgctcataaactttttttatagctagtggtgctcaaactgaacagcacgagatgactgttccaagtttgtattagcatatttgctcataaacttaaataactagcattatagatgtaaattccaacaaaggaaaatgcaccaaattcggcttgggtatgaaatgcatgtgataactgataaacatataatcctagggaggagcataatttacagttagtgcaagtatagctttcatgtaactttagtctcatgaaaaataattccctctttcggtgcacaactgcacatgtgaagctatatgtaataaacaatggtttggcttgaaagctaatgacaatttgacatgaaaaatgataagtgagacaatccaaacagtgaagattttcatttacctcgggtagcatatcgatcttccttccaagagcgatttcaaacgcaaagatcttcaaaattgcggagattgcataagccttgaataggaacaccgaataacaaacagcaggacatgtcaataaatcaattagatgtacaaaaaagattttctcaaggataaggaagtagaacattaatcagagaaaacaaaagatctatacagttgatcaaggtgggtccagattataacagtatataatatataattggatatatatattataggctactataattgattggactaatggatcaaactacccacaaaatggattactgggttacccaacaacaatgtaccctgagacatttcaaattacaagttctgattttcatggcaattgatcatagtaattgcgcaagaaaatgtcgagtaatgatcaacttggatctatattataatatttcaacacagagcatgcacagtagcaatgggccacatgtaataacagtggaacaaaagctaaactacaagagcataccctgacagtgtcatcagttgggtgggcctctgccacatcatacagcttcccaataatatatgaagctgaatatttcccatctgctgttccatattctcccaaaacccagcatattatctgaaagtagaatgaatcaacataatctaccacagaaaacatggtacggagtatgatataagaagaaaacaggaaattaaaatcacctgcagaaacgaagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41239 - DNA, 16361 bp, Oryza sativa
  unsure (1)..(16361): unsure at all n locations
taagctgagcatgtttttttgtgtggcaaacacttttccctctttcaccgtccatgccagcttcaaatgaaccagtgcaagcatcaacaacaagaatagctgcatcagcttgcgttgcgccagatatcatatttggtacaaaatctttatggcctggagagtcaagcaaaactacacggtacttcttagtctccaaataagccacggccacagtcattgtcacgcctctttctctttcttcactgctttcatccatagcccacgcataagcaaatgatccttttccctggtaaaaaataatttccataatacaaagaatatgaatggaacatcaggatcaagtagagtacaataacaacaataataaacttactttttctttagcctccttctcattcttgtgcatatcttttttcgatatccttcctaacagatgtagcagtctcccagagagtgttgacttgccagaatcaacatgacctacctaaacaaattgttcgtagacagtaacctatttagacaaagcacttttagaataacaaaattgttaaggaacatatgccatattcagaacagaagatgagtatagcatactattgcaaggtttagttggctcagcactcctgattcctcattagcgaacatccacttctcaggcttatattcttcaggtaaataaggttttgcagtatctacttcattcttttctaaacctagcttctgtatgtcagaagaaagtttctgggccacatcctcattctgcgcagaactgctagccctactactctggtcctccttcagctgaaaatgatcagaaatcaattgagctgtcctctcgacaggcacatcttcaggaagtgcaatgtgtttcacctttttcccagcgcctgatgagctaccagcagatgtgtactgcgtggaaccaactgttgaataataaaataatttaaattaaggtgacaataaaaaacacagctaacaggatttttttttcaacaggaaggcttatcaaccaacagatgatacaactggttgggaagatctgcaaatcgagtacaaataagtcacccttacaaaagtagcttggttcagtctttggagtgcatgacacgtgagctgtgggttgttgttgcccaacaggtgaaacatttttaagtggtatgcaagggaacaatctgttcagccacactaagtaacaatggtgcttgggaaagaaaaggatcaaaatctgcttcccgcacataagatgatctaatgtgcttcttttatatggtgaataatgaattatccttttcataactcaataaggtgttatagaaggagaagctagtttaaaggtagaacagagttgcatacacaaaattgtaaagcatctaccatttgcaccagcagtacctttctcatgagatatgctagcattctttatctcagggtcaccatcaaagtctgtagtacgagtattcactggcatcttggtacagtcagatttcggcatcgaaggtgtcccaaaatcacttggtatcccatggactgtaatttaatagttataagtacactatgattacattagaattccttgttggaatacaaattgtgattcaaagaaaattagaatgggtgaagcatgttaccttttattgaaccatccttggcagatttcataaaggattctcgaaaaaccccacacatctcacaatacaccatgctttcatgattatcgaacatgcacatggagcatctccaaagcacaggcaccgtacttgaggacttcttcgatgactctgcacaatagagtggtgacataatattagagatcaaggagctgtactaggcgcagttagcttgatatgctgaataaatcacaaaaaaaactcactgtacaacaacaaagtgaagcattcagtgcatggagcttatgaggaaagcaacggttaaatgtataggcatatgaattatttcaaaaggcctcaaatatatagaacaataatatgcatatgcaccaggattcagtaagcaaccagtaggtaaccctggtagttctaactggcagccagctatgtttcgattctcacccaatttgggtagatttgatttgcagtaagtttttattttgatggactaactggatgaatgatatttgactcattccaaaaaatgcatgttgaataacaatgccttcgagacaacaaatatctgaagtgcatatgatgggataaatgggcaaggaaattagagcaaggccaggtaatcggcagacataagctacacgatcactgcatttgtttgaacaagcaatgctattggaagttttagagtaattaagcataccgtgttcttatttgcatattcaggcaatagaggatgcgatagcaagtacgaatgcaggatggaaacaatgtaatgtcattaacaacatttaacaccactgagcaaattatgataaccgggtgaacgctccttgtaacctacaccgccgtaactaacctacacgagtagatatgttaagtgtgcatcatgaagcgactctaatagctatttcaccattcttacaagctgaggtgtacactgtctagtactagcttcaaaccttcgacataatacctttctcctccttcacggggtgctgaatgtcgtcactgtgcccggtctcaccgtaatcatcgtagtcctcatcatactcatcatagtcatcgtcgtactcgtcatcgtagtcaggcccagagacaaccttgcgtggcatcctgctgacacagcggcgtacctaatggggaacaaaaattagtgttattagtaaaactaaaaggttaataaaaaggcaaagagaaaacctagcttccagatctagaagagaagataaggttgaggcaaattcgagagaaaaagggtgtgggtagaacgggagggatggcaaagaaagaggatgtgcgtcggcacgggtgctcaccggaggcgggtgtaacatcccgagtatttagctatagtcttagtcatgctaatgacttggtcacactggctgagagcggtgttgattgagccacgatgctggctaggacctataaatatattgattgttgttttattctggatattaaatggtttctcgattgtttccttgtcatttatttatttagtcatatccatatgcatcattgatttattcttatttagactaaacctggtgaggagtgggataatttagttttggttaaactatagtgtagattagtcgtcacgaagcgaggtacacatatgcacagtagaaatcacagttctttatttacagtttaccactacaggtctgcatacatacatgcatataattgtacactagaaattttatacagtatgcattctatatattgtgcatatacatggtgattatagatatcatatcataaactgaaccatctcagtcaaagattcaataattatttatttttcagaaaaactcttgagttctagggcaattgcatatcagtccctaaattcgtagtagtcttaaattttactaaacttgtgggactcaagtgcaaaagcactaaacatgtcaggctttacaaaatttctattgatcgtaaatatagcttgagattatcacaccaaaccagctttgttgaggtggcagcaagcccttatccaaccggcatgcaagcaggtgagtcacaaaagaaaaaaattatcccatatatcaacccagctactagagaaccagtcttggttacatcggttggaaaccaatctcaagcagcagccatagtaaaatactcctcagtcgcaagaacaatcaaccacagaatcaagcagtagtagccagcaattcggctagagactcagctgaagacagagaaataatcataggtagcatatcaatagtaaacacctcagtcatgcaacaccacagccgtagcagcctagagtgagcagcagaggagactagggtgactcagagagagagagagatagttgctgttgtagttcattagtttagtacaaaacaatcagagcaaccatagcgaccatggccaggaaatcatatagacaaatcaaagtagatgagtaggagatgcttgagatccaggagaagcaagaatcttcaaatcaagaaagagaaaaggaaactgttgtaaattggattaggaggcaaaaccagcaaggaacaagaaaccaaataattcagtagcaggtcagggtttcaatcaagcaggaggtacctgagcttcaagaggagaggggtttcagctccaggaggaggagctgagttggtacatcaactgcaaggggagaagctagagttccaataggagaatccttgaaccggagtccagggggagtatctgtagaaaccagagaagagaaaatcatacaaccttcataattatactagagtcattaaccaggtaatctgcagattagaatagaactaaaatcatatcatggcatgattcttgtgtgatgcatatattagtatgcgtaggacttgggtgttgcatttgcatccattagaagatgaaccagagcatcttagattcagtaaaatattcatattaaatagtttgagcttcaaaacagaatgtgtaactaatatgatataaatattttcatctaaatgtcaagtagaagataaattctggctgagattaattatgtcatcatgtagctaatagaagaaatcagggttcagtacatgcatgggattattgatgctttattgatgcaagaacctggctttgatcataagaatctggatagtatagttatatatgtgtaactaaaattttactatagataaacaagtgttcaggtgataaatcaagaaacagtagaatgtatataaagatatcatcaatcttatgtctttatcaagtttactaactgcagatttttgtccatagtacaaatattgatttttttcgacatatagataaaatcagattttagatttagccatggacttggaaattagtatctgaaccctagcatagatttaagttatcatgaaggaggacaactatagcaattctgtcaattaggataattcaattgtagataaatcatttatcaattagtaagcagtaagaaatagtagcatcgcattatcagccaaattatgttaattagctgtagcaagaatcatcatgcgaatggagttcttaaaataagtaatattgaatctataggattaatatggttagcaggtgtacatgtatatttttagttttgaatgcaaatccataaaccgaaacctatgggcctctacagcaagtcacctagaagagaattatatcaaaatcagaaccgtaggagttggtaatataaccttgctatgatcaataccataaaacacaaaattacttatcagagcttttagtaatcagtatactttgtcatatagatcaatattcattgttcataggtcatttgatcacttttgtcatactaccatactgcatcatgcatgtaggaattaatattgaattcctgtattatgctctgaatagtagcataggggagctgatcctgctaacatattagcatatagcagatttcaatattttaatcaccattgaatacaagcatatataaggaccactcctgataatgtgatttctatttttaatcttatattgcaaaagcgtatgcttgtgtatgtgggtattttatccattcatagcatctaggcatcatttagccatagtaaaacaattagtcaagaagagccagcaagggcagtcatgagtatatcaccatcacgagagttatttaggaaaaattcacaaacatcacccatacaccataatccacagtatattaccacacacaccacacaggagagcacaaatatcatatcagaggagcagaagagagaggaagaatgagaggaagaattggacactggggtgttcaccaatggggatagggtgcagccaccagttgtgctgtgttttccaccggccatctccatgggggctgcagcagcaggaggcggatggctagggttagcaggagcaggctcgtgggagccaggggaaccgattcgcggcggcagcgggtactggagggttaccggagttggagtccggcgaccggagcgggggagcgcggcggcgttgatggcgcggcctgggagagagcgtgagggaggagaagagaacgaggaaaaaaaagagagagagagagagagaagaggaagaatcaagaaggtgggttaggtgggttgtgttttgttgggcttttgctaatgggctgtagatggtggaaactaagatagtgtttggcaaatgggaaagggaaatgattttccacccatctttaaatcctaaccatttattctccctctttcatttaatcctaacccttcatttatttctcaatcccaattctatcccccatttcctattatccaaacacactctaaagaaattaagaagtagagcttggataaaaaagaaattattatagaatatttaaattggtttaaactctttaaaataaattcttgaaaatcttgatatattattacagtcactggtctattcattttatcagattggtaatttaagtacatacaaatacaacttaactttgcatatcataatcctaatagaagtatctccttcaaaatatatcttatgaactactttattgatcaaagaaagtaaagatgtatatttctatataaatcaatataacttgtggctattaaatatatttttctcttgagaagcaaattttcttctaagtaaaataactaatcttccttaaaatgaaagtttaataaaagtaagtccataacctatatagatctagtatgtgcattcatgttaaatatatcatgtgcatcgcattcatataaatattcttgtatttagttgtgttttattgtttctttcagttgggcgtttatcttggatttctggaaatcttcgttggtttattcgttcttcaattttgggtatctcaggcaagtccaacacctttgatcaactcttgttatattttcgtaattgcaatctatatgtatcactttgcattaaattatattttctataattgaaataaatatgctgatggattggattgactggtggagcagtcagtcatattatagatgtattctgaacctgctatggtggtgggggttcagttgcatatatttatcatcataaggttaaataacaactgttatatggcattcaagcgccgtagcgatcgtgtcgaccatatgacctggaatgggacaggctggcttagtagttctttcttaatggctttatcctgcgggcttaaggactttcgcgaatcccatgagcgtgggctaccgatgagggttgccgttgttgcgggatccgatgattcgccgttgttccgggaatcacccgagagataattggcagatgggattgatgaaaagcttgtgaccttagccttgccgacatataccataaagtgtgcttaggcgctggcgtggtggcggtgtagcacgggtgttaaaaggtttaaggcttctatgggtacagcgacacacctctgcagagtgtatgaattgtgatatgtcactcccttttcgggtagaaactgcgaatgcggcaggaaaggaacctatcggaggttctaatacctatggtgccttatatgtagtagattttataattgcttaatatgagcttttactacactgtgtttatgaacatgcataaaacttccttgttggattatgggatttggagatatatgtattatgcaagtggattatgggcatatatttgttggattgctatagttggacttgttgagtaccaatcgttctcatcccctatatatatttgttggattgctacggctgttttgtacacctgggtgtacatactccctcctccttgttggatatccattagttggtaatgaatagttgggtttaaaaaataatgtttaattgttttcaaatttctgcatgcatgtcggttgtgttctatttgttttttcaaattttcatatgcatgcacaccggacggtgaggaatggcgacattcaaaattttatatatactttttgcttagttagtacaagtatatactcttttcactagtatatactatattttttcagtacatattttgttctgtttatagtagaatatactatttgttttcagtatatactgttctatcccagtatgtaatgcttttttaatccagtatatatatacacttaagtcgggcatatactacttttatagttagaagtagtataaacgcatatttaatttgttttaagcagtatatactttttaatgtagtagcagtatattatatatactaagacatgcccatcaggatcacatactgatactggctcactggcaaatgctcatagcgatgttatgcatagtggttcattagtctggtttcatttgtcacataccgtttcattcttccggcttcttggtttgcgtcatccggaaacatgttcatcaccagcatgtacggctgccgttgtgaattaatggagcaatcaaatatgttatctttgtgctgatagtttttaaagacggtatatactattttttatgttagtagcagtatatactgtttttaaactaaaaaaagtatgtactggccacatcagtatatactatttttttaaagtttgtaccagctagtgtatactgttttttagtttagtagctgtgcatactgtttttagtttaaaatcagtatatactatatatctagtaacagagtattaatacctaaaaatatgtactaccgagaggtgctattatcgactgagcttacagtcttacactagctagctcattgattggtaccttcactgtagaagctgtcagcaaaatagtatattgcaattttcagtgtgacgcaatgggtttgatctgccggagctctcgccggtccagaaaacaaattgcactgacgcagcggccgcgcaccactcggctgggaacgctgagggtgagggctgggaggatgagttgaatctacgacactgcatgcaacaaagaaattatatgcctaatcatacaaagggcctcgcatcaaacaaacgagaagtaatggatctaattaagcagacaaattaatcgaagtgattcagggaatcttttcggtctacaacaaaggacttgtattaccagcaccattgaagatttgatctggacgggagggactcagatcaactcagaagaagactatatatactacttgtctacctcctccatggatccgccgaggattagaaactgcagcactccattcgctgtcgacggggagaagtggagcacgtacgacctcaccagggaatctcgtcggagatgccaccacaaccgccgacgacgattggtacaggagggacgagagctagccgccgctcgtggcgacgttgaatggctgggagtagtacgctaggattagtcatttgatttaattacgtggacagtttgttgatccgaaaagaatgggataattaagaatcatgcatgttattgtttttaaaaacgaaaaatcaaagcgggtattctaggatgagacccggtagcatggatgatgcgaggggcctttgatgaacggtggatacaagcaggttggagtacagaatcattatatatatatatatatatatatatatatatatatatatatatataaaaggacactcatatagggcaccatggtgcctgggcactatggtatcaaatgcacaaaattgctaaattttttcaaattttttaaattgtgagtatatacctagttataataattcgattcatatctatacctatcaacaaaacaactcaaatttaactttatttcacaatccatgattacatacctaactaattatatatatggatgctatatacctagaattaaaatctaacaaaaacaagttcaaattcagttcaaacttgctttgaactagttagtaaagtagttaatgttaatacctaagtaattgaaaaagtttcatactcatttgaattggttatatactcaatttcaacaatggtgcccgggcaccattgntcaaattgagtatatacccaaatcaaatgagtatgaaatatttggatttttccggtcgtcacaccgatttttcgtccctccataaccccacgcgcacctcctctccaaatcccacatccaattccaatccaatccaaaaacaaaatcttaatctcaatccaaatacaaattggaatcatcacaaaatcctagagaaaacactactacaagatcacaagaacatatttcatcaacaacaacgacaacacaggaacatcacaagcacaaaaacaccgacgctggaaggggagggtgccgccgtcaccgccgtcgtcgtagggaccccgggccgctgctgcctcccctcccgctagatccggaggaggggagggcaccgtccctgcccgccaccgcaggagggggaacggctccgccgccggtgggggagggggagcctcccctcccgctggatccggcggaggggaagacgccgcacccgcccgccaccgtgggagggggagggggaacggccccgccgccagtgggggagggggagcggcgctgccgcggtggagggggagaggcgccgcctgttgggacgccgcgccaccgctgcctctcctcccactagatcctatagaggggagggcgccgcccctgcccgccgcctcccctcttgccgcttgccacagccagccaccgtgggagggggagggggagcagcgctaccgcggcggaggaggagagacgacggcgtcaccgtgggagggggaacacacatgaacctttgtcgccaccatgccatccgccgaagaaagagagagagagagagacgacgccgccgcctctcccgcccacgtcgggccgcagccgcctccatgccgccggatatggcggaggcgaggcccggcccaccgcctccacgccatccgggctgcagccgcctccatgccgccggatttggaggtggcgaggtccagtcggccgcctcccctcccgtccccaccaggccacagccgcctccacgccgccggatctggcggaggcgaggtccggccggccgcctccgtccctccttgtaacgccccgattttcgttcgggattaaaaatcaattaataatgcatttcctagaaattaaataaaaagttaatcaatttaatcaagtgaaattatagaggaaattaaaatttcctttaaaaatcattggccgggaatattttgtaatattctttgtgccctaatgtactctccggaattttccgtgaattttcggagctcgagaaatagtttcaatagcacaaagatcattgcatcaattaaaataaaaagaaaacaaataaaatcctccttcctctctttgggccatttttcggcccaaattcctccccctccttcctctcccgcggcccgcgcgcctcctccctctctcgggccggctcccttctcccttggcctgctcgcaaaagtctgttttgcgtccctccttctctcccttcgccgacaggtgggaccggcggtcccacccgtcagctcctcctcctacctctcgccggccaaccccaaccgccattgccgcccacgtcgccgcaaaatccggcgccctcccgcacccgagctcgcatccaaccacatggacacgaccccctccacgtcctccaccttttcccccactcaccccgcaagaaacggcgccggtttgacctccccacgagctccacttcacctccccacttcgccggccgattccgccgctccccggccctctcctcgccccttgagctataaaatcaatccccgtggcctcctcttcctttttcccccttttcctgagtccccacgccctctaccgagctctccacgccgatccccatcgccgccgctgctcctgccgtcgccgcgcctcaccacgtgtgccatcagcttcgccatcccgcgctgcacgccggcctccactcggtttccttcaaccgctatcggaaccacctccccaccgtgtaacctctctccgccgcttgccgccgaactccggccgcctctcctcgccacgctagccaccgccaagccgcgccaccgccacagtcggcttcgccgctccaagccgagcaccagccaccgcctcgttcctctaatccacaaccgagccgccctccccactaccaaccagagccaccgtcgccatttccgcctccggccgcgccgcaccgcctcttcagtccgccccgtgttgtgttgtcgccctccacggtaccgcagccatcatccgtggctcagcaatccctccgtgttcgccggtcgtcgccggactcatctccccgtgcctcccggtgagctccgtcgtcatttcggtcggcgtttcctgccgcaccgcaactccctaccctctcctaacctcttcatttccttccctaggtccctccgaccatcggccgccggttcctgctcacggaacgccgccgaaccgccgtcgtcgttgcctccccgaggagcgccgccgcctcttcccgccgccggcgacctcccgctctgcctcgtcggcccgcacgctcggtgagcccctcctcccgctccccttccctttcgcgtgcatcgccactgcccgtgagcgccgccgtcttccggctgctcgccgccgttcggcgccgccggctgctgcctccggaggccgcacgctgcccagcaccacggctcggccgagccggtttcatgccgtgcccgtgccccagccgcgccgcctcgtggccatccgatcggctttgggccgatccgggccgtcggttcccgtggaccggcggtggatcgcctcggtggtcccggtccacggtggaccggcgcccttgtgccgctgaccggtggggcccgcttgccggcgccgcccctcccctttgatgacgtcagcgaggtccatttcctttgtaaaaataaataataattgcgcaataattcgtgaataattatagaaattcatttaaatggctcaaaacttctaaaattcatatctaattcattcgaactccgaattgagccattcaacttgcaaaattcatctaaaaatgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacactccccttgagcatgttgatcccaatttataaattttttaccgtttacaaataaatatgcatgttttgctaattacatgggatccgggtattacctatctgctcgcttgtgccatgtttacttgatatctgttctttgtcaaccttgggtaataaatcgcctagcttgtgttactttgatgacctagctagtactatatgcttagccatgcttaattaccactagctcagttgatggggtaattacagttttagaccttttagtatcagaatgagctgcgtgctcgagacatctggccatgcttcatggtcgtaattatccaactaaaatgcgtctgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaattgactcaatacactgtagttcaggtgggttggttgggcctgttcaacgtggtgtagcgttgatcagtggagattcaatattactgtaattactcaacagttttactgtcttgctcaataaaatgttttacaactgcctttatgcaaatagcctcaaacccctccttgtatccccttgcacgtctgcaccgttggtgtggcttgctgagtacggtggttgtactcagccttgctatttttcccccttttcagaagtgtagtgcttctgagctgaagatggagttagaggaccaaggctcagaccccagttgagttttgcctgtggagtggagctgaagccccgctaggatagcctttttccgctgttgctgcttttgtttcggtgtgaggactaagtgcctcttccgtaagtattttacgctttatttacgtttggaactgtatattacttgtcgttttgtgtaccctggctggtcctggacagggatttaatacgtaaaatagtctgaaaatttgggttaaatttctaggccaggctcgccgttccgttggccattcgtgagctccgccgccaataccgccgtaatactgatctattcctactgctagcactggatctgaggctcatgatacagctgctcacttgatccatgagtgctaggtctagatcttgctgcttgagatggaatttgtgaaggggaaggagacaaagaaggggatcgagaggaaggaggcaggagacagaaggggatcggaagagggcggagaagacgagaaaaagagggaactttctggaccgagcctttggagagatcgacaggggaagagaaaaaataaaataactatagtgggggagagatatcaagaaaagaagcggcgaataaaagaggggaggaaaagagaaaattaaaaaatacacaaaacgagatgagacattagcgcatatttaattgagtattaactattttaaatttaaaaatgaattaatatgatttttaaatcaattttttatagaaaatctttaaaacaacataccgtttagtagtttgggaagcgtgcacgtggaaaacaagacaaacttgtccaaccactgtctaacttgctcattattttatttttaaatatcttaactacttaaaaaatacataattttccaattgttacacgaaaattttttgtccgtataatgattggcgccctccgtccctgcccatgccattgtcgcgcaaaggatgggaagaggcagccccccgccgatgaagagctggagccgcacgacggattccctgtcgcgcacgcgccacctcgccggactgccatcgccaccatcgctctactcgcttgctcggacgtgccggagagaaggggatcagggagaagagaagataatgggattagggacatgccggaacagctgcaatctaggacggccattctctctcccgcattgggtcgcctgtgctgctcgctaggacttctagcttggctgggccgccacgtcttcatgggctggcactatcggctgggccgctgtgcactagcacaagcgcttgtatgccgcacagtgccaggccggttcgagccttttaggccgaaatcagtttattttttaagcaactgatttaattaattttagaattacagaaacttatttgtcactattttaagacatttaaaattgttgggaaattatgatcaattatttggtcactcagtaaattatttttaaataaatgaaaccaatgaaaagatgatttttatttccttaagtgcatgtttctttgtcattgcggatgccttttaccttttttcctttgcagaggatggttaagtcagatctataactgcctcccctcccccgtttgtgaaaatttgtgaaagttggaatatgttttgaacgtgtagaaaatttgaaatatctcacgcatgaattataaagtttgagatacgacatgaatctgaatgtgtatacaatatgaaatatgttttgatatttccctgtataaaatttggagatatttgtgaggtatgtacaaattcaagatttttatgcagcaatcttaaccattcatatttagctgatattcacccagtgcaacgcacgggcatatttgcgcgcgcgtgtatatatatatatatatatatatatgtatatgtatatgtatatgtatatgtatatgtatatgtatatgtatatgtatatgtatatgtatatgtatatgtatatatgtatatgtatatgtatatatatatatgtatatgtatgtgtgtatatatatatatgtgcgcgc

SEQ ID NO: 41240 - DNA, 10524 bp, Oryza sativa
aaatccgcggccccgcagcgcgagaaacccttcaccgcagaaaccctagagctcaccctagggcgccgccgccgcagccatctccgccgccgctcgtcgggctctctccatctcccatccaggtaaacggcacaccccccttggatctctccctctcttaggttgccatttggtagagtttttcttgttgatggaatgatgacgggtgctggaaatgtgcttcgctaatgctagtgctgcgatctgtgatccttttgctgtgagataattggtcttgctgtcgttagtgttagcttctacgcgttggcagtaggttcttggatcgaatgcagcagcgggcgttgggtttacttgaaatgttctgtttttttaatgttacagtttcatgtgtgaatcatagaatatttgtttccgtattgatgaaatggacaaaagtatggttaggatctgaatatgtagttccacgtttacgggatgtgtacaaacttgtatatgttgcattctatctctcctgattggttgttacgctcatttacttgctttgtccttacatgctagtgttatatgttagattcattctgtcatatatatacatatatatatacatatatacatatatatatatacatatatatatatatatatatatatacatatatatatatatatatatatattattccttgtagtgttgagctaacaattaggtgaagagaagattcgacaaaattgatcaagtgttgcatttctctacatcaacttattgttgaaggtgatgaagatctagaagagcaaggtattgttagtgttactattttggtaaaaactaatttcttatggtttttatttaatgagtttcactacaattgtttctgctatgctactttagtgtgcccatttcttagtaagttggttcttactaaggaatgagccgtagaccggtattctatctcggaagtggaatacgtgggtcgctacagcgggaagggaaagcagctagagcgcacgacgacgacacccacatgctgcccgcggagtggatggagaacggcgaaggctagcaaagaagcgaggagacggaagttgaggccgacaaaaaacggggagatcgagttgggggagtcaggaggggaggagagagtatgcggcggcggcggcaaatttcgtagcggacgccggcaccacctgcgacgggagtacgagactaacactggaatcagaaaatatattattaagacattttgaaaaggagactagaaattcttaatttaatcagaagaaaattagagtttaagaaatatgatttaaaaaatttcaatacaattttcagaaattagagtttaaatacaattttcaaaggctcgagtagaaacacaatttagaaattactgaaattataaattttaaaaaataagtattgaaagaaaatccatctagaatacaacataatattaattaaatttcggatctgaaaaatatattaaaagaagagtccatctaaaacacaaacaagattaattaaatttagaaattaaaaataaaataaatcccaaaattagattccactacaatttctaaagagttcaagtagaaatacaaattataaattactgaaaaccagaataaaatatatagtatattggaataagagtccatctagaatacaaaataagattaattaaaattacaatttaaaaataacataaatccccaaagtggatttttatacgaattccaaagaattcaactaggaatacaatttagcaaactaaaatacgagaattaaaataagtaatattgaaagaatagtccatctaaaacccaacattatattaaataaattttcaaataaaataaaatgaattctaaaattggattttcaatacaaattccaaagaccccacgaagttaacccctcacttccccttttatactgagttcggttattcactttcccaactcatatctctcgtttgacgtggcacactttttaaactactaaacaatacgtcttttgtaaatattttctataaaaagttgctttaaaaatcatattaatcttttttaaataaattaactaataataaattaatcatgtgctaatatgttgctctgctttgagtgcacggagtgttagttatacaactacatattctcagaatttgggcgacaatctggactgtttggaggagatgaagatggaaaaagtatactttgactccttcaacaggtatatcgactcctccaactatcaaaaccggtgcaaacaatgtccctaggtggttttgaaggtggttttggctgacgtggcgcctacgtggtggttttgaccaattctttgtcctacgtggcgcttacatagcattagaataaaaacaaaattttgaaaatacatggaacccatatgtcattcacacaaaaaaaaaatatattgtgggacacacatatcatccttcctctccttcccttcttcctccccatctctctcctttatctctctctctccccccggcttttctcttcaccggaggagcggcggcggcggtttggcgcggcgccacggcggcggcctccaccggcgggacgcgtacaggtacggcggcttctaccaccgtggggagggattccatggcaacgagaagcagctggtggccgagatgcccgtcgagccggcaacggcgaccaccgtggtgctccccatcgcggagccagatccggactcgcgccacgatgccgccgtcgcggccgctgaggagccggtccatggcgaggccgatgaggaagacgaggatgagatggcgagtagccggacttcaccggagggatgtttgcgcagaccgttcacatgccgtccgatgtctgtctcctggaaaatcacaaagcaggaacttcaacttcatctcctctccttttgttgcaaggggaacagaacagcagtgacggtgaaagaagaacgggagtaaaaagcttttgttttcacctggagcgccttgtacgtgatgtccatgtctgccaggctctgcagcaagctcagcagctcgtcctccggctgtgaggaaagaaacgaaaaaacgtgcagctcgtgtcaaatttctgtggtttctttgaattcgtcggcgaggtggtgaaagaaaattaaaaaaaaaaacctcagttgctgcagccgccggcggcggcggcgtagagccgctccacgaaaccgtcgcgccgcgcgcgcagctcgtcggggcggtcgtgcgcggcacaggccagcgcggcatccacgagctcccacacgccgctgcctcctcctccaaatgccgccagcgcgcggggcagccactcgtcgtcccgatccatctcccccctcgcggcggcagcggcgagacccgacccatccgcgccggagtatatatcggatctttccaactcagcgccacacctcacaaaccccatcaaccaaccaagaatccgacaccaatcaagaacccaacctccccatcgccactgccgccgctcccgaccgccgccgctctggtgaagaggtcggggggagagagaggtaagggagagagaggggaggaagaagagaaggagagggaggatgatatgtgggtcccacaattttttaaattttgtttttattctaatgccatgtaagagctacgtaggcgtcacgtcagctaaaaccacctaaggatattgtttgcaccggttttgatagtttgagaagtcgatatacccggttttgtggttggaagatataaatcatactcggagatagttaagggaattaaagtatactttttccgatgaagattgatagaagctcctcaaacaggccgcgttgtagcaggctcatgcggtagttcagcccaatatggcccattaaataaaggttgcgttccacttggatcgctaacgttggcagggatatcttcctttttcgggggaagaaatggcatgtagatagacgattagaggtagagcgccaacgagctcttcacgtctcaactttccaagcccaattgggctaaaagccaatgcaatcaaatcacatgaatacaccatacaaatattacaattacaagaaatacaaattaaccgatacgcccgaactccggcggatgccggtggcccggcggcggctatcaggcaacggcagccagtgccggcggcgaagcggccctctcggcgacgacctgctcgtagaggtccctgatcttgagcccgacgatggtctggaagagccccgtgccgttgttgctcccggggaagtcggcgtgcttcagcatctgctgcgtcacctctccgtagtacttggtcgacaggttgctgaggtgactctccacgtagatcagctcgtccagcttgtcgaacttcccgtccatctccagcaccgaaacctgcagctcacaaaaccacatcaattttgcaatttctcctcacatctgctgaatcggtgatgggttgttgataattactacctcgtggccgaagtaggtgtccgggaagtacgagaatttgatgccagggtaggagcaggagagcttcctgccgcaggggatccagctgatggtcgatccttcgtcgaagaggtaggccggcgcgaagtgctcgacgccttccttcatgatcagcttcacgcgcagcaccttgccttcgtcgccgtcgtcgtccgcggcggcgatcagccgcgtcggcaggacctcgatcacggcatcggcgtactgcttctgcgggtctgcacagaagacgtacacaaaaatggatgccagtgttgaccttgttgagctcgatcttttgatttagtggtggattagtgtgtttttaccaatatacgcatcgaagtcgggcttccgggcttcaatgctggccttgatgctctccaggctgtgcccacgctctgccatgtctctctgcacaaatgggacgccgcaaaatgctagtactattcataagtaagagaactgaactctgtcactgttcccgagcaaatcgtgacacaaacagacctgaattttccatgcaaacttgatgtcgctgctgatgtccaggtagatgctgaagtccagcaggcccctgacacgctcatcatacctggagtaacgcaaacacaacacacgttaatgtgcattgcccggcatatagtatagtagaagttgtagatcaacatgagaagaaaaattgcaaaaattaatcacattgggtgcaggccctcgacgacgaggatcttggggggagtgatgagctctggcgggtcgaggaggcccgtggcgtggttgtagatgggcttcgcgacggcgcggccctccttgatggccttcagctgccggtacatgaggtcgaagtcgttggcgcgcgggtccagcgccgtcacgcccctctccttccgccccgcgcggtccagcgagtggtagtcgtcgaggcagatcaccgtggcggcgtcgccgaggagcgtgttggagcccgggttgccgccccacggaggcgccgccgccgccgcggtgccggcgccgagcacgctcgtcaggcgacgcacgaacgtggtcttcccgcacccggagtcggcagccagcccgatcaccaccgtcccgcccgccgccgccgccgccgccgcggagcacgacacgcggaacgggaacgccgccgccctcattgtcctcctccacctcccgcttctcagcaggatggtcgtcgtgctcgccgagctgaacgacctggccgccattgatcagggcgttgcgaagctaggtccaagagagtgagaccaaggagtagggagagcttgcagtgtggtgtccgttcttgcttgatgagttgcttcctctgttagctcgctgtcagctcagcctcagctcagcgacgaaatatcgatcaaatgagttgagctagatgtactgcaggatgcttagctagcttgagatgattgagactggattttcatgggctttctttgtcctgcatacctccatgccgatatctagctagagacgcgcgcagcagggccggccggccggcggaagaagagaaatcttggtggtggactggtggttttcgcggggttgcagattatggtggtcctacgtggtggcggcatgagggtggccggctgaaaacggagggcgccaacgtatgtgtttgtttggtgtatttggcgaattgcattatgattccattggtgaaaatggtgattctcttgaaacacactcggttaaccatacaaagatactgagtactactgattctactcttcctcttttaacgcaccacacgtgagttgtaggatttgccacgagcgcattgctcaattgtttatccgttgatttgagcttgctttaactgcctaaactaactgatagccgcaatcacgcgcgatgttacttgtcactgatgaccaaggctagccatcctagaacagactctgtcaaagaaggtacaaacatgggtttccaccgaggagctggctgaaatggactgcagaagcggacgcgtcgagtattggagcaacacagaagatggcccatagtttgtcaagttgctgtgaacgccaaaacgaccgcccaaactgacccacaggggtgctttggtttccattcaaagttcagggcgctggttctagagaagatccctgccacgctgcatgattgcatgcaccgccgcttctctgccttattgtcaaagagtaacagcaaccgtaccatgcgatcagcaagcataccggactgcggtagcatctttaacagcaggggaaaaaaatcaggtagatagaaattccaggtaggcatcacatacaattgtgcagataaaactggaaacttgcaacgaattgtgccagatgaatctgctttgagttagatggatagtaaaaatcgggaagcacagcatcaagccaacaatccgcaagggtgcatatatatgatccaggtctgaatgcaattttgtgtctattttcccgagcgagaatagccttagctcatttaacggtaaccaacaggcaaaccggcgatctacccaatcacatacggactacagtttgccaagaatcaaaacacctcgttccagacacaaagctatgataacgatgctaacaacctaccccataacaagcttgaaaaggtttcacaataaactgacatgaagagacattctcagggtgtactgatttgtatgcacagaagcgatgcatgaagaggtgtgctactggtgatcaccggaaactttccatcatgatgaatagcttcacttgttccctctgaagtacatgtacactctctgcatccaccgatagagaagtaataaaaaatattaaatgtacacattttgtaccctttaaaaaacaaacaaatcaagtaatgatcataaccatggacaagctgggtattcgatgacttgcaggaaccaaaaaaaaaagcaatcttcaattaacattgagtataaacttggacactaactaataggtaatgaaaattgggcagtacaatggaattgtagtaccaagaaattaggaaaattacttccccttgacatttattttagtgaactatgaattgtattcacgaggtttactagctctgaaattaaactaagaaagggtgcagagcaatgtgaaagcagaagtacttaacttttagtttacatagcgaattactacaatagtttccatttttttgaaactgtggctctaatctcaatgcataataatctacagaaggaatacggaccacttcctcatgcattcagtatcctgacaacaaattactactttattagttactactatgcagatatctataatatggaaagagaagtaacaagtttaatgctttaagcagaccagaggttaagaaatatgtggtgcatttaatacatgcatagagcattcataagttaatatctgccttacattcatttcatgtgtgcaccctgatttaccctaaaataacgtaggcttctcttgtgctaagctaactagtgctaaaacacatatatataaggacagagaaggcgacagatccctcgaagagttatggatagaattgatagctcatttgacagaggggatatcagtttatgagaacacgattttgttccagacctgaagaactccaatgctcagcagtgtctccaagcaaaacagcgcgaaccccacaaagtaaaagatctgcaagaaaagaaaaacatcagtacttaatttcctactagttggcaccttaaggttaattcaaagtgctggacacacaacatattgcagaaaagctatccagcttgcttatttatcaggaggatttgaaatggaatgaggcaattcaactcaccccaattatcacatgctcagaaaaggtgtctatggcagccagtatgcccctgataagcaaaagagaaataaacatgtaatattaatatctcagaaacaagaacatgcaaaaaatactaccaagaatgagctctagaatttcataattcatcagtcaatatttaaataccaaataactgcatattaataagcaaacacttgatataacttacgttaatgattttccatgaaacacaattggcggggcaatggcagcaataatgcaaaagccaatgtggatctgtgccaaatatcaatgaaaagaagatgatatgatccatttgataagcagtagttgtaatgtcaagaaaacataaaaaaacagttttcagctataacttaccaagtaacagagaaagaaccatccaaaactgaacgcactgttagtcctgtttaacaagtaaaagaaagtgtcagatacaataataaagccatggttccagaactatacagcacaaaccatagttcaggtccactgaaatgttttatactagctccacaaaggagcagtgcaggtctgcataaacttttgtgcaaaagagatgcattctctgtaaaatgcactgatggaaataagcaagataactgaaatgcgctaactaaaatataacacctgtagcaagatgcgctaacaaaaataatactctttgaaagacacattaacagaaagagtggtaaagcagaaaaatatacctcatagcacggtagagaggcctataccatatcaagtacgagaggggaattccaagcaaggcatagatagtggcaaggaaaaacagcttcgaatctacaagcataagacaacaaccattaagcatgagccaatgtacaaaaacactttggcatttatagaaacccatgcaacccacctccctccttgatccaacagactatgacagcgatgaagttccatgagaggcaaagcacgatacctgtagattaaaataacacagacaggacatactgagaaaaatcaaagctgcctttgaagcgcaccgtagctaccaccacaattgattaatccagagactcagctagataagcaaacaatgtagtactaccaaacaattgatgtagcaaattgcaataacaatgtccaatctacacctaccaagccagcttgcgaacgcgagatactgcaatttctgcaaattagccggtatctcattggcaatgtcatggtgaatgatcgggaagaatggtggccagttcttatcctccattggcactccagctgcatcaaaaaggaaaaaaaataatgcgaaaatgagcgcactcctcttaacacaactggcaattgaattatcactgagtccaccatcagtcaaacaagagcataccattcctcagcgcttcctccctccttttgatatcctgcagccacaacaaaaccacaatgatacactaccgaatcaaccagcatttcaaaagtttacaagtggaatggagagcaaaaacccaccgcctcccgccgcttcagatctgtttcccacgatgagagctcccttgccttgctcttggagtcctgtgcagcgtacacgcccccaaaaccctcagattcgcgtacgagaacaacaggagaaaggaggggggaaaaaagagggagcactatcacgtaaagcatcttacgcccatggtgtcgagcgggacatcgacggtggcgtcccccctgccggcgccgaagccggcgggctccgtggggcggaacccgtactgctgcctgctgccgccgccgccaccaccacctcccccattctgcagcgccacagccacacctcatcagaaaaacagcacgcgaaaaaaatcccagatctaccaccactccacgatccacgaacacacagtaaccagacaaaaaatcaccccaaaaaaaaacgaagcgtgcgaggagaggagtgtcggctcacggagaaggggttgtcgtcggcgttgccctcgtcgaacgggttggggtcgtgatgcatgccgccgccgccgccggtgacgcgccgctccttcctagggcttggctccgcctcgccgccgcgcgtggaggaggaggaggaggagaacggcgggtaaagcggcgagtggtgcagcgcgtggcttggcttggactcgagtcgcttccggttcaagcggttcactcgcttttgcgccgctttttctcacgtgacgtgactgaattgggggggggggggggggggggg

SEQ ID NO: 41241 - DNA, 24797 bp, Oryza sativa
agggggttcggtccccgctccaacacgcttcgtcgcggcgcgcgccccgtgaaggaaagcccacggcccatcatccagccagcccaatatgccaaagccgaaacggcccactttacttggaattaggccgaatttaggcctaatactagtacatttgtttttgcttgtaatttgggccttctacctggactcagtttgacttcttcaccgagagtcaaagttttttccgcgtgagaggagtcatcggagctcacttcgagaagatgacatgagatttggggagttatttaaaaaaggacctgaaattagggggagatggatctatccgtccatgaaatcaaacaaacccaaatgcctctcaatgcaagcaaaggcccccttctactatcttgttttctaacccagtcacatttaatttagcccatgtgcgagcttccatcacatgccccccgcacgtctccccaagcttatcacaaggcgcccggacttgaaactcttcactaggagctgtgtgttttgtgttgcttacgttaatcacgtacacgtaaacacgctagctaagatggacaggaaaaggttggagctgagctaatggctactcggctagtacacccattccctctatctccgtagttttacgcaaaatatttgttcctaaataagtgtagttttaggctgaatttaaatcagatgtaagaccgcagttgttggcggctcgaaaaatggggtgaatcgttagttaagtgtagttttaggctgaatttaaatcaaatgtaagaccgcagttgttggcagctcgaaaaatggagtgaatcgttagtaaatgatggatcgaatatcaattactataaaactgaaatattgatttatttgatttttttttcaaagaaatagaaatttttacacaaagcgcaccgtttattaggttccagaattgtgctaacatataacaaccgagttgcccaaacgaacggcgaacgggtccttagattggtccattagatctctttaatacgacttcattgttttctttttgtttttaaccatcaaacaagtagtactctgatctcctcctcctccaatccttgttttctctcggcattaataaaaggcaaagtaatattttaacattctgattaatttgtgtttgattagttaaattttatgaatagagggagtatatgttccatgagtatgctgatcaagtggtgatctttgtttagcttgtgccattaattagattaattaatagttatccatccatcatccatgtgcatgatacttcctcaatccataataactgtatttataggattcaaatttatcttaaaatatatagttattataataaaatactaattatcccatcaatcacttctcaattaaatttctatctttttttcgcggggaaaaacaggaactttattacttagccatagctgtccgcagacataagttcggaaataaagttacaacttccgtccggccaaaagtccgtaagggactcacaccgaccttttattagctaaaacatggctgatgcgattgcagttcctgttcaccttcttcagcttcatctccctggcccccttcaccatgccttggatctccctgactaaaaacgtatgtgccgatcgcagcttcccttcagaaagaatcatctgtatcgcctccgcacagtcagattcaatgataatcggtagaagggtccattggagagccagtctgataccttccttgcaagccaaaatttctgcttccagcgcactctggctctgctcaacaaagccatagactgcaaatattacatctccagtgctgttccgcaagatagcaccgatgccccctgtgttattctcctgataggagccatcaacattcagcttcatccatccactcggaggtttctctcattttgccaagacagattgcttcttgcacttgggcctgtcttctccaattacatgcatcccagatcccaagtttgcattagggatgtcatctctcgggttttctggcctttggatggtgaaataatcaaatcaataaggctctccagtcggcaggatgaggattttatcgcttggcatcctgataaaatgggccagttttcggttagaagtgcttatatgttagcggttcagctcgcaaatgctggggagagctctagctcctcaggaaatgatactaagaaagcgtggaaccatgtttggaagtgtaatatcccccaaaaggtcaaagtgttctcatggagagctatctcaaactgtcttcccactatggtgaataaaaagaaacgaaacctggaattgtcggacatctgcagtatctgcggcctagagcctgaagatgtggcccatgctttgtggcgttgcccgcatgccaggcgataccgggacctaatgagctccgagatgcaagtacagcgtatcctgcacgggtctggggaggggtctggttggatccttgatcttttggaatcaatttcagaggatgatcgccctgtctttcttatgtcattgtggcgaatctggtatacacgcaatgagattactcacgataaagcggcgccatatgtggaagtttctaaacgcttcgttctgagttatgtaaactctctgatggaaataaaaatttctatctattttaatcttagccactctcccactcttacatgtacaccattaatgaggagcaacatattttttttcttctcaaatcttaatatatgctaaacaatttagagttataattattacgagacggaggtagtggctgatattgaggtgtgtgtggggtgggggggattatatataattcttgttaatttcagtagggggtatggtttatgcatggtcaatttggagacacatgctttcctgcctcttagcggggagccctagctagcaaaggtaggtgctaatcgagatccaaagttacttctagaacagtatagcaactggctatggtactatgcttctataggacgcctttgggcatggatcaagtattcaaattagaggtgcctagcttgactgtaaccatccacacatgacacacagttacatgcatatggtggcagcacaaatatgggatccaatgtactttgaaattactggatcaaattcaactatcatgcaaatatatatttttgtaggagtgtagatgatggctggcctatagtagcatttgcatcaagctatagtcatacatgtagagggtgtttagatatagggtataaagttttagcgtatcacatcggatattatataaggtgtcacatagagtgctcgggcacaaataaaaaaactaattacagaatccgtcaataaaccacgagacaaatttattaagcctaattaatccgtcattagcaaatgcttactgtagcaccacattattaaatcatggagcaattagacttaaaagtttcgtttcacaaaatactcataatctgtgcaattagttattttttagcccatatataatactacatgcaggtgtacaaacattcgatatgacagggtaaaaaattttatggtgtgatctaaacaagaccgtagatgtgtcactaattaagtttaatacacctagctataggccatagcagagtactagctagctagctcaacttaatttgaaacattttgaccacaaagttgcgagctaggttgatgatcaattatttcaatagtagacttccatacaaagatgacgtaacaagagtattccactatatattctgatctgatacctcgagtttaactattcccatttgcgtggagtggcaaaatatgcaacttactactccctccttccgtaaatgtttaatgccgttgacttttttaaacatgtttgaccgttcgtcttatttaaaaacttttgtgaaatgtgtaaaactatatatatacataaaagtatatttaacaataaatcaaatgataggaaaagaattaataattacttaaattttttgaataagacgaacggtcaaacatttttaaaaaaatcaacggcgtcaaacattttggatggagggagtcctttttaccatccgatcattctaccctaaaccaaatatttgcgaatacgcaaaaagattacacatcaatatattaaaagaaataagagtttttattacataatgcaactggtcagacggccattgcctggggacaggggggcaaaaagaaagaaacaaaaagattgctaaagtaaagaaaaatactacagaaaaaacgatacttctagggagggtggtggcagaaccccactacactactaacaagcccacaaaagcaacggctccagcagatgaccacagacggccttactgtaggatagacttcagaatcactgagactaacgagagagagtaatcgaaaatcctagagtttcactcctttcacaatgtaacgctccacctttcacgagacgttaaaaactaattcggcaaaatcctaattgcgaaaattttcgtcatttgtgtgcgagtctaagttgtgccaagtatctcaattcaattctgtccttgtctccctctcatcaacataaattgccaccccgaaatttccaattccaattcaagctcccaaaatcaaatttcgacattcaatctattcccttgaatccctccctatctatcaaccgatctatctacctacctaccaatcaatccatctatcgatctaatcacctatctaccatcgaactccttcccaaacaattgtcccaactccgaaaatatgtggtttccttcgaatccctctcaaataatcccttgaatcgccaaatacaaatctatcccgaaaatatcaatttctcaccttgatctcccttccttgctccttcatatttagctgagttcaaacatgcaatttgaattcgaatttcaattcaaatccaagccccaaacctctccaactcaaattctctgtataagtctatttcgcctccccatgttttggatgggccggatttcctcccctcggcccaccttccttgccgctcctcccctcgcgtgctcgcgcgtgcgccatggccgagagagagagagagagagagagagctctctctgttccttctattctctctctctttgttatctctgtttctctctctctcgtcgagctcccccaccggcgccgatttcccgccgacgccgttcgaaatttggccgtgccagctgctccacgcgcgcgcgccgtggtggccgaccgcctggtcgccgctgccgtcagcgcctgcaccacccatgccctgtcgccgcccgaccccgctgctctgtgcgctcgcgtccaaagacgcggaggcagcgcctttttttcccacgcgctccatcctccctctcctcgtccaaaatcgacaaggagctgagctcctttcccctccccctttttttgcttttccccctctcagctggcgtcacatcctctgcctcccgtgaccgtctgtcgccacttgaccgcgaggccgccagccgagctccccttgactgccctcgttggttccttcccctcgaagccccatctccacctataaaacccgcactcccctccctcgttcggctcctagcctctccaccatcgcaccgtttctcaggccaagaacgctcgcccaacgccgcggcctcctccgtcgctggtgttcccttcctcgccgccttgcgtcgccgctcggccaacgcggtgctacccgccgcgaacaccatcctccagacccggcgccgccctccccgaagcccggccgttttccttcgctggcttcccgtttgcttgtcaccgacgccgttcatcgccatcggtgagctcttcacctaatcctcctcgttgtcaccctcctggatcactgtagaacactcccgaaccgtcgctttgatcgccggacccctctccctccccggcggcgttccgcccttccccgcaccgcgcctcgccgtcgccggcctctctcagagtctctccgccccatccgaccctgggaacaagttcccagagtcctagagatgctcccgccaccacgaattgaccccattctctcccggcgtgttttcccccttttgctcaccgccggtggccgccgtcgaaatccgccgcctccgtccagtcccggccacatccgagtcgaggaatggagtctacgtctcctttttcctccctccggtggtctcccttcctcccgcctcgcctcgcggccgctccgccgacgcgcgccgccgcccgccatccatctcccggtcggtctcgtcttcctcctctcgccggcccgcgtggctgccacgtaggcgccacgtcggtgccaactcggctagaccgagtcaaaccggccagcctggctagcccctccgtgcgcacggaccacggtgcgccatgcggctgcacgtgggcccgtcgcgcctcggtccacccggcgcaccaatcgtgagccgcatccacccgaaaccctaaacggcgcccgcgtgctcccatccctccgtgaaccgtgtcgccgacatgtgggccccacccgggacctcgcatggtgggttcggtccacccggaccgccccctctcccttccgcgcgcccctaatgggccgcctccttgcgcccgcgccggcccaatggctcggccgagcctccttcaacccattgggccgcgcctcacgctcggcctaaaagtccatatttcctccctcagtccaagtcagtgtccatctctcatgagctaaaagtccatatctgctccctcccaatttactcctctctcaccttttgtaggccccacatgtcaatgagtaattaaagaatattcttgggaatattcttttccacgaattcaataaaccatctctcatattcccgaaaaattcgatgaatcatttccttgtccagaaaattcagataaacttccaatattcatatctctcgatccgtagctccgatcgactccgttccacttccagtatttctataaaattgagatctatttaatggcactattaattagtctaaataggatccttcttttggtcttttgtttaggttttcgattgtttgcgtatagttgcggttgcggattttcgtcgatcgtggttatctcgaagattcgtgaagctccgtgaaggccttgagcaaggcaagtcaccctttgaccaattgctcctataattggaaaatcattattaatttgtttgcaaatcgcattattagcaacacacatttataacatgcttggcctcagtttgcgtgccaaactgacggacctacccaatagtcgcactaattcctgtaggctgtactaccctgattccttgtcgctccacctttgtggtacttcggtatctatgctctctgagcgcgtataagaactattccacatacaccgttgtttgtcgaaattttgggaaatgggtttgagaagccttgaaaacccaacatgtggtgtcggtgtgtttgaaaataaaatgaattgtgaaaactcgcgatgcgggtgttgtgcctgggtggcgccgtcccgtattcgcatataaggaccgattcctgtgggaaattcatcaagcataacaagtgcaaccacatggtggtatgggacaccctggctaagtaattagctgattttgggaaatcttgtataccaatagaggtggaaagccgggatgtgggggtagaggcatcctgggagctcgaaacagaggaagacacccgagagtcctaaaaggaaagttggggttggcccgatgttggtcagggagaccctctatgtggcatgaggtaacccagagttagatttggaaatgccttgtcgtgaatctcccttttccagcggtgcgtcatgaacacgggttaggtgatgagagcaagttcgcgttgtgtgggtaaagtgtacccctctgcagaggttaacaaattgttcgaacagccgtgcccacggtcatgggcggatgtgaggtgtttcccgttgcgtagatttgtttgcctgtgctttgtgaaaagttgttgtggaatgggaatcgtcaccagaattagcctatgtggtagatggatgacctgagtggtcagaaacgaatctgtgtgattcgggatgtctgcgggcatcatagactaggcttcccgagtggaagcagattgttgtgctgctgggcagctggactctaggagtccgagaaaatgaaaaaggctctgggagccgattaatcaagtgaaagggctctgggagccgagaagtaatgatctgacccgggtggtcagtacattaccatttgagttgttgaaaagcatctcttaaagttgaatcgagacgcaagtctcatttcgacccaaaacctgaaaagaaataatcacttagtgattccaaaatgatttcaaacaaaatatttgcaaaacaacctcgcctctcttccaagcttgcattaaacacctaaattcccgtgacttgctgagtacgaaagtactcacccttgctctatataaatatatatagtttctctgccttgaagtgaagatgaagtgaagtgaagattagggtttcgtcctggttcccagccatcgcctgtggtgttgtgtgttagaccgttggttccgctgctgctgctgttgttggtgttttctcgtccgcgtcgtcggttgcattctcaggctgttctgagttgcaacctaagttaaggtaaataagtcctttatttattttaaggattgcaatgactcatatttgtctccgtgggtaccagcgctatgtcctaggactggtactgagatcgcggtttcgtaggaagcggtttgcgccgttctccctacgacacgctcctgtcaggtgccgttgtacggcggtaccagattggggtgtgacacacagttgcaaataaaccagtagaactagggagtcgaaacccataaaaagtgcttaggcaggcatgccttataagtcggccactagataaacttgaagcgagcacgccatcagatctgaagcgagcagccaccggaagaaccgaggtcagacaacaaatggtgctagacctgatgagcgaatgcacaataaagaatgatgtggatcgtcgtttcaaattctcgagtgtaaaaggacaggccgagtggttatcaataattaattagtgtaaccctaaaccaaatgaaatgatcgaaattgtttcaggccattttaattaattagtgtaaccctttggacaccatttgaattcgtgtgcagaaaacgccaccaactttctcaaactcagcgataaaaaaaattaacaaatcgctcgtaaattctcgatcgatgcgtgcgtacgtgcatctattctgcacagctagctagctgcagggcaggctgcaagccggcacataaggcgctgcaacgcaaatcaaatcgatagacacgatgctctcactacccctacaaacatagcacgactccccatatgtgtgtaagtaagtgtagatgcatactacgtactgtgtagatccatactgtatatgtataagctaccacatcggtcttaaaatgtatatgcagctatttctagcatcttgatcttaaaataaagctatttcttcacttacaatttactcttaaccaatcaacattattctccatttaatttatttatctaatttctcttctcaaataatttttttttctccaatcatatataatatactttttaatatccgtgcttaccgataaaatacctatattttagaatggaggcagtagcacatgcagttaaaccacacttttcagcatcagccacacgtacgatcgatcaagcttatacatggcgccgaagatcgtgtacgtacacacgtacgaaaattaatgccagttgagtagtatatggttgtgaacaattttgattaccaccacttgcttaggtttgaattccccctaatagcctagcaagctagtgtggggaagaaccccttgtgttagagtaaacaagctagctgagagctattcttgttcatttttccaactaggattttggtctaaataacctctgcttggacaagctagcaatagtatcaccaaaagggatcaagatatattattttgctctccaacagtttgtaattcaagatttaccgcataattacacacgtgtcaactacgacatgtggggttgatctatgacatgaagtggcaaatcctttatgccaccttgaggacgggcgcaacaattaattctattttttccttaattatattctagaatgatatacaaagcttggcttgtcatatatttcctacatgcatgcatatggtggatccgaattgaaaatgacgagatgtgccaccgcatattcgagagaatatattggagcactcgatattaggttgaggggtgctggcaattgcaaaggacgcatctcatctcttttctacaatgaaataagataaatggcactgatatatatgccagtgtctcttataaaagacaagaatccgtaattttcttgacggtcaaaaactatcaagtagcatcaaaaccgtcaaggttcattattctgttggctgaccgtcaagtctataaagccaaggatattcaggtttcttggctgctaaccgtaagggaatgttttcttagcggtcggacagccaccgccaagaaaattaagaagattgcgaactttcgaaagcaccaagaaatgtaaccttgtcggtctgaaccgacaagaatatatctttccttagctgccaagaaaccgctaaggaaactacttattcttgacagttagaatcgccaaggaaatcagttggctgccaaaaaattacggattcttgttgtgtatgtaattgatgctgctgatcgatccatcacttatcccacaaaaatagtggaggtaataagaaatggttcctcgacacacagtatatattaattaacatatattgatgaaaagcacaaattaaataattccttgcaggtgaaatgacaacaataactaacacgtctttaagaaaaggaagaggcgataaagtctaaattcagtattacaagaaacctaggggtgagtgagcacatatataggttcgacattagtggtttctagatgaacaaggctacaattttcacgccgtacaccatgcatgaaatatttgcatcctggtgctggtggtccatgtgatgccttgcgaattaataacctctataattctaattctcatagtacaatctctccccctctaaatttttttctttataaataaaacaatgccatttgcagaattgtacatgcatatttctgtacgaactaatcatctacgagtgccaaagagtagctagtgatagagatgagatgcccttctctctgctgtgacatggttgcactagaatatatggctggttgtcacatggcaggatgcttctcattccctctttggcccatctcctcctatacatgcgcaggcatgatgcatgcatacggttgcaagcacaaccaagatcagagaatcccagcagtagtacatgcatgcatacttgcgacgtcatatgataatgtgatatatattatactccacttggtgctagctaggttgaattgagatcgatcgatcgatcagagatggggacgataaaaactgatagagctaagctagggcctggatgcagagagagatgcagccatggccttctgttttgttttgttctcaagtgagatactactgctactactacgacgatatattgatcagatcgatgtgatggcgctggaatttttttaaggtgatcggcacaggcgtgaacgtgggagttgggcatggaattaatggcgccggccgtgcgtgagctggacaaaatccaaaatcatatgatccatgatgtgaaggttggtggcctggctatagctctccctcccttttgtaacgaactttgaaagaggcatcggttactgggaatactagaatatgggattggggatcgatcgagtgatgaatgctgcttgcattaattaattaattaattggcacccggcagacaggatgctttgctaattttcctttttaagttattactccattcattttcaaacaagtttgtttttagcttcaaccatttgtaaaaaaaaacatttctatctcctgcataccctcaatctgtaaattgataagctttatttctctaatacccttaccaagtctcacctaccgacctaattaacaatactatatattttcatattgatatgatcgatttagtctcttccgcttcatcttattttgagcatcccagggaaaagatgaagttattttgaaccaggaaagtataattatttggcgtcataatttagtatggtggagatatgtaaacttctaaagagcttttacgctcctgctggagatatacgatgtttcaacgctgaaaaatgcggtgactcctatcaagtatcataaaattgctcaaactaataagagagaatccattatatgccactgactttgtcacacctctacgatttaccactggctttgtcatgttctataatatgctatcaacttttgcttaacttctacgatttaccatcaccgtccgattagcctctgttagcactgtacaattttgtccaaatgaccaaaatactcctaggacaaaaacttgaaaaaattggataaaattaacaaaatatcatattataaatataagattgtaaacatccaaaatttggccaaaaatttaaaatctgatattttagaatttgtatccgaattttgaaagtttttgtctcaggggtattttggtcatttcgacaaatttgtatagtactaacggagactaaccggacagcgatggtaaatcgtaaaagttaaacaaaagtcgatgcatattgtagaacgtgacaaagtcagtggcaaatcgtggacgtgtgacaaagtcagtggcatataatggattctctcaactaataactctaagaaagtatagctaatcaaaaagaaagatgagagcaatgaaaatacaattacctaatgggctaatcatttgagtaaccatgaatcatgcatcatgcatttttcctccccccccccccccaaaaaaaaggcgaaccacccgttgtttttccactgttactctcatattttgttattgcaaatgcacaattgttggttcgccttctaaagaaaaaaacttctagagataaacttgacaaatactttttcaaaatcatctctacattattttttttacggagggtgtagtttcatacggaaaaagaaatcttatcaatattggaaaaaaaaaggtgaaccaacaattgtcatttgcaataacgtatggaaaaattgataaatatagtatgacaaatgttttttcttggcaaaaccctgataattcacagcacaattatactcctgcgaaaacaaattaaagggcgtgaatagaaaattggtatatacggaaaaattggtgtaaggtgtgtgatcaacaattagtaaggccaaaaacaagtattttggaatctcatcaacaaaaacaatgaatctccatatcaggacaagccatacctttgccatagtctgaagggaccaagaccgattactttatcccaacgtcacgaagatcgatctaaagtattactaaagcttgttaataaagttatatgactatgcttaatttcaggaacctctaaacaaagacaacggcatgcatgagcttgcagctagctagcattctgtcaggctggaacaagtgaaaggtaggtgttatcttgtctttattttaagtacaaactaaactctgtgtttatcatgtatgtgtatatatgtctttcaactcccagctcccttgtatgttagtagtagctagtccagaacaggaggaatataattaataggaagtaattctatatatcttaggagtactatagagtgaaaactcactaaattctaaaactcaacatgcaaagatgctacattatcatccactaacaattaatacatcttaaatataacgtaagcatgctatattatctataattctaaaatgtattaaattctgtagttttaaatgcaagcatattaaatcatcatcccacataattcacataatattttaatatatatctccagcatttttgtatgatatccttatatagttcatcttcacttagttaatgctattcctctcttctctcattaagtatatcacatcacatcacatctatggtcaaaattattttcctcattttattctctcagtaagacatatcaattgtttttagtccttagattactaatctatgattcaaattatctccctcctttttctctctcataagccgcatcaccttacttttatatttggatcatcattctatatactatttaaattatcataaaaaatatcaacttacgtaagcttatgccatgtagctatctattatatactccctcgtccctaaatatttgatgctgttgatttttttaaaacatatttgaccgttcgtcttattcaaaaactttttgtgaatattattaaaaaaaacttgagtagtagtagtagtatatttaataatgaatcaaatgataaaaaaagaattaataattacttactttttttaataagacaaacggtcaaacatgttttaaaaaatcaacggagtcaaatattttgggacggagggagtattatttatacttattatcactatatattatactaaactctcacatcaacgcgcgaggtttcacctagttaagtagacaaagcttacaaacttgcattttgttgagcgtaggaccacactaattaacatttcagtaaaaataaagccaaaattaattaaccaggagaagtgaaattagaaagaaaaaacagcatatgaacctttaaaaagagcagatgagtatcacatatttgaccgcgcttaaactagctagctccacaaaaaagtggagagatattcaacgatcgagatgcatgcataaatgcttgttttgtgtggaatgttgtcaccatgtgtgtgtttgcgagttacccaaaatagtactagcaaatgcacgattgcaaagcgccatatatatacctttttttttaaaaaaaaagtggcatttattcatatcaaatattttagccactgatcttaagattagtgtgattattaatccaacaccaagtgcgcttactcataaatgggttgtcgttcatatcttcaattgatcatgatcctgactaaaatatatgcccaccctttgatgcggattctccaccatttaattaaacagatcacattaatcgcagcatgacacacaatgagcaaatgtattacatctagactaccctatccccatttgtttaagttacccatttaaaaactgtgaagtgatcagtatatagtactactgtatatctaatgtgccatatggcctgacacaggctgcctctgatcaattccaaaattcagagacagttctccgtgactaactccaaaacaattctttctggtgctttgtgaaaacaaattaaggagagacaagtgattagcgtttgctttaatttggacagtactactctacagcaagtcaagaagtcaatccaagttgatcagtgtaggagtactaaaagtatatacgtagtatactactagtgattaattagtgaggccattggcagtttggcacatggcacaatttggaatctttggggcagctactagagagagatagagatgggaaaagaaaccctaaactgacacaatgtgtagttgtcaggaaaagaaacattagtgcacatacctcaaaaaatactctgtgcttgtatttgtgtgtggttaagtgacaagactctttagccttgactcaactccagtaatgcacgaagtcaaactgatcaaatcataagctcatggtttcttaattattttaccaagatatgcctagataacaaatggcacattgtgcaggccaaggtaaaaaggagaacgacgtgggttgaatatggtttgactatcacgctatatatggatggatcggacatgcatgcgtgaaaacttttctcagttaattatttctttacaactgttgtctattcatgcacacgttagttattaatcaatttgttatactgatctactactatactctgttctttcttccctacgtcaagttctcactattccatggattaataaggatctatggacactataacactttggtttagttgggattagatcactaatcaatgctactggtgtactagtagagagagaacaaaacaaaaaagtctgaattaatatgtttctatcatgagtcatcagatatatattttatcctgtcgcctgttcagaggtacaggactggtctgacgaacgaattaagctcataacatataattagagcagagtcgatcgataagcttgagcaaaatttaatcaatatccatctcagtgaagagataatatcgaactctaataccgtatcatctccacatcaatcaagcatgtcctttaatttgcgccaaaaaatttccttcaaatatatggacaccgtatcttctgtgcgtccaaatagcgctgtatatatatatacctgtctgaactgaagaaagtatttatccaactggtcataatatgtgcaatatttcgtctacatcattctagtttgattaaaaataaaggtacggatattatgtccggccgcatgcgatcccatatccaggatgtcattagattcaaagaaacttcctacagaaagcaactctcctttgtttaattctgctgcagcatcaccttcaagaacccacttgcaattgattcttaaacaatacataatcatcacattagttaagtaccaagagctagctaagtgaattgatagattccaaatgagcataatctatgtgcttaattgattgcagtgggatgatatgtctgaatggttgcttagcaaaaggaattcacatatatgcgtgcatcattggttttgcattcgcagtttgtgctatcgacataattgaataatgagaataatccaagtgcaatataattaattaatttatgtctgtaggccgggtatgtgcatctctcttatcgttctgtttattaattattagctactcctatatatttacagttactaatttatttacaactatatagttaattattagttaactattgctctgctaaaatatgtaatcttacatgaagtggatagttggacgagaacaatataaaactatgctagcatagcaatatatactactcctgtgcctgcaggccggccggatcgattataaataattttctccagcaagcaacacacatatcgctagctgtgtgtgtgatactgagatgtgcttcatttcaataccacgggcacgttcattcagaaggaaatatatcaaaacaaatcgataaggaaacaactgaaagatattataaaatagaatataaaaagatggcaatgtagtatgtgttcccaagaaaattatgatcatgtcactttcgaatcagctaagatccaattaagaattcaaacaccttactatatgctacgattacataggtgctgaaagtagtatgctttggtacagaaagaggtcaagtgaaatacatggtgaggctgtatatatgtatgtctgtctgtcgttgttggtgtaatggtgttgctagctagtcagctgggtcaatggctgtggtacaaccaacctacctattcatcacttgcaccggttaataaagtttcatgagtacgtaggataaaggcgaacaatattgcacgcccattttcagagatcaaagtacacacacatccacgatgcatgcatgtttgccacagtgccctgcggtaacatgaccaaaagtaaacaggactatgagtcactgtgtacaaagtgtacaacgccgcatgcatgtacatggtgtcatcgatcgagcacggctcagtcagtatattaactgtgaagcccggggcaactattatatcacttgttaattcctatacaaaattgaaatggtggttatcacattatccagatttattaaaccatgggctaattaactatagggttaattccttctctctcttttcttttgcaaaacacagcacacactcatccctaatgaatgtacacacgcacgtacactatatctagaaacactttcatgaaactggatcaatatattttgagattgataaaatcaacacagatatcatatggcagacgtgaacctaaactgtcaagctatgctcggtttgcattataggtatcaattacatgtcttttttgctatagtactcgtactataccgatacttctcgatagagagtgtcggccgggggcaagaaatcagcacgtactggtgccgttcatcagggaagagtgtcacggagcacgccagctcgctcgtccggccggtggccgcccgtcgccggtcaagacgacaagggtacgacgcgccgcgcgtccgctttccgattcagttttttttgttcttaccttgcacgcgatgcgccgcgcgcgagacagagagatctcatgagcgagccgtggtggtacgcgcgcgctgcgtacgtttttttttcttctttggttttaccgcgcgcgcgcgcgacaagcgcccgccgcggccatgccgccttgcgtgtggggatcgcacacacctctctctcttctctcccccccggccgcttgggcgggcgaggtcagcgtccgtccgtccggccccgcgcgcgcccgtgtatgtatgcgtttgcatttgcatatacatgcatacacatccacagccacaaaaaatattactaaaaccacgtctccctctctctcatctctgctgctacatacttctttattgtcatcttggaagccaactcaagttacccatctctctctctctctctctcttctcttctctttgttttcttgtttgcttgcttggtgtaaagaaaagatagctccctttccactgcccatctctcacatccctgcttcccttccaccctacctccttttctgccccctctccacaacaccccaacaagtttgtttgcttgctcgcacgcttgctgctgactagtagctcgctagaacaagcagatcagctcaattacctagtgtcaagaacggagaagaagctttcagcttaggtagctttggtgcggaattgtgtgcagaagcgggaggagaattattgagcggttggaagtggatgcttgcgtcgagctaagcaaatagcatccactatagagagatcggtggagagaaagccctagctgagaggaagctctagctagctaagctagccatgtgcgactacttcctgcagaggatggagggcgaccaggccggcggcgacctcaccgacatcgtccgcgccgggggaggggccatgccggggagcgtcgtcgtcgacctcccgtcgacggccgccgagtggcagctcccggctgagccgatgctcttcccgccgccgccgtcgttgtcgtcgacgacggacggctgtggcgccgggggagcggcaggcgccgacatcttcggcggtggcggcggcgaccttttctccggcctcgtggacccgttcagcagcgactactcgtccggcgcggacttcttggacgccatgccggacgcgatggcgaaggtcggcttcgacacagctgtcggcggcggctgcggcggcggcggcggaggtggtggtgggagcggtggacacctgttagacatgagcaggaagcctctcttgcccagagggatgccgatggcggccgtcggtgggctggcggcgccgagggtgatgccatcgccgctgtcgccgcgagccatacggccgtacccgccgatctccgcaggcgacatgatgaagctcggcatcacggcagggcaggcggccgggtgcgccatcgacgccgccgtcgccggcatgcagatgtcgtcgccgcgctccggcgggatcaagcgcaggttgggccggcaaccaccatcctatagctagatctaattagatcgatccaaaaagaattcttcgtttggttgcatgcacaatatcttgggttaatttcgtaattcgtgaccggattttgattaattaggggggaagtgattgtacaacttctccttgtttttttttctctctttcgctatccaatttgctgttcttttttcgaaacaagcaaatttgctgttctttttttccgtgttctgcactgcaccgccgaagaaagtaagaagagagatcgaggaggaattccgaggattcttcgggctgtggcaaggtcacagatgttacctacagctcaaaattttaggcacaagagttatcatgaacacatggtgaacggtgggaatatttctggattggcaaaaacgcattgcatatcgggtgatgtgcatatctgcatctagacctaaccggccacagctttttttccggccggcaaggtcggcttttgaaaccctaagctagcacatacgcatcgcctcgatttgatcgatgcaaaatttgcaaacgagttaattaacttggctgcgacattgcgtgtgtacacatatggatatgtaaaacaaaaaaagaaaaaactgtgagatatataagtgatacttatccaagtgctaattaaattgcaggaagaaccaggcgaggaaggtggtgtgcatcccggcgccgacggcggcgggaggaagacccagtggtgaggtggtgccttctgatctctgggcttggaggaagtacggccagaagcctatcaagggctcaccctacccaaggtacatgcatgtttatcattctagcaaatgcattttctgttttaacataagctaattgatttgatgaggtaataaattggattgaattgagtgtgtatgcattaaaatgtttgaacaaactctttttaatcatctggcattcatgtatatatatagtccatcatcattatataattttatccagtactccacattgcgtctgcacgatccatgcatggaagtcaagagattaattggaagatactaaacaaatggttagctaggtatagggtagcatgaaagatgcatgcatgcttctagctaattctcatatccaactagttctactagcttctgtaatttttgtggtatttttggggttgcacacctcatcacatacagatagtactccataaatgtgtgacgaattaattagctagataaaatgtactgaaataatatctgctgagattagtttatccttattccaagggtgtagtacttagtttatccatgtattaatttgtacaagttttaaatcagcaagtctcaactctcggtgcacactgcaggtaactagctagctcacacgattagatggagtatactcctatatctttctggcaagctagatgcagttaagtccaggatttttttttttgtacacacatcagatatgatgtttctctttctcttaaaataaaaatggaagtgtaatgaagtgagtaaaattaaatcaagtactgtaaccagtttgagaccactgtgatttcagtatgaaagtcaaaacatttttttattggaaacggccggatatatcttccataacttagaggatcgaagcacataggagtactactactagtacttattaatttacctacagcattggtttaatatcagaacaagtgatgaagtgcatgcaagcttaattagtcgatctaaacaaatatatcttgttgaaatgaacaatttgcagaggctattatagatgcagcagttcaaaaggttgctctgcaaggaagcaagtagagcgcagccgtactgacccaaacatgctcgtcatcacctacacctcggagcacaaccacccatggccgacccagcgcaacgccctcgccggctcaacccggtctcaccacagcaagaacagcggcggcggcggcggctcgggttccaagggctctcagaacgacaagtcacagcagcagccaagcgttaaagaagagcagaaggatcaggcgacgacggcgacgacgacgaccaccagcacaatcactaccacgaatagtgcttctcctgtggttgtgaaggaggaagaggcggcactggcaggatcgtcggaagcattggagttggagagagtcatggacactactgcagctggagtagtagaccacagtgagctcatggatcatgttttcagtgagagctacaagccgatgataccggagactggccagccggatgatttcttcgcagacctcgccgagttggagtcagatcccatgagcttaatcttctcgaaggagtacatggaagccaagccaagtggtggcgatcatgcccaggagaaggcaatggccaaggaattggatccattcgacatgctagactggtctactactactaactcttcggcagggagctcatttgagcaagggaagagaggctaaacccatgggcataaagccatgcatgagggtttatgcatgcatacggttacataaacttgatcccagctaataaccataaagattgtgacaatgtcagcaaaggaaagatgagattttttttttttacttttcttttcttcatttggtctctctgcttcttcatattattgtgtgtgagaattaaattttgtttcaaggtctaggtatatggacctcattttttaggctgtgtcaacttgttgtacttatgcatgagatgatgaccactctatctctctctctgtcgctcgatgtgtgcactgtgtttatggttatctaacagatataagaagattatattctatgtggatgtactgctggggtatagggatagcagctgaacaagtaaaattaaaatggggtttttgaagttgatagatggaagaagaagaacaacaagagtgtgtgagatcgacctgcattcctgaaggggatagatatgatgtgacagagatcgggacatgcatgcattgctagcttgcaacggaagtgatatgcccttggatgtgacctcaagtgaaacccggtgcgtgaaatagctagagtatgaatcacaaacacgcacacactactcctctcaaagttggcagaatagtgcatgcgtgtctgccagtgagaatctgaaacaatataggggatgccaaggaacactagctggcctcctcttcctctttgcttgcataaggagggcatatgttggattcgctggagatggtacatatttttgtctctgcgccaaggaaatgcatttacttctcctgttcatctaatggccaaacatttttgagatatacattactcatcaatcccctcacgggctcaccccatgaatacgcatatgtacatcagtagttcagtactacacacatgtgataatattgtactggtatatacatgtatatctgtgcagtactatttgtatatggaactagatagctgcatcctctagctacctgcagtatcatgcaggaagtaaatacatgcactgctaaaaaaatgtatatacgtggcatctggcctttgatttggcccactggattaacaccatttcccatccatcaatagtacttctagcttcactacaagtgagtagggacaatgcgactatgcgaggactaatgccatatgcaggatatggtatgtgtctgttgtagctggatgtgagcatgtggatgtgtcttgtggttaaatgtatctgaagactcaagtcattgtaacggtgtctgtggatacatgcagcatgatatgtacgtccatccaccactcgctcatttgtacgaggtatatatactcgcccggagaataaatgttttatttttgaaaaacaaatattcttttgtacttattgaaccaagatacctgtagtaaacagcaatattaatattgatgtttaactaattaattaaagatgatgcaaggaagctatatataagcgctgatctggatggatgaggaactcgacacctgggcgaatttgtacctttgccgcaaggatagcgagcgctgtagctctcttcattttctttctctgatcccaggtggtgcataccctgcaatagttcttcaacggcggctcgtcttctccgtttctgctacatacatcgtcctcacctttcgttgaagctgcttgtatttgtctgctagtactgtttattctaaaatattcaacatacagagcttttgcgtgcgtgtttgtcgaaaatgttctggcaggataaacaggtaggaaatacaactttgcaagaacaatatccgttttgtataatattggtagatacaaacaggtccacggttgcataagctctaactaactttatatcctcctaaaacttctctttgagaaaggattttattgggcaaaaattagtactactagcttggaatgctttgcttccatgtggtgctaatattgtttagtgtaacactaccgtgcaagccaatccatcaaatgagcggccacacttacacatagcaacctacttacatttttgttctcgtttcgtgtaaaaaagttaatccgggagtggtatggttgaatggacaatatcttataaattggttccacccaactaaactagcaatgtggtgttaaacgtgcatgtatccacggctctcaaggccacaaatgggccctctaaattgggcggatgtcaaattttgtcactggacctagatgaatttacctagaacataaaccccaattggacagatctatctctagcttgttatggttgggccaacagcgtcctgtcctacttagtttctgtgcttgacatctgagctggtatcatgatcccagcggttgtatggctctgttacgctttgttataaaagctgggctttggcctttttccaaaaaaaaaaaagcattattacatatagatgtcctaaatcctactccctctgtcccataatataagg

SEQ ID NO: 41242 - DNA, 13996 bp, Oryza sativa
  unsure (1)..(13996): unsure at all n locations
ctcaaaatcccttatattgtgggacggagggagtaacaaacacccatggaaattaaagatgccattgaaaacaaagatcttcttttggtatttccgttacaaggggtagaacgatcttcctttggtatttccattacaaggggtagaactgacaaatgatgacaattaatctatctaagcgaaattgacgatgcaatatgaaatcgttagttctattgacgcaactattacttactgctcgctatggctatgcgtgaaagatatatttttctgataagaaaaaaaatcatcttctttaatataggctatctacttacttatccaatagcttcgtacatgggtctttatccttcaaaagacgccggatttacatgacttggttgcagttccctgtcaacaattggttggagcaggtggatccatggttatgggtggtggtctaatctcttcgatcagattgatggtccttaatattagtacttcttttgagttcattttcataactgtttgtttctttttgggttgtgtatatcttagctatacagaggctagatgtattttcacgactatatcatcttgatatagttatcttgaattcaataaaagcttcctttataagaagaaaaggagtgcctgcatttcactctacttttgttaccagacaccattttggtggttcctttctagcaacaaatttataaacacttagaaatagactataatacttcatattgaagtatgtcacgtggtaattacacactttttatatataactaggaaggtggcccgcgcgtatgcgcgggcacttatattattgaaaggtaagattattgtttgttcaaaaattttgtctcatagatttagggcaaactaaagtttggataattttattttataataatttaagggttctatttttcttaaggtatcttagaaaaccattcacgaacttttgagtaggagatgggtttagtacttacaacttttaaatcatgttttttttctcgagtaaataagaaactattggtagttaattatcatacagtccatctatatacataccgtgtagtatggccgcaaatgaaaaatgcgagtgcaagaattcaaaactcttttgattaaatcatctcatgaaggcgtatgatatagtaataaagggagggaagcatatgcatgggaaaaaagaagaaagagaaaaatgaaaaaaagggaggggatgcgtacgaacccgcgcacgtaggtgcgcacctatgctgaggtgggaccccgtaatatttagtttgttctaagatcaatttaatctaacggtttataatattggacctaccgatttaagtgaaaattaagtaatagataattttattttttttcttagaatttctaatatttgccctaatttattagagcaccacgcggcagtttgagagcattttaaggaattttaaatgactaattagaatattaactgcgcaatatatatgtatgggacatatggtaatatttgttccagcttcgtccttgtttatataaatgtagagagaaattaattttgtggctagcaagccattagatgtctaactaatagcaattaattttgacacctatttacaattgttcagagtaactcttatatattcatcttacgacttcgataatccattgatcaccaatttactaatcaccatgacttgcatgaaaaaaaaatatgtagtaaggtttaggatagctgaaattgatgaattatataatttatgtgatagctatttgagagtataaacgaatgaattgacttctaaaacgttaaaatgttgtttaaagaagacaccatttagaaacttagaaagcgtgcaaacaaaaatccaaaatatgcaatcgggaaaataattaatcgctgcatcacacctttaattttcttttcatgttattaataaaattaatcatctccatatatgatttgatatgtggcaaaacggtagcgctacatcggttgtgatcaccttagatgtctcagacactgcgctttgttacatgtgcgaaaggcaaaggtgcatacgtatattgtgcagcgagcaaaaagagaatttcggacgctttatttattagcaaacaatagatccgatgattataataatatgtccaccagttctagtgtaagtgtaaattagttaatatagattttaaatttttattttaatgggtacataatataatggtgtagaccttacattgaaacagtgcattacgtgagaataatagaccaatgtaataaaaagtagatccgatgatttatataatggggccatcagttttagtgcacgtataaattagttaatatagatattgtttatttgataggtacatgatataattgtgtaaaatttattttaaaatagtgcattatttgaaaatagtggtacaaagtaaaaaagtacaccggtttaagttatatgatggtagattatttgtttgtaaaattatgattaattatttaaaaatatatccattatatatataaatggaaaaaataagaaaaaaaagaaaaaaaggaaaaaaagggggggaaggaggcgtacgtatgtacgtacgtatatactacacctgccaatgtgtgagaagaggataggtgggaccatggtatttagtttgttttaagatcaattttatctaacggtgtataatattggacccaccaatttaagtgaaaattaagggatagatgttttgcttttttcttagaatttctaggattttctctattttattagcgcgccacgtggcggcttgagagcgtttataggaagtttcatggacttttagtatataatagatagaagatagatagatagataatagatagatagatagatagatagatagatagataatagatagatttaacaactttcaagttattggtagcctggaacaataacctggttgattctggcataatggtagaaagcttgcctcattaatttttgttggtggaaccaaattaagtagactataaacaactctaaatttttgagcttcggcagataagccataaaaaacaattaaagcaaccaaaaataagttataacaaaactttatatctatattattgacaataattaaaagccaagagtacaacccctcaagaatctactctaaggctgcgttcgtttgggtgatagggagtgagaatgcacatcgttttccacgcgcacgtttcccaaactactaaatggtgtgttttttgcaaaaattttctatatgaaagttgctttaaaaaatcatattaatccatttttaaaatttaaaatagttaatactcaattaatcatgagttaatggttcacctcgttttgcgtatattcccaatctccttaatccccttctcctcaaacacaccctaatatttcaatttttggttgtgactaataagccaataagcaaattattagctagtttggacaaaccacgttatcaaaaatgaaaatcgtactagtaataagttttactccctccaaatttaaataattatcaccaaactccatccattttcaaaattttactactcgtctactccaacacaatagtaataattaaaaaggatgaactttcattcatcgtaatttttattttgcgattacacagcacaagcgcacacacacatgcaacactatactggcatacatccgtgaatgtgtcccctataacacgctctctaagagttaaaaacccaatgactcaaatttgaataattatcaccaaactcgattcatctttgaacttttaccagttgtctattccaacacaatagaaataattaaaaaggataaacttccgttcatcataatcttattgtttaagagttattagtggtcaaaattaaaatagatagtactacagtcaagatcgataattatttgaaaacgtagggagtaataattataaaattaacctgtaaaagttttgatattataaaagaaagcgtgaagaacgtacgagtactgttagaactaatggaagaaataaccccaatcacttctcgaaacgcatgtctctatatcaaattgatatgaactgaagagatattataatgttaggcgcagcgcaggcaggcatgcatgcttgcatcttaaactaagttgggcttatttggtttactattatgccaaaatataggtatgtagattttgatagtgccaaatcttttgacgtcttattgacacattttggtaacaaactaaacactagccaaactattatttaaaataacaacaatttgataggatatattttggcatcaaacaaaaatggtcctttatcagtcatcgcccttgttgttttgacagtgcagtggtaaaagtcccgtatttaattaccaatacacttacagttttcttaagaaaatgtttggagaggcggccctccctctgcatcttgttttatcagtcatcgccctcgttctccacgccgcgttgatcaacagtccgctcgtacgagtacgacggcgacgcaaaagctgccgcggccgtcgctgttcatggagttcgtgcgcgctcgctctcctcctcgcggggcaaaatgatcgagcaaaacacgcatatcgagtgcttttccgccatgcaaacaatgcatcaaacccccgtgtgggtaaggataattccggacgacgacgcccctgtacaacagcaatggccgtgactgtacgtgattgggttgtgatggatccaataattaggcatttaatcgccggggcatacctgtccgtcgtccgatataggactactactatagctcgcatttgatccggtgtgtgtggatcaatggcgcgtacgtgcacgcaggcaccagtgctatagcttctgcttctgctgctgcttgcttgcatgcaatgcacattgctcacacagcctcgcactgtttgggagggggcaagcaaccttaatgcatgccaagaaccgaactgggctgaaaactttaagggaacccctgtgccggcacgtatgaatgtttcagactttcagaggagacgcatgcatgcgtatatgtctcatgccctgcatgatgatggcatttgcaggggctcgcagttgtcttcggcaagaacaaaatttaagagatgtggagtgaaaacgctaacgcttgcagcaggtgctgggcctgggcgtgcttgcctgggaacctacacggcaagtggaattttttttccttttgttggaacattttcttttaatgctgctggagcactattgctgcctctcttttgcagtgagcgcagttaatcgctgggaccaaagttgttcttgctctcttttatttccaccatttttttaggtttgggaataagatattctgcaagcacgaaaatgtgccttgtttgcagcctgcaggtcgagtaaaagcaaaaccaaccagacgttccagactgactcgttttcagaagatcaaaagaggctatcattgtttagtgggggcccaagaagaaagaaggcccagttcatatgttcagcaaaattaactggctacgatgcgtccgtccccctgtatcctgtactcatgtgagcagcagaagtgaattgatccgtagtactgtacactgtaaaagtgtactcgtaaacgtgaagtttggtcttttgcttctgggagaatcagtttggtttttttttactgcacgcatcttagttacgataagtactattttgtgctcagtggttcctgcagtcatgtgctgcttcaggctttcagctgtttcctgaaatcttgccccagggaaaacactagcagcaagattaaccactgcacatctggcgccatgcatccatctcgattagctgtcaacgctgtttgggccggcgagctccattcactgattgacctatacgtttctgtgtctcatttacagatttttacctgttacctgtagttgccgtactcgcgaacaggaaccacctcaatcttcatggtccggttgaacgagatctattgacgcttgacttgtctcaattagaagagtgatccccaaacgataccggagctttcaggcacaggggataataagggttggatgaagtaaaagcttacacgtcttgcgggctttctctcccaaagccgtttaattaaactcgtgaaaacgatggttttatccgtcgccgtcaccccgtggccggtacggtgaagatttgctccacccactttttcttcagaaaacaattaatacatgatttgctccaccccccaaccatcatattactttctctacctctgggagactcggactcgcggcgtttgttttctttcagcttcaaggagggggcgcgcggatagcaccggtgcaccggcatggacgctgaccacgagcgccggcgtcccgagcagggcgctctgaggaggccgcttttagccgacgacgaggtacgtgtgcttctgcttccccgcgcgcccccgtagcagcagtagtatgtactaccaccgacagcttcgctgccggcgccgcgcgcgagattgctcgttgcttcgaatcgcggagggctcgtgttcgcatcacccgcgctagccggccaccgcggccggtacgtcgcgcgcggctttcgcgtgtgccgcctgaattgggccgtgcacggtgcacccgcggcccgcggcgcccctcgttgtcgaacaacacatgatggatggtccacagaccacagcagaagcagctcctccactgtactatatggttgtagacttgtggccaccgcactgcagagtgcagaggagtctttccgtttatcgatttctgctctgctgaagattgcgaggtacaataggctggttaccttcgcattccaaatggggcttcgatgagaacaccaacttatttacttacgtggcaactgctttattgttctattttttggtcaaaatgagattggtactagtatacggcgactctgctttaaggttttgcttgctgtaatgcttgcaggcatcttcctcaaatcagagcctggtatctcaggaagatcggggacaagaggtggctgaggtgcagaaggttgagagctgctccaacaaggcactgataatcatcttgagtgagtgcctagccatacttgctcgacttgttcaaatcagcaatattgcaatatcgtcagatgaaaatgctgagaaaaaaaaagagttactgtagtactgatttgtctaaaaaaacataggtctgaaataaatatgtgtgcagtagcagtagtcatcagctatagtaggttagacaacgatcggattagactgattctcgagaaaagggaaacgtagattagagtctgattgaaaataatgatatgactatatgagacctggtcttatgcatgattggatcaaataaatgtcagattaccatgcgcggatatcctaggattacctttcaactttttccagagtgatgtttttcagccaacactactgtcttttcatatttttgccttttttttgtctacctctgtttacattcttgaactgccaattcgaactgaattatgtaagattctcaccagtcaacccatcctaactaacaggcctgcaattcttggaaatcactgccttctacggggtctacctgaacctgatagtgtatcttcaggacgttcttcatggcgacagtgcttcgaacgtggcgacggtcagttcttgggtcggaactgcctacctcatgcccatcctcggcgccgccgtcgccgactcttgctggggaaagtacacgacggtgttggccggcttctccatagctctcgtcgtaagcgatcttcccctgtaatgcacacgatctgcagaagcacaatggcgctctctgcttctctgacggacacaatccgaacacagggcatggtcaccatcaccgcgtcggccacgctgccgtctctgagaccgccgtcgtgcgggcagagcgcctactgcgtcccggcgacgctcagccagaagctggtcttcttcacgggcatatacctctgcgccctcgggatcggcggcgcgaaggccgtgctgatcgcgttcgggccggagcagctcgacgacgacgacggcggcggcaagaacgagcgggtgcgggagaggaaggcgtcctacttcagctggtactacgcggtggccaacgtgggcatgctcacggcggggacgatgctggtttggttcgaggacaacgtgagctgggggttcgggtacggcctgtgcgcgtcgttcgtcgcggtcgcggtcgtcgtcctcgccgcgacagcgcccatgtaccggatcctgcccccggcgggcagcccgttgaagagtgtgatccaagtgcttgtggcgttctctcacaaggctaaattgactttgccggacgatccaactgaactgtacgaggacgacggcgtcaagaactcgttgcagcatccggtgcacgaacgattagagcacaccaaccaattcaggtagtaatctaatatattctcatggagctaggtgaacaaccatggtctcagagactcgtccctttgcgatgcactaggtgtttggacaaggctgccattgtcagcgacgaggatctggaagacggcgacaggtggaggctgtgcacggtgtcccaggtggaggaggtcaagattctgctgcggttgatcccgatatggctcacgtcggcggtctacttcatcgcgaacacgcaggctcagaccacgttcgtgcagcagggcaccaagacggacggccggatcgcgcgcggcgcattctccgtcccggccgcgtcgctgtcgtccttccagatggcgttcgtcgccgtcttcgtcacgctctacaacagggccgtgatgcccgcggcgcgccggtgcctcggccgcgccgtggcgttcacgccgctgcagctcatggggttcggccacgcgacggcggtcgtcgcggtgggcgtggccgcgtgcaccgaggcgcgccggctgcacgcggccagggccggggcgcccgccatgggcatcgcgtggctgctgccgcagtacctcgtgatggccgcctccgacgcgtcgctcaccgtcgggcagctggagttcttctacgaccagtcgccggagacgatgcggagcgcgtcgacggcgttctacttcctcgccatatcgctcgggaacctgctcaactctcagctggtgactctggtggcgaaggtgaccgcggtatggggcaatgcagggtggtttccactggacttggatgacggtcacctggattacttcttcctgctcatcgtggccatcaccgcggtgaacttcgcagtttacgtcgccctcgccaagaactacacgccaaagaaggttaggtagggattatacttgacattcgcttgtgtcagaacaacagaaaaatgctttgacgacgggatgcagaacatgcgccggcgaaggggctcgacggccgtcgtcgtccgccactccgcgtcgagcacctgaaatggcaagtgaatggtcttgcaataaacagccataggagggccttatatgtaaagaaacatagtacataggcaaaaacatgggcctaattttaatgggccgatttggacagattgactatctgtgggctgtaccctcaatttgttgggccagcatggatcgacatcactggcagcgatccagatttgatgggccaagatgcgacgcaactttcgccggcgaactagacaagctgaattttgcgggggctccttgctagggggcttcctaacgggcgcgtgcacgctagctgcctatctggcgcagccgcgcacgtccctatttcacttctcagcgctaataacgctgattagtattgatgaccttaattagcgctaatgataattgttagtattagttttttttcaaaaaataatacataaatagaacttttaactcagatgtggaaaactttcaacccggatttgaaactttcaattcggatttaaaaactttcgacccagatttgaaaacttttatccaaatttgaaaactttcaactcagatttaaaaactttcgactcggatttgaaaactttcaagtcaagatttttttaaaacttttaactcatatttaaaaattttcaagtcaagatttaaatactttcaatctaatttttttttaaaaaaaaattcaacttatattttaaaactttcaaatctagatttgaaaactttcaactcggatttaaaaacttttaactaaagattcgaaaattttcaattcagatttaaaaactttcatctgaaaatttaaaacatttaactcaaatttgaaaaattttatctaaaaattcaaaaaatcaactcaaatcttaaaaattttctactcaaattcaaaactttcaactaaaatcaaagatgaaatattcaacttctaaaataaaaaaattgcgaaaaaaggcaaagagaaactaaaaaaacgcatacgtaggtttaggtttttcagaaaaaaaaaggacgtggacgccgtccgcgcgcatacgcgccagcgccgtgggccttatgggcctaaacgcgcgccgccaacgcgtacgcgcgaattagctctggcgccttgctagcgcgttcgcgctgatagcgagcactcccctcttttaagtcttattaactatctctattagttaatatacttaacactaataatagtaattaggaaatattctcgagattttttgggagattttttactaacagattgaaaactttttaagttagatttgaaaactttcaatttaagttttaaattttaaagtcaaattttgaaaactttcaacttagatttgaaaattttcaagttagatttgaaaactttcaacttagattcgaaaactttcaactcgagaatcgagattcgaaaactttcaaatccagatttaaaatttttgaaaacttttaatttgagattcgaaaactttcaactcgagattcgaaaactttcaactccagattcgaaaaatttgaaaactttcaaatcgagattttaaaactttcaactcgatatttgaaaatattcaagttcaaatttaaaaattttcaactcaaaattttaaaactttcaaactcaaaacgtgctaaagattaaaaataaaaaaaaagtgggaaaagacgaaaaaaatgggtaaaaaaagggaaaaaaagcgtaggcggaggcgcgcgcgccgagaattagcgatcgcgaaatttcgttctccgtatcgttgggctagaactgcccatcgtacctaagtacctatttcgttgatctattagaccgtaaaaatttgatctgacggtcaccagcaatcctcctccatagcagaagaagagcgcgcgggctcctacttttctcctcggccctcaccgccgctcgccggagctcccgtcgtgtttcccccacctaccctttttcagacatgcagttttacaggctggacgatctgaactacgtggagattcggcaaacctgcccatcaattttgacggggaggtgatgctgccgatctgatcaagcacgcagatcgggctattatctgttcaattctctcttcttcttttttaagggtatcagtacgagattgtgctatttcattaaaaatagagggaacaaagtataactcgtagggataaaaaaaaatgagaaatgtacaaaactgagaaggcctatacacaatttgatataaaatctcgtagcctccttgctcccgccatggtcctagttgttgcctcttcttttatttttttcataaggttaagggtcgcagtctccttgtgtttgaaaacccactgatttctttccttccagatctcctaaactattaaaataattagagtccgaaggcctttcttaagcacatactttatattggctagcatttcttaccaattttggacgctctggcatagagcctagtggcatgggtccagatgctcgtaagccaaacggcttagagcaggtacaattaacatattttaatgagataaacgacgagacagaagagcaacggactacagatctgtagcaagctacagcacggattataagacgtaatgtgtgtatgacatgtgggacaatatattaatagtatagtaagcaactattatatgaatagctattaaattggctgtagatgaattggagctaacagtgggctatactattaaactcttacccaatctcaaaaaacgaaggagaatcgagcagcggaacagtcttcacagagatttttccagagttacatgcgactagttctaaaaaagattaaaaagaatttgaacgcaacggtcggcggcaactacctcctagcaaagatcaaagaagatttcaggcttgcgggagttgcggcatcgtctggttggtgagggcgtgaggccacggcgcgcttttacgagtttcgtcaagcggaggttgttgagctcgatcgatcgctggtcaatctcgaccggcctaaactacttgaccgaggaaattcgccaccacctgctcttcccaagtttctttggagctctcgcgtcgtcctcccctgggggcggcacgggaggcggcgacccggccacccctctccctcccctcctccccctctgcttcgccgccgcccgagcggccgccggcaaagccggccggccgcaaggacggcagcggcggggcctctcgcgtcctctcttccgggcgggcagggggccgtcctaggtggagcggcggtgaccgctagatccggcccgctccggccggatctggcggggcagcgactggcggcggcgagggtggcggcaacggcggcggggagggcgacggcgatgtcaagggcgcatgacgctgggcggcggttgctgaaggcggcggggacggagttggccgatggcacggaggcggcggcctggtgctctcgtggcgacgacggcacgttacctggcggcgacggcggcggtaccccccagatccgggcctttcagctggagctgcagagtggcggcagttggcgacggcggcggcagtttggccggcggcagtttggtcggcggcagttggcgacgacgacgacgacggccggcggcagttggcgacgacgatgacgacggccggcggcagttggcgacgacaaggacgacggccggcggcagttggcgacggtctcggccggatctagataccggcggcagttggtgacgacggcggctgtgtggtgtcggcggcggcggcggcggcagtggccggcggaaacgtggtggctgccgtgtcaactggcaacggtggtggaaccatggcgttgagatgctagctgctcggtggtggagggcgacggtgcagcaaaggttttgcggaggcggtggtgacgtcggcggcggggaaggagtcgggtgcgaggtggggatgatgacggcgaggtggttgggtgttcggcagcagcggctgtggtggtggtgaccgtgttcgcagtcaccggaggcatggcggcctcggttgactagccgagggcgtgggagacggtcgcatctggtcggcgcggcaccgttcggtggaggggtcggagaccggcttagcacagagaagtgcagccgatggcagcgcaggccagctcggcgcgagaggcacgggcggcggagatggaggccggcttggcgcgggaggcgcagccgatggagggaggccggattggcgcgagaggcgcgtccagtagaggaggccggcttagcgcagagaggcggccggcggtggaggaggcgacctaggtgtgaggaggagctgccggtgggtgtggcgcggtcttcggtgcacgaaggctggccggcgggggacgccggtgcaggggtcccacatgtcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41243 - DNA, 1612 bp, Oryza sativa
tatactatagttcagcttcaaccaaattgcattattgatactattgtgctttcttatagctgtcttggttaatttggctcttggataattacctgtttaaatttatcagcatatactgcctactagtatttgcagaaatcgaagccagcataagtttaagtaaaatgttattgtgtcttcgtctattttaataacgtagtgtacgtgagtatatgagtgtggtgtcaccgactacacgtgcatcttgtctatgtaatggaaaaagaaaatctctttgcttccttaggctgaatccaccatggcagtccagcgcatattctagatgccaacctgtatgcatgacccgacatgagcatatgtcaactaggcctttttctttacctcttcacccaccttgcgtctctgcaacacacaacgccacgggctgagataaagacgagaatgctccagccagacgctagatctagcccaaaaaatgggtagcccatgtccaagccaccccatgaactcctccatgaactcttttgtacacaatgctatctttttatctgaattttaggtagtttcaaattgtatttctatatggactatttcttgtagttttaatttttattccgacttttagattgaattatatttatacatataattttatttcaatatttattttaaatttttaatccgaatttcatatttttcagcctaaaaggtatttctacgttgactcttgtcttaatttaatttttaaatacgaatttaagttttcttttcaaaattgcatttctacatgtacttcttttatccttttattattattccgaattacagatatttttaatctatacacttggactctatttttttcttttttattaatatgggaaattctaggtcatgagagtgaatatggtggcttttatattgttttattgagttaataatagatcgacagttacaggtgttcctttttctgttacttcatgaatatttcaataactagatgaaactctgcgcattactgcggaaatttagtatgataacaataaaaaaaataacgtgtaagataactagataacatcagattaagtaaattaatgtggtttacgataatttaaatttaaatagtatgtagaatggtgattcaaacgtaaaaagtaaggtggtatgactttatggaagaagaaaagtagggagatagtttgtaccgtagattaatcatctaaaggctaaaaacaattgatgtgatatgacttaattagaggaaaaaaagagaaagataatttgaaccatagattaatcatttaagcactaactaagtgaggatgaactatataagtatataggatatcataaaacataataaagatatacattgaaacatgatgtgaattcacataattatgttagattataatttaacatgtttgtatttgaaaagctcttaaattataaaaactataaagatatagcatgtttgcatgatgtttaaatgtgatgattgttagtgaatgatgatgtggtatcttgttaattagtggatgatgatgtggcatcttgttagtggatgatgatgtggcatctttgcatgttaagcttaagaagttagtggggg

SEQ ID NO: 41244 - DNA, 1963 bp, Oryza sativa
gctgctgcatttttaatcttgattttgtccaggtgttcgcgtggcgatcaagtgcaagaacagcaacggcgagtacgagacgaaggccaccggcgaggtcggcaagtctggcgcgttcgccgtgcccctcgcggcggacctcctcggcgacgacggcgagctgaggcagcaatgcttcgcgcagctgcacagcgcggcgtcgaaccagccatgccccgggcaggagccgtcgtggatcgtcaacgccgccgccgacaagaagaagaccctcgtcgccggcgccggcgacacccacttcccgtcgtcggagtgcgcgtcggcgttccctctgcgacccgttccacaagaaggacttcttcttccactacaagaacccgtcgccgccagcgccggcggcgtaccacaagccgccgccgtcgtacacgcacccggcgccgccggtgtactcctacccgacgccggcgtactctcacccgacgccggtgtacaagcagccgctgccgacgccgtcgccgccgatctaccacccgccggcggaggagaagaaggtggcgatgcaggacgacgcggaggctgaccccgagctgttcaagaagctgctgccattgatcaagaagaatccattcctcaagttccccaagctcccgcctgtggaggtggaggcaaagccatagatggtcgccggcttcgccgcggcgccatgatcgatcgatcgaagcgaggaaacatgagtactagctggtttaattgcttcgtttctttgtgtgtttttcacaccggctactcgagctagttaattactgcccttctagcgttgttgaagcttggtctgttgcctgcctgctagcttaactattcagatataaataaaagcttctgttctctatgatgtgattacatgtttgccggattgaatggatacctagctactagcttagctagcttaattaattttattggatgcatactaaaatcttgcattttttccatacaaatatttacttcctcgtttcatattataagacgctttgattttctttatttttaagtaaagtgtacgaccggtcacttagcttgtatcacgtgtcatctagaacttgtgtcactgtgtcatctagatccccgaactctaaaaatgctaattcaggtcccataacttgctaaagtgtgtcattctggtccaagatggctacggaccattatagcatgctatgtgacactggtgtggcataccacacggatgctgatgtggcatgccacttctgcttgtccaactaaagaagagggaaaaaaagagagagaagaaagggaaagaagagaggaaaatggaaaaaagaaaaaggagaaaaggaaagaaaacttttccaagtgggccccagttgtcagtcaatatagagatattgctggtgccacgtcagcatttgtggggattttggattatttatcactctcttcgatggtgcattctcaaatgccatcattcccattaactttgattatttgccattgtgacctaccaagttgtttctattttaccattttttaactaacaactcagcaaaacgatgagaaaatgaccacattgcccctctcattcatcttccttctaccatcttcctctccgacatggcatgaaccagtctccaacatgggacaagccaagcagtagggacaactattgccatgaatgagctggggcagcaggacgagcaatggatgtgacgatgcttgatggttcgccgttgggtcgtcggggcgaaggcaatacatctcggttgcaggccctctacctcgcataaatcttgtgaacttgagagaagcaacgcaaatggaggtggggcacccgggggggaggtgtcagggttatggataccacatacctaatagtagttgactaaatctcggcatgacccaccacttaccatgtcctatacggaaacaacctgcggatataggaggagtt

SEQ ID NO: 41245 - DNA, 3616 bp, Oryza sativa
attttttaattaactacatgtataagtaaattttgagagaaaattctgtggcaataggaacaattttccatttcttataaatatataaattacattaccgaattacatatatatgcaaataaatagagacacgacacacatatatagagcgctctggaacacgtattatttctcctgaaaaccaacacgcttgtgcactgaagtctccaacacataaatcgatcgttctcacacactcacactcctcacatacaacttttattaattctgcacgaacaagctgacctggaaattaattaatcacgcaagaaccgaacgataaaattaaccatgcatgcaatcaaacagaccatgtgtgggttgatggaatggatgaatttttcagtggtagacaggcggagagctgggagacggcgcagctccgccactgttcccctcggcgccgccatcaccggttcctgcaccggcaccaccaccgttcgccggcaatggcgtcggcttggggtccggcttgggttcaggtccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgccgcgctgtgcagctgcgcgaagcagtcggcggcgccgtggaggtcgtcaacggcgaggggcacgctgaaggcgccgtcgccgtcgaggtcgccgatggccttgctctcgtacacaccgtcgctgttcttgcacttgatcgccacctggagacctgaacatcaccaaaaaattaatcaacgacggtgatatatcgttcgatcgaactgaccacgcaattaattagcgacgaacatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgaagagtagcgctcgtgctacatctgccattgctgaatcaatcctcaaactctgttgttatttggactatgtggcaagaggctagagagctgtgtgtggatgagtgaagaaaaagcaggccaggaatgtggtttatatagatcgataaaggctactagctgggagtgatctgaggtcagctaattactccatccatctacttttgatagttatattttcatcttggcacacagatcaaggataagtaattctacttatcatccattcaaacatgctactccctccattccaaattgatctacatatagtatttttgaggttatttctaaatgatctacatatttgtgttcattcattaggtttattcgttacatgtacattggagtaaatggacattgatgcatgcatctatgcacacaagtatttataacccacatgcaatatcttgatttgctattggctaggaaatagtggggatggtgcctgcattgagtttgttgctagagtaaagatagtataagagagttattagtttttcttggtcttggtgtacctatgaaatatgtagatcaatttggaatggagggagtactagtcattcctcgtaaacaaacgatttattaatatttacatttctcgatgcctatgcagccaatcttatatggaagaatggtgagtcacacattaaatccgagaaagttattaagaggataagttattggattgaaatatgcctatcgaaaataaattttttagatttagaaatataactatcaaaagtagatggagggagtatattacattatgattagcaatttgcgccgattttgcaggtttaaaatcattaacgccgtacgtgcattttatttgattagatcagacaccgatagattaagagtagcaaatcatggaggcactgtgaacgtgcacactgcatgcagtgttaactgttgatgctcttgccaccgattggtggtgtttaacaagcaaagttaagctttaatcgactggtactcctacagctagcgcacagtactactagtctgttttataaaaatggagaatagttctataatttaggacagctccaaccaaattgcatgattgatactatttttaagtaaatgcgtaaatttcacaaaactacatatactttattcaaactattgcaaaactattgatttaaggtgttatatcataaaactacaaatttaatgttaagtttatcataaaactacaggtttagtgccaatttaatcacaaaaatgcaacttttatagctcaaacataatggtagtgctaaaaatttgacctccaaattttgtagtttcgtgataactccaatattaaatatatagttatgtcatacttgaccttaattctttaggtttctgataaatttgatgctaaattaatctgtagttttgtgatagttcgatcaacatatctgcgctattacatatgtttggaacgcagtcatgagtgtataagtgtggtgtctgtatttagtggtgactacatgcatgttgtccgtaaaatggtagagaatatacttgttgatagtatatatccgataacagtgtttgttttaaagtatagaagacgttggtatcaaagtatacgcgagattttggtaaagtagacgagagacaaggatttttatattgattcaggccccggtgtgggtactagccataatccaatttatatgaacatctctaggatgtatcaaactgattacaataggagagcgagctagctaatatagcttaccaactagcattcaccgagaataaatccgacgacttagaatcattggctagctattgacttcctcttgattgatattcgatgtgacttgtggctatggcttatgattcgatgctcttctctcctaggggctatatatttatgcggacaatcaattttttgttaagttgaattcgaggagttcatatgggatacgagcaagtaagagtcttgtcagatcctgtagtcaatggcacatgagcataacccaagagtcttagcgatgagattgccgaagctttcaaaaatgctttcggcatagatactagggttaaaaggcgtatatatcaaaaactctatactggccactacgataatgttcaatatcctcaagggttttgattgcctcattgtgtaagttcactggagaacatggccggtctactttagaggatatcgaccagtttattattcaatgcgaagaagctagtgctagtagtattttgaaacttaggctttttcccattgtctttatttggtgatgcgcgcaattttttgggtttatttcacttgcaccaactgtattcatgattggtctgagttagaacaaaaatatcatgattacttctttaattagtggtgagaccgaattaaacttgtcgtacttaacctcggttaaacaaaagtataacgagcctacttttgaatacattagaagatttatatatataagaaactgatgttatagtttaac

SEQ ID NO: 41246 - DNA, 8416 bp, Oryza sativa
aacatgaaaaatcttataaatatataaattacattacgtagaacacataccgcattacatatgcgaataaatagagacaacgacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggcctagctctcgtactcgccgtcgccgttcctgcacttgatcgccacctggagacctgaacatcaccaaacaattaatcaacgacggtgatatatcgatcgatcgagctgagtacgcaattaattagcgatgaacatattatcatcatcatcatgatatatatacccttgaaagcatcctgccccttcatgttcttgctggagcagtcgccgcacttggccaacccgacgacgatcgccgccgcctcgccgtccgcagcggcggtgacagccatcacgagggcagtgcagacgatggcggcgaagagtagtgctcgtgctacagctgccattgctgataaatcctcgcaaactctatgtagcaagaggctagagctgtgtgtggatgagtgaagaaaaagcaggctatgcatgtggtttatatagatcgataaaggctactagctgggagtgatctgaggtcagctaattatattacaacatgattagcaatttgcgccgaatttgcaggtttaaaatcattaacgccgtgcattttatttgatttgatcagacaccgatcgattaagagtagcagctagtagttcatggaggcactgtgaacattcacactgcatgcagtgctgactgttgatgcacttgccgccgattggtggtgtttaacaagcaaagttaagctttaatcgactggtactcctacagcgcacagtactactagcctgttttataaaaagggagaatagttctatagtataggacagctccaaccaaattgcatgattgatactatttttcagtaaatgagtaaatttcacaaaaactacagatactttgatcaaactattgcaaaactactgatttaaggtgttatatcataaaaactacagatttagtgttaagtttatcacaaaactacagatttaatttgaaatatatggtcacaaagctatagattaagtaacaaaattatcataaaactacaagtttagtgccaatttaatcacaaaactacaacatttatagctcaaacataatggtggtgctatagatttgacctcaaaattttgtagttttgtgataacttcaatgttaaatatataattaattacgtgatacttgaccttaaatatgtaggtttctgataaatttgatgctaaatctgtggttttgtgatagttcgatcaacatatccgccttataaacatatgattggaacacagtcgtgagtgtataagtgcggtgtatgtatttagtggtgactacgtgcatcttgtctgtataatggtagagaatatacttgttgacggtatataatagtttttttaaagtatagaagatgttggtatcaaagtatacgcgagattgccgtaaagtaaacgagagacagagatttttatattgattcaggccccgatgtgggtaatagccataatccagtttatatgaatatctctagaatgtatcaaactgattacaatgggggagcaagctagctaatctagcctaccaacaagcattcaccaagaattaatccaacgacttagaatcatcggctagctattgacttcctcctgattgatattcgatgtgacttgtggctatggcttatgattcgatgctctttgatctctcctaggggctatatatttatacggacaatcaatttcttgttaagtagaattcgaggagttcatatgggatacgagcaggtaagagttttgccagatcctgtagtcagcggtacacgagcataacccaagagtcttagcgatgagattgccgaagctttcaaaaacacttttggcatagatactagggttaaaaagcgtatagatcaaaaactctaccctgaccactattataatgctccatatcctcaagggtttagactgcctcattgtgtaagttcactggagaacatggctgatctactttagaggatatcgaccaatttatttgtcgggtcccaaaattaaaaacttggatccggctgagattaatgtatcaacccctggatcagtaaatattgatacataatatgcaactggttcttcattgcatacgttaaattttacaatactaaggttttacaagaataggtactcacataagtaagactattacatagaggttttatacattctgactagggaggtataacctctagggattttctatgttattggagtcatcgtagtaataatcataggagtcttcttcttgacccaaatctgaaaaaggggttataagagccagggtgagtattcacaatacccggcaagttaccatggaaacatgttatgtgttggtatagagtagagttctttgcaaaagacaataataaacaatctggaagtattaaagcaagagtttgtaaatacatagactttaggtttctaaccagagtactatatgggtctcggtactcaattccatgagtacggccattcgaatagtttcatgaatattctactacagtagatgtacgctttactcgcagtccacgacttgccaatattcattagcttagtcatgacccagtattaggttattaacaattgtggtacctgttccatgaactctagtcctcatgcgctctgaacgtaacgttatcagcagcgagaggagttctggtgttcccggggtatttaagggggatctcgtatgacaccacgtcatctcgatcagggtttagaattataacataataatttatactcgagtatcatcgaccatttacttgtacatggtaatggtaaaaattgcccttcgtggctatagttgcctcttgctcgaggacttaaaaataagaaccacgatacagaggtaccacattgctaattaatataatgactaggtatgtccctattctagaaactatggtcgtacctgttcgttcgacataagtacctggtaataactatatcgatcgagacagtactagccacccgaaaatcatccaattcctacgtactgtcccaatctaagtatgaaatatttagaccagattgtaagcaaaataagcaatactaaattgtttgggtttctatggttgaattatgcatataaaatagagtattgaatagaaggctataaataaataatttgtaaaatataggcttaaatgatcaaaaggtagaatagtaacttgccttgctcgatgtcctgagattgactgatattatctaatatgtcagaggactcttcaagacctagggttaaacatataaaattcaaattcaaaaggaattcaaataaaatccaaaaataggaaaaataaaataaaatagaaaaatagcaaaagtagactcaaaagatagagaatgattttagaagaattttggtccaagtttcactggaattggatctatattttaaaagatatgagcttctaaagtttgaaaatcaaattaaatgtgaaatgatactgtgtgcgggtcccacctgtcagtctctttctctcttctcttcttcaacctctagccgttccccatttacggccggcggtgctagggttagcgatttcggcggtgatagagggggaaagggggttgcggccgaggaggggaggtagctagggttctccggcgacggcgagtggcggcggaggggttaatttgatgtgtgggtgggctaacggctagggcggcggtgacatggataggccgtgaaggtgatcggggtggtgagagttaggcatagcacggggagggttcctagagcatctacggggtacttagaaggatttaggtagcttgccgactttcggcaaggtgtggaagaacttgccgacgagcacctccattggcgacggacgagctcatgtcggcagcccagaaggtggcatggtaatgctggccgattgcgaatatggaatctagggagtacgtagatggttaaaatgaaagaactcaccgagataggctgagacgacggattgcggccggaaaaacttctcggcggtgagaaccagagcagagcaggggcgacagtgcttagctcggtgcgacgaggtgaaactcgacgcaaagcttcggttaggctccaatatgctagagcatggttgatattaggtgttctaaggattagttaggatggagagtggatggaggggcgtgaagtcaatcgcacacaaggtgttcgaccgacgggcggaagtggttgatggtatggtttggcaaagcagagcttcagggttgtggggttatggttgatgatgatcgatgatggacaaggaagggattggggtcctatttatagggccagaagaagtggatgagctcgggcgccatcaacgccattgatgagcttggaaattgagcacggcaggggtggcagggagctgtgagagggagggcaagatcaatttgagtggcgggaggccacgttcgaattcttactgacgaaggcttgacttgaccatgggtgaaaacgtctggcgacgtgttggcgccaatccgggctcgacgcgcggcagcggcgagggttaaaacggtcagcatggcggtggtcggtttgaattgtgataggggaaaccaccgcttatcttcaatccaacagtgcggcaagaattggcgcgattcaccccgggtagaagcgaattcggacttggcggcggctttggacgggcgtgcacagcgtcgagcggcggtaacttgcggcggaggtcatcctggcttcgtcttcatcacgattggtgcggtggcggtggtcttagggcgtcgaacgactagcggcgcgccaaggcggtcgggcacacgcgaacggccctgaagccgacgcgcggcggctcggcgtgcggcgatggaggatgccagggtggcgcaagtaaagggggtggaaaaggcaaagtgaaccacagttttggatgggttgtggtccccaaggatcaaacttagactttgcaaaggtttgggtagatgttgggctgagatagttgggctgggcatttcatcgaacaccttgagggcaatgaatagtgttttcagaaattttgaatatttttcctagaaaagaatgaatttaatctataagtttgaaagggtttcactagggtttagagtatagaaaattctcactaatgaaagggggtaaactaaagaaatatactaaagttcgaaatttgtgagaatttgctaaaattcactaagttttaggataaagggaataattagggtaagttaaaagagttctaaaggaataatacttgaaccaataaaaggattcaaataaaattttaaattgtactaatctagtcaaaaaccagcatgatgcagtcaaattttagtttaaaatttgaggatgttacattattatacaatgcgaagaagcctagctagtagtattttgaaacttaggcttttcccattgtctttatttggtgatgcatttacttgggtttatttcacttgcaccaactctattcatgattggtctgagttagaacaaaaatatcatgattacttctttaattagtggtgagtccgaattaaatttgtcgtacttaatatcggttaaaaaaagtataatgagcctacttttgatctacattagaagattttatatatacaagaaaccgatgttatagtttaacactttctgataaggtcttggtagatttgccttattctggtttacttgaatatttaaaagaaaagctagatggtcatactttcttagatgtaagccaattacttcaaatggctttgactcaagagagccaagttaaagaggccaaaatctcatagaaatttatgtctgattgttcccatgttaatatagtttatgaacaagaatctttgaacaatgagacagttgatgtatacatagacgaatgggtttggaactccaactctaaaccattcgtttgctccgttcttaagctggttagtcgtaagaatcgacaagaggaaataacgttcacttttgatgtggccaaatgcaattagaaacaaaggtagctcatccacctgcattaccttttcctatacagactgctgaattgcaagagaaggagattcccgatggcaaggagaagaccacattgaagacttcaatacttagggggcaaggtgacaatctggagatatcaaaatatgacaagcaaccaaggagatcaagttcatctaccaagcgagtatgcaccaccggcaactaacttctccttcttcatggtattacacttggagaccacattgaagacttcaatacttaggaggcaagatgacaatctggagatatcaaaatatgacaagcaaccaaggagatcaagttcatctaccaagtgagtatgcaccaccggcaacttacttctccttcttcatggtattacgcttggtttgcattatggagttttaatggtatgtggatgatgcctatttatataccatattatcatccattatgggcattgccggttgccacattgaccgattttaaataatcaaccacactcatctcatagccggttgagagaaaataatcagtcacaaaagaatccacacaagaaagtggcgaggcaagagtggaggctaaagaaaaacaaaatacaatctgaacaagaggggcctctcgtagctttcttacatcaccattaaacatttaagccttagaggcattcatggccggtattggtggatatcgcccttagatgatctcatgcatagtattttttggctcacaagtttgccgaaaagacaggggggcatgtgttgataatcaaatttggcagtagagtcgagttatagcaagtttgagccaaatttataaaatgccagagctttcccgcgaagactggtgtgaccgttattatgtggccggtcaaaccggacaatgcactgtgattagaccataggtatccaggcggttagaccttaatcacatagtccgagtccaatttaatttagatacttctcgtgttttcttgttttacaccaaaatttttgagtcctagttgatttatatgcctaattgcatatgaaaaaaccccaggaagcaagtccacccctcctataaatataagggggccaaggacggggggccctaatgggcgatcgatcgccaggcgatcgcctgggcgatcggatccagcccccctccccctatactccctcctctcccctattcctcctccccttctcctctttatactacagtagactacacaaatttttttgaaaaataaaagttagaaaaatttatgtatagaaatactatatataaaaaatttgaattcaaattcaaatttgaatcgagtatgtaaacttttgacttataaactttgggtctataaactttaggtgtataaactttagatgtatagaaatactatatatagaaaatatttgaattcaaattcaaatttgaataagatataattcaaattcaaatttgaatcgggtatataaactttaggtctataaacttactttaggtctaaagtttaaactttaggtgtataaactttagatgtatagaaatactatatatgaaaaatatttgaattcaaattcaaatttgaatcggatatttgaattcaaattcaaatttgaaacgggtatataaacttttgacttataaactttaggtctataaactttaggtgtataaactttagatgtatagaaatactatatatatataaatatttgaattcaaatt

SEQ ID NO: 41247 - DNA, 948 bp, Oryza sativa
catcagcaccaaggatccatctgctccgtcttccaattgaccacccctcaatccagtcgcgagccgaagccgacaaatcacatgccgtcttcccagtcgccgaacaacccgagtgctatgtctagccatctccctgtcgaacgcaactcatcgaaaggccccggccaccccaccaagagtgttcgattccaccgaccgagaacgccgatcgcctccagtttcaatcaaccccgagcgtgtggccacacgtctccctgttgagagtagctcaccggaaagttcgagccacccgcttgaagtgtccgacccaccgattggattgccaatcgcttccgccgccatcaacccgagcaccacgtctggtcatctccttgttgattgcagccatcaaacggttcaaaccgccgcctgaagtgtccgattccaccgatcaaattccgttgatcgccgccgtgctccaccttgcatccatgtccgtccctggacaccctgtgtagtcgtcgcggcgtggagcacctccctcgtacctctaccatggatctcccgtaggctctgataccacttgttataaaaccagccccgaaatcgacatcggtagctaaacgcgaaagaaaacaccgtaggagatctaaacacgatgacgacaccaaggcacgatatttgataacggagttcagccgaggcctacatctctagggcactgattacggacgctcctccccgatccagcatattacagcgtatcatagttacaacgactcacgaccggtcgtcgccggcagccgctccctctcgctatgctatgtcgccatgcggttacaacaggcacgcccctctattcatgagagatcctaggatagagtccgactcatactctagtcatacacctaatacaactctaagtcttaaactgtaaccgactacgtatatatattcgatacaaactct

SEQ ID NO: 41248 - DNA, 1080 bp, Oryza sativa
aggtgctcgccgtgatcgggctgaaggagttcttctacgaccaggtggccggcgagctccacagcgtggggctcgccgtgtcccagggcgtgatgggcgtcgggagctacgccagcggcgcgctcgtggcggcgatcgactgggcgacggcggcgaggagcggcggcggagagagctggttcgccgacgacctcaaccgcgcgcacctggactacttctactggttgctcgccgcgctcgccgctctggaggtggccgtgttcgtctaccttgcgcagcgatacgactacaagaacaaatccaagccatgatcgatcgtattcttttctgattttgtatcttcttattttagatatgaacaatggcgtgacgttatcatttagaaaaaatatcaaacatattcttttaattgtatatccctactattataaaaagagtaaagtgcacaggtagtccttaaactaataatggtgtgtcatctagatccttaaactcttaaaatgtatatccaaattctagaacttgtcatagtgtgtcatataagtcccaattcaccacagcccctttctacatggcgctgatgtggcatgccacacggacataacgtgacaaacggaacccatttaaaaattttcctttttcctttttcttctgttcttctatttttcttctcctttttttttctttcttctcctttctctgcgaccggagcataagaaaggaaagaaaaaccgaagaatgacaagaaaacaaaaaggaaaaagaaaaagaaaaagaaaagaagaagaaaaaagagaaaatgacacgtcacgttcatgtggtgtgacacatcagcgccgcgtaggatcctaaaggggctatatcgatttgggacctaaatgatacactttgacaagttctgggacctgaatctgtattttgagactttggagacctagatgacacaaccttacgagtttaaggaccacatatgcactttacttttacaaaaattaaagatatttttgccggtgttttggtacgtcattcgtgtttgagtcggtttttaaatcactcgcttttggaaatacagatctgtgt

SEQ ID NO: 41249 - DNA, 1088 bp, Oryza sativa
acattgtggaagtgagctagtcctgactcctgagttctgaatgcctgaatgggggaaaacaagttccattgcttaccttttcttatctccttctagatatttcaactggtgtaatatggtgacacaagatctgcaccagatcaactatctctcggtttctatcaatggttagtaacaggagtagtaacctggagagagctgctattctgctcgaaatcaacacaaagtcaattagtcactcatatcaatagacagaacacaattcctatcgaacaaaagaagatcaaacataataaaagaagataaagatgtattattttctaaaagaaaaaaaaaagatcaagatgtgtagatcaagggaaaaattgaaaaactctgaagctgtcaaatgattatgcttgccttttagatggtccaactgaagtactagaattcacaaggctcagctaaatgattcttgccttcactttcttgctgccttgcaaagtggtggatgcttctcaaatatcaagtactagcagtcttgtgtctggctcagtttctttccaaggatctagaaacaagcaaagaaaaaaagttagttgattagtcacaacccataacactgaccaactgtacttcaatgagttatcttccacaaggttagaattttaacctagcatgcagagctcatcaaactgtttggagtagtacaagtacaaaactcatcattcatcctcagcaaacacagaatgaaacctgacaatcatatgattctgtcctgataaacgctacagatctggatggcgtaattacatgagtatgcgaccatgtgactcatactctacaatagttctttttttctgataaactttacagagttcatatcacaatcactatttattttaactggcatagtgactcagatcttcactgtgtcaatcactcttgtcccttgcaagaaatgttcaaagagccctgcaaggtagtccataatcttcaccctcttgtatcttgccgggtgcctttcatcgatcagctcaagtgctggctcaatctctttctcaagattcataaaataaaacaacaccactgatattctctccttt

SEQ ID NO: 41250 - DNA, 1736 bp, Oryza sativa
  unsure (1)..(1736): unsure at all n locations
agagcttggtggtgcgctgatcggcggatgcggggtcggacgtcggaggcgggaacataccctcgccggaggaagaggaaaaggcgcgcgggagaagggttttgtggccgcggtggatgcggcggcggaggagaaggagcgccattgccggcggcgaggtcgagtgaactgagaaggtgacggaaaactcgcgggcttcgtgtggttggtttcgtagggcattcggcgagttgggcctcaacgggctagcccaaacggcgcaggcttcggcttaattcggcccaaattagcgaacagcgtagaattttgacaataagtctattttgtccttttgactacaaaaccggatataacatctattccatctaaaccagtgcaagtcgattcttttgcggataagtctatttttgtctgataacgtctctcccatcttcgaaaaccagtgcaaattgactattttgggggtttaggaagtggtttatgttgatgtgcaccggcttttgaagcggagacattatacccggttttgcggttgaggagggtgattcactcaaaagcatgacagggagacaaattagacttactccaattttctctgatttcggcccaattttgcgtatggcgtgggatttggggctgaattcggcccgtttttatctccttcgcaaaaatggagttgaatttgggccgattcngtcgtcttcttgtcggcctacgagtggtggaggcgagctgcagtgtgtccgaagcttttcttctctaccagcggcagcggcggctggtagggagaagnagatcgccaccagatcgccatggagacgctggcgagcgccatgcggcgggagaaccgccgcttcaagcccccctcctcctcttccgcttccgcgtcggccgccctctcctcggggagggtccccctcgtcatggccttcctctcctgcctcgcgtggctatacgtcgccggccggtacgtacgcgcgcccgcgcgctcagatccggggggaatttccgtggagttttctgattgtttcgttgattggattttttttttgcaggctgtggcaggacgcgcagacgcggatgatcctgtctggtctcctcgagaagagctccggcaatgtgcggatctctccccctctccacccacttctcgttttttttttccgcttgatttgtcagttcgtgtgatggtatcgcctaaattgcagcttccgaaggtgctgtcggtggaggacaagctgaggaatctaggatgcatgtaattcccccctctctctctctgaagaagaattcacaattcaaaattttagttgctgatttgaaatgggttgtttggtggcagtggaattgggaggaagattgcggaggcagaaatggaccttacaaaggcgaagagcgaggggtatctgtgggggaatggaactgctactggtagttctgacaagaagaagctcctgctgttattggagattacactggttttggttcccggctcaagaggaacaccttccgtggctcatggatgccgagaggttcgctgttcttgctctttttagttccaagtttacggcgataaaatgtgtgcgccctgataaacatttgttggaatgcagcttcatttttttttctaatagctattgctgatgcaaactatgttacttataaggtttcaactacaggagtataattgttcttttacctcactgtaaatttcaggtgatgctctgaagaagctt

SEQ ID NO: 41251 - DNA, 1011 bp, Oryza sativa
ttccatcaaacacaaggggaaactcctcttgtcctgaaatctgcaagttccagtctttttgccttctcatccgatcccccaaacatctgttctcggagggattgtgtggtcatcttatgctgtgaaataggacatgacggttctagccttctagcctaactatgatacccagattcacagtattgacaaggctgactttgctaatctgaagaactagatagatggtgctggaagattgcttgctatttcagcagctcaccaccttctcatctctccataatagtgttcttgattcactgggttaccggatggaaaaccagtggcagctaatacagtaagcccaacaatttggccagtcaattcaaacctataaatcttcagcctattgtgatatagacaattctacaaaacaacaatcatctttttctaggtaatctaaatgctgaatatgatatatcaatggtagttcgacactttcactgtataacagttgcaggttatcttgctaatactagatagaaaaattacacggcaatttgggttgattctcaaattgaaccatggttggaaaccactgtcagcaattctgccaaactataatggtgaactctatcaggatcacaactcgaaccaataaattctagggatagagaaatacaccatatcccaatacacaaagattagccatttgtgtttctgtcaaaagctgcatactgaattggatatgtccaaggtatttgggctctataaatatactcaatataaccatataatcactaagaagggttcttgctgataagaaataggacgataacacacaacaatctggattgatttcaaaccatagctgatggcaactcttaaaagaaaatttatactaaattcatcaactgtttaccatcacatggattaaacaccaaccgaattgcgagaacaagaagcaaaccatctcagtagatcaagcctcaggcgccggctgcgagaggccggccttggcgagcagcttcccca

SEQ ID NO: 41252 - DNA, 926 bp, Oryza sativa
gccccactccaccggtcagtaagaaaagagagagatgaacacaggggagatgggcaaataggagcaagaataggggtgaggatgacatgtggagcccacgtgggccccaccattttttttaatttctatgtgaaactgacatgtgggtcccacgagctttatatttttccggatcgaattgccacgtaagcgccacgtcagatcaagaccccacgtaggtgccatgtcagccaaaaccgccttcaaaaccgccgagggacataatctgcaccggttttgatagttgagggacccgttgtatctggttttgtggttgaaggacgaaaatcggattcgttgccaagttaagggactttagatgaacttattccccaagagaataaacgaggcagcaacagaaatttccccatgatgaagataacgaagctccagcctccaggagagatcaagcagatggacaaaaaaaaaatgatgtttgttttaagataaactagtgacgagatttgacacaccaaaagcacattaaccgcacgtgaaatgcaaaaatgaacctcacaccgagacctgaaaacagagcgaacaactctagaattgctcagcgaatcaattgttcctcatagaaagctatttcctgacataaacaaatataacttttcctaactttgataatgagatggcagcagatatgttgtgcacctaacagatgagtcaaacatccggataaacagttaatttgctttattaaacaattgcttcagtgacagggaatgccaccatatgtagcaagccgcaaaaataagtttgcaagtcatacatactggagatgcatggaacgatggaaaacagtacatggacaactataactgaaccaaaaataaaatatcattcttggataattttagggggatcctctagagtcgacctgc

SEQ ID NO: 41253 - DNA, 21851 bp, Oryza sativa
  unsure (1)..(21851): unsure at all n locations
tactttccactattctcttcatgttgtcatcatttagcattcagcgtattcctttacaccttcgaccttgatgagttccttcccattggatcatctcccaagacatggcattgcctggtaaccggtgcctgcacttttcactccgtgtagcatctgataccgagttgaagatttcactccttgccttcatagaaacacttttacctaggtcatcttgcttactcacagatttatttttttttctctcaatgacaaggtgactgttgcagggcgattactgtcaggagtcttccttgtgtgatgcagagcatgtttctgattatcctttatcaatcacctttcggcctacgtctttcctgctagagaacatcttggccaacctcttttatcaatcatctttcggcctatctctaacaggtggtactctttaatgtgggttgcggacacttctggtggcgatggggtcctttggtctgctgcctttcagtgaaaccttgaagtgttttcgccaaaagctatactgactgtcattgcctttgatccgaaaaagacacgtgtgaaactcttagtccaaacaaatgtctctttggttaatcgcttgattttcttttccatcatcaggttggttattaactcgaggttagaacatagttcctctgaaatgagaccctaagtctcctttgacagtaaacaattatacacataatcccatatcagcatcttctgaaagagtcctcatagaacttgtttttattacacatttctcccatattacatgaatacgaggcactaccttaaacaaaaagggaaggtgcttaacatcggtacattgtatcctcaacatgaatcatccataaacatagtaaactcactgtttatagacatgaatatatttatttattacatgattgctgcaaactttcgattacacaatgataagtagcgaattgaaaaccacaaacgtggctgctcattttgattctggagagatatagctggcattgttctagtaactgcatcatccttgattggttctgtgatgatgtgataggactgcatattgctatcattcacgggagaaacttccttctgattgctgtttgaagcagataacggtcttctgcttggtatcgccctcctgaggttgattgcccttcgctcagcctagagtaggtcggggagagaaacaacttcttccatcgacgacaattctttgctgaggccgtaggtgcagagaatggttggtgctgaaggtattattgttatgatttattgcagagtcaggtgcagcaggaggagcattggtgctgtggatgatatcgtcgatgttgctgttggagctgactagctgatgagacaatcgtagggttgttcgttggatttctgcggtcttggtcaacaacacactgagttggcaatccgtgggcacatggtttgtaccttcgcacagaaaacatgtgaccttgtgggtgggacattcacctggcggatggtcttcttcaccatgagggcaaagtgtgagacacctgctagcaatgtgtccaattttctccacaacgggtgcatgcctttgattccatctcttcctcgccgagatgtcggggagactcttcttcatcatccgaggagacttgatctgacccttcactatcagatactctgccaccatggcttaggaggtgctgggtcaactatcgtgcacctcggaaggtatttcctctttgacgtctaggaataggtatccctgctggaggccattcggtgttggtaatagtcatcttacgtacttcttcttcagttcgcatcggcgcttttctcttctgattcttactcttcttgcctttggcttgcttagtacgtgaccccacgtggtacgaaaggctaggaggaaagcatttcccgggattccatggattctctccattgggctctctactttgcacactaggctgcaagcttgacttggtgtgaggaggctggtttagcgatgtctgccctgctaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatagtgattttggtcttgacttccatccaatggtagctgcgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaaacaaacaacctaccaacatggttacatcacaccccactgatgcaaaccaagcgctacacacacaagcaaggaaacacacaactaacgactctaccctagagggtggcttaggttctgcgacgggttctccaagatcttcactccttcacagctggcttcactgcttcctccacttcgctagcggatcctacagtcttctggagcttcggcaaacaactgacgatgtcttcttcttcactgacctgaccatccagtactagttgaaatccgaagaaggaagaagggagtaaacattttgaaaatagcattagggaaaggaggaaaaggaactttcgcaaatagtttcatttataaaatatgtccttaggttttatccacttggcttatcctacagtcgagacggctctgataccatcttgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggattagcgggcctatggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacggcatttaaaaatcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacattttagctgttaagcaaattttaagaattaaaacactaacttgggtgcattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggattgagcccctagcagcaggacaccagccctgtaccatgacatctcgactaccgggccgcagctcgtgtagccttcatttgtcctagagatgtccatcgacccccgacttcgtccatctccatccgtgtagttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccatgaataaagtacccactagttggggttttgtttaatctagggtgaacaaggtaataatatcaataacaataatattaagttcataacaaaggtaaataggcatggccaaataaaacagtgataacgcgggattttaaataaagcgataatgcaataatttaaatcaaaataattttataaactgggattcaatatgttcaaggatgatgtgacttgccttgctccgggagaacggccttccgaaccttcggcgacgaccacgaaccacgcttcgggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaattaggttttgcaactataaaacatgtggaagcgctagcctggaaaagacaggaaggctgcgttgttgacatgcggaccccacatgtcaacctaaaggaccacggtagaccgagtacacagagacggtccacgggtcgacggaagcggaccccatgtgtcaaccgaggcgagtggccaacaaacggactccactagacaccacacgggctgcacacgtggaaaccatgctgctactgagcggacacactaacacggacaccacacggtcaccacccgcacacgtgaacgactaccgacaccggtacacgggtaccggggtcgacaaccgcacaacgggtacggggcgacaccgaaaggacgagggcggggcagcgagaggagagaccttaccaccacgcgacgaggcgtgagaacgacaacgacgaacgggcgcggcggagacggacggcgagggaacgacttcggcggcgatccttgaacgaaggcgagacacggccggcacgaggcttgacgacgcggaggcgaggacgaagacgacgacggctacagcgaccttgacgaaacaccgaggacggacgagaacggcttgacagagggacgaacgccacgacggccgggaacgacgggaggacgacgacgacgacgaccgggaccggcgaggagacgacgagggcagccggcagcggctgcacggaggcgaggacggcgtggaacatgccgcagcgatgcccacgatggaggcggcgccgcgagacgacgaaccgggcgaggatgaacggtgaagacgacgacggataccggcggtgttcggccgaaggggaagcgatgccgaggacgacgtcgcggctgcgatgccgaagatggtggaggtgtggccgaccggtgcacgggcgaggagggacgggcggccgaacaactccggcgaggcggatggagaggttcgcggcgatgtgcggcggcttccgggcgaaaccgaggggtggacgaggtggagggctacgtcaccgtgccgagggagggacggcagcgccggctgatgcacgggcgcggcggaagggggctgccggaggagacgtcgacgaggaggaaggagaggccggcgcgggcgacggcgttccggagaaattcgggcgacgccgtggcctggccgggaaagaggacggcactccggtgccgggagaggtggtggcgacgtcggccggcgcacagggacgcggcagaggcgggcggaggcggaatcgtggcggcaacaccacggttgccagcggggaggcacttccggaggtctccgcggaaaacagagggtaggccggcgaagaggaggcggctgcgatgctggaggaggcgacggcgcgaccggacggcgctccggcgaggagggagaggcggctggaggcggccggaggcacgggagagagaggaggactgcggggagaggtgatacgaccacggggagactcgggatgaggttaaaacgatagaacggaggatggggattccattttatgggatgggggagggagccggccacgggaggagcgggaacggcggcgggaaacacggccggcggcaatggaaggcggccgggaatggcgcggccgttcccggcgattgggggcgccattcaaggggaaattaagggggaaagagagatgagggaaaggggattaattccccccaattaattttggaatccaacgcttaaatcgcgcggattcgagggaggaacgaagctagggttcacgggagagagagagaggagaccgggcgggaggaaggagacgaccggcctggcgcgtgggccccacgcggtcgggcgctcggtcagcgcacgcgcggcgtgcgtgcgcgggaggggagcggctcaggcaggggcacggcgtgggccgggcggccggcccaggaggagaggaggggaggggtggcccggggagagagggaggaggagggagtgggccggggaaggagggagggaaggagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacattggggaatcaatatcctgaatgagaaaagaagggaaaagaaaactcttcagggaaaattggaggagctagataggaaagctttagaagatgacttatcccctgaagaatggaattagagatatgaggtggaaagggatctagaacacacttataagatggaagagttgtactagcataaaagatgtggagaacaatggatcttggagggggataggaacactgagttttttcatagggttgctaatggcaggaaaagaaagtgctcaataatctctttgatggatggagatacagagctgactagtaaagaagatataaaaaaaatcatattgtctcttattacaaaacccttttttagagctgatgttttaactatacccacttggctcgagatatctggagtggcggtctgaacctttctgctgacaacaaagagagtttgattagacccttcaagattgaggagttagataaggcgcttcaggaggcaaaattgaacactgctcctagtccagatggttttagcatccttttttgcagagcttttggcctcaagtgagaaatgatttgtttgagatgttgcttatgtttcataatgaggagttagatctcaagagactgaactttggggtgatttctttgattcccaaaaacaattagcccacagacattagacaatacaggcccatctgtgtgctgaatgattgcttcaaatttctcagtaaagtggtgaataacagactctcagaggtagctaatgatgtgatttctcctacccaaacaaccttcattcctaggagattcattcttgagggctgtgtgacaatccatgaggtgttacatgaaatgaggactaaaaatagagaagggattattttaaaaattgattttgaaaaagcatatgatagggtcaaatgggagttcttgatagaggtaatggaaagaaaaggtttccctcccaaatggattaattggattaagtcttgtgtgataggggccgggggagggtctgcattaacattaatggggataggactgagttttttagaacctttagaggccttaggcaaggggatcccctttctcctctccttttcaatctggtcaatgatgctttagctgcaatgttggataatgctaagagaaatggagttattagtggcttggttcttgagattgttcaaggggattacccatttacaatatggtgatgatactgctcttttcattgctaatgatgtctctcagattactgccacaaagtttatcctttattgctttgaagagatggctggtctaaaaattaattaccacaagagtgaggttttcactatagggttagaggaatctgatactattggagcttctcaaatgcttaattgtcctataggtcactttcctatgaaatacttgggcttgccaattagccctgagaaggttttaaatcctgattttgatttcttaggtcagaaactagagaagagattgggaaattggggacctggtagtctttctcatgctgggagagctgtgcagattaatgcttgtatgtcctctattccttcttatgctatggggttctatcttcttcctgaaggggtgcatcagaggtttgacaagataagagggaggtattactgggctggtaacaaattgaaaggtaaatatcacatggtcaaatgggaagacatggcttttcctaaggactttggggggcttggttttactgaaacaaggaggatgaatgcagctctgctggccaagtggattattaagttggaatccaatgatcagagtttatgccttcaggtgctgaggggaaagtatatgtaggaaggtggtatgtttcagtgtaaatctgggaatggttctcaattttgaaagggtttgttgaatattagaaagtgagtgcagcttggtgctgaatgggttctgggatgtgggaatcatatctatttctaggaggatttctggttacacaattgtcccttgtgagttatgtatccaaatattttcaaaatttgtaatcaacagaaggtgctggttgcacangtcattcagagaggtgtggagtgtctcactttangaggtcctttggccctatagaaagtgtagaatgggacaacctgaaaaatgacatagagaatgtgaatttgagtaatgagcctgacaagccgatttggggtttagcctctaacagaagattctctaccagatcactatatagagctttaacttttagaggtattagagaggtgaactcagagttgtgggctgccccctgcccaatgaaaatcaagcacttcctctggcttgctctaaaagatagaattcaatctgcagagaacctgaaaaagaggggttaggagggttttgaattctgtcaactttgtgggcaaattgagactactagtcatattctttttaactgtggcatggctaggatggtttggtgcatttgtagagatgctttgggatggggttccatccctcgaaattttgatgagttctttctattatgccaatgtgactgtaacccatcttctatgcatctgtttatgagtttgcttgcggctgtttcctggaatctttggctaactagaaacaatatggttttcagagataagatcttgtactccccactaactgtcacagcctgatttttcgttttaggatttataaattatttaataaattattaatagaatttatattaaatgttctttaatttacaagtgaagttaaatgtgggaaataaaattttctaaatataaagcatggatggatttaatttttaaattctccatgattaattatactctctgaaattttctcagatttttcggagctcaattcctaaatgatacaaaggacagttcagtaattagttaatcaataatcattaatgatttaattataattatgttaagtgcttttcttgtttaaaaatccttaaattacaaattgttgtttaattggaattagtagaaatgatcttaaaagcttaaaagaaaagatctaattttaatttgttaaattctaagataaaagtgggctagataaaatttcattaaatactttacttgattctatagttcctaaatttttctgggatttatttgagccaaggaagtatttttaataaatggaattgcatttcatgaataatttaaattgaaaaaggttttaaaatctccctttttgttttgggccgaaagtcggcccaaaagccctctctctctccccggcccaagttagcccaccagccgagccgccgctcgcgcgcgcgctctcgctcgctgacaggtggggcccacctgtcaggaccttcttcctcctcgcgccgtcgcccggccgagctctagccgagccgcgccgccgtctccttccaaatttggtcgcacctttcctgctccggccaaatcatttgaggggaaataatccccttgatctcctctatcttttcctctatagaaacttcggataaaatcgtttggaaaccgatggatttgagctcgattcggattcgtctctctcctctaaccctaacctttccatcgccgtcgccggtcgctatgggcctccgtcgccgcctcctagcccctataaaagcatccccgggacctcctccgtccgccgccaccctcgccttagcccgccgccgtctgtagcgccgcctccgcgtgagatcttgcgccgccgtcgccgccgtttgtccagccgtgcgtcgccgtcgctccggtcgtcgtcgtcgctcgggaaggccgccgtcgtgatcgccaagtcgtcgccgtcctcgtccacccctccgtttccaccgaggatcgccggagcatcgccgtcgtcgtcaagccgatcgtcgccgccgcttcatcctcgtcgccgtcgtcgtccggttgtcgtccgccgccgttcgtttctcggtaaggttcgccgcgtcgcccactacccgttggtgtcctccgtttgcgccgctgcgccgtcgttcgccggcgagcatgcaaggctgagccgccgccgggtgatgacgtcaccgctgacgtcatcgacgccgtccgccgtagaccacggtagaccgagttgatctcggccgtccgttttggataggatagatttcggccggccgttccgtagaccatcgccgtgcactcggtccaccgtgagccgagcccactgacgcaataattcccttttccgtttcaaaaataattctttattgcgtcataattcaattaaaatccatataaatgttttaatccggtttaatctttaaaaattcataactaattcatattagctcggttttagttggttcaagtctctaaagttgtataaaataaagatctacatattaaaattatccataaattgaattaaatttatttaatcctttttaaataggctttaattagattaaatcttgtaaaattcgtaattatttcatatgaagtcagaatgagcccgttcaagtctcataattcatctaaaatcatgatctacacatttgtttactttatatgtattgtttatttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcccaaacacagttcctttgagcatgctgatcctatatttaaattctctatttatttcaactgtgcatttattttttaatgtcatcgggctctgtagacccccgtttttataacaggaatcaatcgtgtaaacagtaccatttccctggatcaagtagtctggtacacacgagttcatagccgagataccaaatgcacatacacgagagtctagtgcgaattattacaacataagtctgcaggcgtagtcttaaatcatcagaccgatgtcacatcctgattttttcgtttcaggatttataaattatttaataaattattaatagaatttatattaaatgttctttaatttacaagaaaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattatttttgttaagagcttttcttgtttaaaaatccttaaattataaattgttgtttaaaaggaattgttagaaatgattttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcagcccaagtcggcccagtccgccgagccgccgctctcctctctctctcagccgctgacaggtgggtcccacttgtcagggtcgtcgtcctcctcgcgccgccgccgccgcctgaaaccctagcgcgagccgccgccgtctccttccaaattcggccgatcctttacttctccggccgaatctttagaggggaaatgatccttgagatctcctcttccttttctcttttggaatcatcggctaaaatcgtttggaaattcgtggattcgagttcgattcggatcagcctctttcctccgaatccccgatctttccatcccgccgccggtcgccgtgggccttcgccgtcgccttccaacccctttaaaaggacccccggtgtctcctctacccgccgcctctctcgccttcgcctaccgtcgtgtgtagcaccctagcctcgtgagcttttgcgccgccgtcgtcgccgctgctccagccgtgtgccgccgccgtttcagctatcgccgtcgctcgggaaggtcgtcatcgtggtcgccgtcgggatcgccaagtcgtcgccgtcctcgtccgcccctttgccgccgccggagaccgctggagcaccgtcgccgccgtcgacccgatcttctccgccgctttgacctcgtcgccgtcgccgtccgttggtcttccgccgctcctttggtcaccggtgagttcgtcgtgccgtccgcttcgtcccggtgccttccgttcacgccgtcgcgccgtcgttcgccggcgagcgtgcgccgtccgagctgccgagccgcccgagccgccgccgccggtggtgacgtcatcgctgacgtcatcgtcgccgtctcccgtgagccgccgtggacccgatcgatctcggccgtccgttttggatagggttgatcttggccgtccgttcccgtgaactgtcgtcgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattatccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcgttttgcgtgatagttagtcgtttccgtcgttgtgaaggttcgcgagtgcgccggaagtattcaagaagattaattgaaggccgattattgcaaggcaagtcacacagatcctaaacacaatcctttgagcatgttgatcctatgtttaaattctctatttatttcaactgtgcatttattttcgaatgtcactgggtggtgtgaacctattcctttgttatggcctgttttcattgattactttattccttgataccttgggtgattataattggactagttgagctttatatatattggttcaactagatattagatataattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcactggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaacaatcaatcaacctcagttgaagacaagttgcgaaggagaagacgtttggcttataccccagttgagctgcctgtgggagtggagccggagcttcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaaccgagcagtccggaatacatcccacagcagaaatagataaagcagcggcatgccattgccacaggcaacgaccgtaactaagacctattgagcgccatcgtctgcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttctaattcttttcacaagcctaagacctagcattgactgatcaaattttagtactagtgtttatatttaaacaacgatggttctgtccaccatccattgtgatcccaaggatagcttcccgccattgagtcgtcatggttttctgaggacgtccaccttcccccttctcaggaagtggctccaacagcataaaattcatcatgcaataacccttcctacacaagttaagaatttagagtctagcccaggtttaatacatgtcccggtgctaatacccgcaagcacggttaatcgaataaatttgttttactcacactgcagtggatgtacactttacccacactccgggactgcccaacacatgagcctcgtcccaacacatgaaacgtatcacggcaaagcttttcgataacctcgcattggcagtacccgctccatgaacttttcatcctcatgcactctaggtgtacacagtttctagcagtgagaggagttctggcgcaccgggaagggaagactcacacacatgcattaagttataattatgtttaaattatcacatggcagtcctaccaatggtgacaccactgtagagcccctgccttacacatcaagaaaccactatgcatggatactgcctccgctcagctatttactctgctaggtctatccccatacgagaagtgtggttgtacggggtcgtttcatgcttaactttatggctcggtcctcaattgaccggggacggtactagcctttcccagataccacccaatcttaccgtcggtcccagtctaaaacaagtgtttaatttcatttctattttcacaattcatgtcatcatatcatggcaatgtggcgctcatgtttccacatgccgcatctcaattaccttcccaaaggtaattgcccaagcatatagtatttgataaaatatgagcatgcatgaatctaaaatagcatttctaagcaattgtcatagttgactaggggctcgtacgtatctatggttacaaagatttaaaggtgaacaataatcaaggcatggcatatttcacaagtgggatgttcatcattgcatgcaatcttatttgtaaacaaaataaattttgcaatcgggatcaacatgctcaaagaatagtgatgacttgccttgctcaatgtcttgcgggtcttgaccttcgctcggatccgcaactccctcgggctctacaagtacgtgcgaagaattgatttgaattccattagaattcaaataaaatccaataaagaccaaattgaaaaacgagcgcgagtggcgaattctatatcaactatattattcgtgaaataggactattcctcaacctatgatattttgtgtctcctaagtaaattcctaagaattcaacatatttatttagcgcttaaataaatctaatttcttaccgcaaattaattactcatagagattaccaaaatataatttaattttgcaattttacgactataattaatctatacttaaataattaattattttaaattttctatttttattaacctccctatcctatttctcttttttttctttctttttctctcctctcattctttttctttctttttctctcctctctttttccttccctttttattttctttcttcctcctctcccttccggcttctccctttctctctctctcggctttttgcccaccagggcggcggcggcaatggacgcgagggggggggggggggaaaacggctcaccggcggcggcggcccaaggcggcaacgctcggtaccacacctggcgcggcgcggtggcttcgaggcgacggcgcggcgcatgaaggcggcggcgcggcgcacaacggcggcggcccatggagaaggaggagaagggggaaaatggaaaggatgggtgtggggtggaaaaggggaggggccgggttttataagggcgtgggggaggggcggacggcctcatggcgacgcgacaggcggtgcgcggtgtggctggcggcgatggcgacgggcgggcggcgcggcgcggggctcggcgcgacggcgacggcgatgcaacgatgacgggcgagcggcgcggcagggtgcggggcgcgaggcggcgacgcgacgggcgagcggcgcgcggggcgcgtggcgcgaggcggcgacgcgacgggcgagcggcgataggacggccgacggcgacggcgcggcagcggcggcacggggcgcgagataacgcgacggcgacggcgacggcgatgacacgcggcgacgggcggcgacgtgacggcggcgcggggctcgaggcgatggaacggcagcgcggggctcggggcggccacgcgcggggcagagtgggaggggggttagggctagtgacctcaatcgaacacctttggggcaatgaacagtgacttttcctatttttccaacttggttgtttttcctattcaaatcttgtcccaatatttctaatttttgctcaaatcaagtttacacaatatttgtgttgctctaacctagattatcactacccatattttatttttatttttatttttaatttattcgaatttaattagggttaattcttattccatcgcacctaaatttaattgttaccaatatggccgcgataatattttatttatttccaacctcacctaatctatattttaattagttattttgccaatttaattttagtgtttattcctaattaattattccttattcgcgatcggtaaactttgaaaccaaattccaataaaataggcaaataaaatcagcatgatgcaatttattaaaaagtttttgaagggcccatatttttagagttttgattttcgttggttgaattttcaggatgttacaaacctaccccccttaaataaatctcgttccgagatttcttaccggtcttcgaacagatgcgggtattctgtcttcaagaattcttcactttcccaagtggctttatcctcagtgtgattactcaattgtaccttgtacatatgccacactttggccctagtcctcttttctacttcatccagtatccgaactggatgctctgggtacgtgagatcattgctaatatgaatttcctccaacggagcttgctcctccggcactcgcaagcacttctttaattgggacacatggaagactggatgcacatcggcgatgttttctggtagctgtagctgatatgcaacttctcctcgtctagccgtgatttgaaagggtcccacatatcttggcgctagttttcctttgaccttaaaccttttcgttcccctcatcggagaaacctttagataaacataatctccttctttaaattccaggtttcttcttcaggtgtcggcgtaactcttctgtcgtgattgagccacttttagacggtctcgaatcaggcgaaccttctcttcggcctctttgataatgtcgggtccaaataccgcacgttcacctgtctcgaccacattagtggagttcgacatcgttgaccaaacaatgcctcattgggtgacatctttaggcttgcttgaaagctgttgttgtaggagaattcggcgtagggcaaacatctctcccattctttgctaaaatccaatgcacaagctctcagcatgtcttccaggacctggtttgtcctttccgtttggccatccatctgcggatgataagctgtgctaaaagcaagataacttcctagggcttcatgtactttttcccagaaatgcgaggtaaactgtgtgcctcgatcagatataatccttttaggcacaccatgaagacacactatcctggtcatgtacaactcggcgagtttagcactattatagtttgtcttgacgggaatgaatcttgccgtcttggtgagtcgatccacaatcacccagatggaatcataccctgttgtggtcttgggcaacccaactatgaaatccatacctatctcatcccatttccattcgggaatcctaaggggttgcaacaaacctgccggcctctggtgctcagccttcaccatctggcatacgtcgcagagcgctacgtattcggtcacatctctcttcatgtggggccaccagtaaccctccttcagatccggtacattttggtacttccggggtgtaatgaatatgccgattcgtgagcctcctttaggattaatcctctcagtccaccctgttcgggtacatagatcctctttttgtaccatagaacacctttttcatcggttgaaaattcctttgcacatcctgcagctaggcgtcccttcacctctcggatttcctcgttgtccttctgggcttcttctatttgggttctcaaaagaggttgaacgtccagggtgtttatctatccatgaggtactatatgtaggtttagttgagccatctcctccttaagctcaggaaccatcccttccgtcctcagatgatggcaatggctcttccgactcaaagcatcggccacaacgtttgccttgccggggtgatagtgaacctctagatcgtagtccttgattaattccagccatcgccttagcctcaagttgagatctgactgggtgaaaatatacttcagactcttgtggtcagtgtagatatcgcaatggtttccaatcagatagtgtctccaaatctttagcgcatgaaccacagctgcgagttctaggtcatgggtggggtagttttcctcgtgtggtcgcaattgtcgtgacgcataggccacaacctttctgtcctgcatcagtactcctcctagtccttgccttgatgcatcacaatatataacaaagtctttcctgatgtcgggaagaactagaataggcgccgaggtcagcttttctttgagctgctcaaagctttcctgacactgttctgaccacacaaacttcttttccttcttgagtagttgtgtcatcggtcgggctatcttagagaacccctcaatgaaccttcggtagtatccggccaagcctagaaaactccgaatttcagtcacagacttgggtgctttccatttcgtaacagcctccactttagcaggatccactgctactccaccggctgagatcacgtggcctagaaaagcaacttccttcaaccagaactcacatttgctaaattttgcatataacttatgctttcgagtttctcgagtaccaatcgcaagtgctccacatgctcttcctcatccttggagtagattaaaatatcatcgatgaatactaccacaaatttgtccaagtaatccatgaacactttgttcataagattcataaagtatgccggggcgttggttaatccaaatgacattactgtgaactcatacaatccatagcgcgttgagaacgtggtcttgggtatatccccggtcctaattttcagttggtgatatcctgatcggaggtcgatcttagagaacaccttagctcctttaagttgatcgaagagatcatcaatccgtggtagtggatacttattcttgatagttacttcgttcagtgaacggtagtctacacacatcctaatgcaaccatctttcttcttaacgaatagcactggggctccccaaggtgacgaactggggcgtacaaatcctttttcttgcaactctctgatttgcttcttaagttcctccaactcattgactggcatccgatatggtctcttggatatgggagcagttccgggtatcaggtcaataataaactctatgtcacgatctggtggcatcccaggtaaatcctctggaaacacatcaggaaatcgttgcactacaggcattcctttcatgggtagcatggtgaatatgcctccggcatgttcggccagtctaggatcttgatccatagttgttctcatatccgatccccaggggtggtcaaggtaacttttctacgcctacagtcgattacccctctgttctttgttaaccaatccatacccaatatgacatccagggtctgaggtatcaaaaccataaggttggagggaaacacaacatccctaaggcgaatatgtacgtctatgcaagcatgactcacagttatctcgccctcaggtgagtgtaatatcataggctttctaagtcccactagggttaagttgtgcttttgactagccttcagagatatgaatgaatgcgatgcaccagaatcgaagagaactttaaccggggtagaattgatagaaaacatacccattagtatgccctg

SEQ ID NO: 41254 - DNA, 1049 bp, Oryza sativa
cagccatccattgcctcaccaagttggccttcctaattatgtagtcctctttgtagatgctaaggtataacagacatgctttcaaacaatgaggaagattattgtaaataaggttgagtacttgcctcatcccctgcaaagtaggatttttcttcaaattggaagtagtcaatgatttttgtatgtgattccattgctgcattccatctaacagctggcttttaaaatgtctggctgttatagttattgctagtggcaagccaccacatttttttatcatgtcatgagaaacttcagtaagatgtccaggaaattcatttccttggccaacaactccactgaaaaacaattgacttgagacatcatcacccagtggatcaatcttaataatgtgctctgagttatatccacagcatgccaaagctacaggttcaatttctgttgttattagtattctactgcaactattattatcaggcaaaccacggctaacaatatcccacattgatgaagcccataaatcttcaattatgatgaagtacctgcagaacatttagtacttcgtaaacattaaacttctaatgtacgaaaaaataaatcatatttaaaaagctatacgtgggatagcatgctgaatttaaaaagttgagtgcaatttcattttatcaactttgcaaacatggtgaagacatgttctatatcttgtaaatttcagaaattaaatttaaccacatatctaagagcaagtttaatagtatagccgactactagctccaaatcatctagagccaaatagccaattcatacaatagttgcttactatactattaatacttggtcctacctgtcatacacacattacgtcttagagtccgtgctgcagctggctacagatctgtaggctgctgctcttctctctcttcctatatctctttaaaatatgtttatagctagcttataacctgctattgtacctgttcttagacatggaaaaagacacgtactcctaagcaaatactctctcatgtttttaatgtttgatgtcaaac

SEQ ID NO: 41255 - DNA, 1630 bp, Oryza sativa
atggccattctgtatagtatctgaattcccgtaaaaaaatattgtatctgaatttgtgtttttatatctcaatgtataagttgagtttgaacctagtatttcgtagagtggtatatgtattatatgaatattatcatttttttaaaaaaaatggtaactattttatatggtgtataagtttgagttggaacttaatattttgtagagcggtatatgtatattatatgaatattatcaatttattaaaaaaaattggtaactatttatatggtttttaaaggaggttgctagtgggcgggtgatcgcttccctctcctcctagcgatcacccatccctcctcctaatacttatctttcatctctcttttttacttttttattacatcataaatttaaaaaaaatagtaaaagaaaattaggaaaaaaatctaatactctcattcatgtgcatagactttataccgtaaactttgcatgcataaactttgtgtatagaaatattttatatataaaatatttgaatccgaatttgaatttgaattggatacataaacttttaacttataaacattcgttgtaaaaactttaaatggataaactttagatgtgtaaactttaggtgtataaattttaggtgtataaacttactaaaagaggaaaatataaaatatttgaattcgaatttgaatttgaatcgggtatataaacttttaacttataaacattcgctttacaaattttagatggataaactttagatgtgtaaactttatgtgtataaacttactaaaagagaaaaagaaaaaaaaaacgatcgccgacagcaatcgatcgcccgttagcctttccacgtcaggtgagcttgcttgctttccgaaaatgctgagctctgaccataccttgcaatgcattaattttatactagtaggattttagttcaaatcccttaaaattaccacgaatttctccgttccaaaggaggctttacatagggaaatttcggtactacagctggtataggaagccaagccacgaacattctcagtgaatacatgatacattagcacgcaacacgatatttgcattgacaggaattcagagatcagaacagagcaaggtgcaacgcagctgaggagaatgaaatattgaaaaggaacttgcgagttaggaccaagcacaccattgtgtgtacaatctatggttttgatttaacctttgttcatgtatatcaaagagagtatctgctttgctcttcaacagttccaatggaggggaacattcacatctgtgaggtgatatgtatgtatataacggacagaaacgagaaaaaaaatgaaatgtacatggctatatctagctggatgaatatggggaaaaaatgaacatatagaaaagaatgcaacagagagaaaaactttcttttgtcaggcttctcacttttcaactgttactagtatgacattatttggaccagatcttggcagagcagcttctcatgatcctggacgctaccaagttcaggaaggcatcattcacactaggatggcaaacaaaaagaggagcagcaggacagttatgttattggcacaacagcatccagattcctctgcagcagccagccaattgggta

SEQ ID NO: 41256 - DNA, 750 bp, Oryza sativa
ggaacaaggacttcctcccacacatggagcgcgtcatcgccaacggcggcgcagacacgccccccaccatcacccgcctcaccccggtacgacgaagccccagacctcactcatctctaatcgcgcgcgtatgattgtgcctatctgctccgatctagtgactgaactagttgcatccgtggcatcgtttgtttcgaaattccaaatcgagcgtagaattttgcctgcactggatgctggtctattgtttctaaagtagcaaatcgtttgagcaggtggatgaggactcggaatcagggttcctaagcatcaaccgcgcaatgagcctcgacaggttactctttcacctcaccctcctatcgaattctctgctcacatttggtgttgcgactgtttagtgacctgtggtttctattgcagtgtggatgttgatctgagcaaggagcttcaggcgccaaccaggccaatcttgaaaacccaggttgaggctgcctggagggggcgggccattggagctgaggtgacagcctgtgatctcattgttcaaatatcttccctttgttatggtgtaccagagatggtgctaagctatggtttgtggatttcgtacgtaggctgtcaacgggtgttgcgtctcctagatggaggctagttccgactcgccgggaacaagcaaagtgggaccgagcagctaaggcagcaactggtggcagtgtaagtcactgtaatcttgtcactgattattggtaa

SEQ ID NO: 41257 - DNA, 4833 bp, Oryza sativa
gataagatgaatgccaaaaacacataggagcacttttggtgttaatgcctgtgcataatggaaaaacacaagggaatgataacatggcggaatgctaatcaactaggtaaaaaaagccccttgatactccaacatagccatatcatagattagagagtaatgaccaaccgtttctagatccatgttttcatctctgaagcatcctctagtcaattgggagataagcatctgagaataagcaaatgtgagtgcacaagtgaaggttgaagaaataaatttataaggattcacacattctgttgctctctgtcagggcggttgaagcttctttgcgaaccccttctgcttggaattggagtcagaacattgatactgtgaactggtgagtgccggccaaatgaatacaagtgtgccattgaacggtccctttggctctgagaagaacaatattacacctcttaataaaaaatgattggatgaagcttcagataaataatggaagtaattaagacatgggatgccatagcccaataggccaccataagcacaagatagaaatacaagtaaagaatataagattacgaacaacagttgataatcaagtgtttttggtcttatgttttatcaagaacaacagtggataattaagtgcttttggtcttaagttttgctatctgaatttgttttacacaccattgctacgtttttatgcttgcagacagatatgattgtcatgcctttttatctcaatgtttaattagcaagaagtaattggcacttgcagctaatttacttgcaaggcgccaagtttctcaatgaaaataagcgtggtagctgtagttttcaataatgtcagacatggttatcacttattaggatcaacataatagtcataactgaaaccatggcattattcataaagatgaaaacaaaattgttgcaggccataggtgattttcacaacggatgcatcaagccacaatgacaacttacagagctagattggccctctctgacagcatttctagcgtgttccacatcttcctcttgcaatgtccaggctagtgttgtatcaacctgccagattccaggaataagcgagtttttaaaaatgagaagaaaaattcaacattcacaagatggccaactgaagattgggtggggaggttaaaccactcgtgaccaggcaattggcatattctcaaagtaataagtccgtcatttcttaagttagtactgaataatcagaagaaaccacaatcatcacgtagagacaacaaaaccaactactcctataacaaacaaatgatttaaattggcaccaggatagcaagattgagaagtaaccatgagtaacaacctcttctaagttttgcgagcctggctgctccttgtttaactgctcctgaagcctgcgtgcaaactcctcatcggattcaatttgtctggttcttaactgattctcatcaagaagtgggtagttgagccccttgatcctcgatagccatgtggagctaccatcttccatggaaacatcaccagctccagtaacttcattagtggctacagagcttggttcatgcattggaacctcatcttctctcttgccattgtcccgcgaatgcgacagtttgtcgacagcaggatcagcgggcctcgcaccaagaatccccttccacttgtcatccggcgtgccggaaccactgtgaagcagcccgtgctgtccatgtccctcctgcaaccccttgctgtctgattcatcctgaggcgcggagattgatccgccatttcccccatctccaggcttgctttcgcctcccgctcccaatgtacagccacgggagccgatcaaaggatcaacaggcgccgacaccgctctctccagcatctccccctcgccgaccttctccttgcccttcttcacttcctggctcggcggcggatgcggatgcggatgccgatgcagcagcctcgccatcctctcccgctcgaggaagctctccgactcggttcttggatccgcctcgcaggcagcgcgcttccgatcgggcgagtgcacgcgcgcctcgtcctcttcctcggactcggagtcggacgagaccagatcaaccacctccattccctgcaaacaaacaaacaaaaaagagaaaacattcaagcacagccatgacgaggggaacatgccagtgagatcagcagcatcatccaatccaataatcattttatttattattcgaggtacttaaaaccgaagtaaaatgagggatttgaattgacacgtacaccgcgaacctctttttcttcccctcctccccgcttttccctcgctcgcccgtgcacaccccacccctcgcgctgccgcgtcgccggccgccgacccgcccctgctcgccgcggcccaggtcgccgaccgcctctgctttattgcgccgtcggggtacgtgtcgctccttcgcgtctcgctcgcggaggaatctggggatgggggcggcgtgagagaggggttcctctccggtggaagccggggggagacgtggcagagagggagaggaaaaatagaagggagcaacagaagcgttagaggcagggccaagggaggcccagaaaaccggggacaaagaggaagaagggtattacggactattcacttcgagatttcgtacttagaaataaaagagaaaatggaaatacgtgaataatggtagggcctacaattttcatacacatagtactccctgtgtaaacaaaaggccaactgataaggatgaaacatattgcatttttttaacaaaggagcgtggagacatgtgaatggaaaaaaaacgcaaatagtttgtcggaaagaaaattttgattttaattcctcatttctctagcaagaaaaggagagaaggtaatattattttgccaatctaggcaaaatttagtaggctaccataactgatggagaaataatcatcggaagagggtgtcgtgttttaaagggactagagatcataaagagagaaaatgttcttgaacttgagatgaatgagtttggctcgaaaaaataatgaagaaggattatatataggtgagggaggaaggacagacatgcaaaaattgtactaatattatttccttctaataattagattatctcacctttgccttttggaggttttgttttctcgaaatagctattgtgcgcctcatttgtggcaacagtggcgattagcctccttgatggatgaggatggtgattcttcttctccttctctagtgatagcaataggcggtgatgaatctaacaagctaaaatttttatgttggagttaaaagaaacatagattaggcgtttggaggaacgactaaggtagcatgccaccggtaatgttgttgaatccgtcgggaaaaatggtgggacaaggcaaggcaacaaattcaaaggtataccatggtggtgagacaagaacaatgatattatagagataaacggtgcaaaagaaaacaggaagaaagaaaaggcacaagaaaagatgtggtcaagtgttgacgaattgtgttgcactagagcaacaacaaaacaatggtaagaagaatcgccacaatggtgggggtaggtggagtggtggctagggtttgagaagaagggaaggggatcgattttatatggattgtggggttagaagagtcaccgcaatagctaggagagggagtggcggctagggtttgttgggaaaaggaaggcatgattaaaggggatcaattttatatggattatggtgaagatgttttcacataattaaaatttaaaatatttaaacttattcaatttaaacttacggatgtccgtaaatttaaaaaattaaatgcatatatgattatagtattttcataatcttataaacttattttaatataaaacaaagtaatacctcaaggatcataaatcacaaattcgagtcttatccccaataggaattaggattttgtgaatggataaggggatagttatccatccaaatgtaatataacttagtcctatgaatctagacatatatctcatgcagtcttagttactactccctccgtactcgtaaaaaaagtcgttttggacaatgtttaaatcaaaccttgggaatataaatcgtgaataactctcaagttgttaagtttgaaaatgaaaaattatatgaatagatttgtcttgaaaaatacttttataaaagtatacatatatcacgtttcaataaatattgttatagaaacaacaagtcaaaattgtgttttggagacagtgtcgctgtccaaaacgatttcctttacgagtacagagggagtatattttagaatagagtgaataatgcactaaattaataatgttagtttcttggacttggttattgtttaatactcagtttcaactttcaacacaccgttcaaaattggcttcgtaccaacatggatttttaacactttggccctttatgaaaaattatttcacaaatagaaccacggataaacttgttcaaggaattatcctttttgtaggcactagtgaccttggtgtcgaggtccaatgtctcagcaccaatgatagcgtcgataggcctggccttaagaagggtcgagctgtgccatcgcactgagccttcgaagtcaaggggcacaaccccatatatatatgctatggatataggagcccataggccataagaacttagatttagaaagcccaggaaagaaagatatataacttgtttgataggaatgtttttttatgcattacatttgttagaaacatcattatattatcagagttatattaaagggcccatctatcgagcttcg

SEQ ID NO: 41258 - DNA, 1890 bp, Oryza sativa
  unsure (1)..(1890): unsure at all n locations
ctacatggctgcatagttcactcttaatcattcttgcatattctgttattcatcctgcttagtgctaacaaattggttgcagtaatatatttacaattagggaacatgctaatgcactaaaaatatgtatttagctgatctgcagatgttttttttttaaaaaaaattgggtacccataccataagacaatataagccttctgagttctaaatagtatctgtttctttactatcttgtttttcaatgaggtattggactgttttatagttcaaatggtactccctcgttttttatatatgacgcttgttagttcaatattgaattaactaacgtcgtatatatataaaaaggagggagtatatccttatgttgtaagattgaaccccttaacatggtggcatgctgtgatgccccaaggtctgaactggttttaagtctataatctaaattctaaccccattttggatagagtacacactcacaccaacacacttgcactttcatcctttgtgttcgtgttcaagggttggttgataccttggactttttctgttttgagggattgataccttggacctggtaagcctgcaaaagtaggccttgtttgggaaagacccggcccatcccctgggattttagccttgccaaacaaggccacaaggtgggactaattcacaccctcatgtgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacctatacagtcttagcctttactctttggggagttttcaggctcttcagtttttataacttctcttgttcctttatttgtgctcaaaagtatttcatttatttccttgcaattgattgctgtgtaagtctcacggcagttcctttgagacattatttcactgtcctagattagttatggccttatttgatttgattccccttatggtgtgcagataatttggactggttgggtatctgttgtgttttcgtgcttgtattggatttttgttgtcttaatttttattcattggtattattgtgcttctgtttagatctgatttttgggggacaaacttcaaaatatatgatagcaagccaccatatgatggcgctaaagcatcaagtagtcgatccagtcggcgttttggaagtagaaggataagtccccaagtgtcagcaggaaactatgaagttggacaggtttcctataaatacaacctgctcaaatccagaggtcctaggagaatgtattgtgcacttgagtgcccttcaactcaagagacatgggaaaactgtctaaagacgaagttcagaaaacccacagggaacacagttctaagaaacaaagctccccgctggcatgagcacttgcagtgctggtgcttgaacttccatgggcgggtgacagttgcatctgtcaagaatttccaactagttgctgctgctgatcccaatgatcctgctagctcgaaggatgaggaaacagttctgttgcagtttggtaaggtcgatgacaatatcttcacgatggattaccggcagccactctcagcgtttcaagcctttgctatcagcctcagcagctttggtaccaagctagcttgtgaatagcaacatagtttgatgtcctcatattgccatctggttgtggttgtggatgcatgccgttgtggttgttcccggcatttttcttctttcatttctttcctttttactctggatatcaaggtactattcatatcctgttcttgtgcgggaaatgtaccattttaccaaatggattt

SEQ ID NO: 41259 - DNA, 3025 bp, Oryza sativa
cttctgtgcgaatcctgagggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaagatgtgtaaactcgtcaaatatattcataccgcaaagacataagtttaccaggttacaagcaggtatgtccattaaaagtgaggacatatgctagcatcatcacttaactaatctaccattcttattcagattgacccttcagctgaaaaaaagtagaaggatttgcaccaatctgctggctaattaaaaaaaaaggaagccagattgaagtggccttatggagagctgataagcttccagtccatattagaagtggagatcctttgtgagaccagtgaaacatctcaatatgactggttcattctgcactaacctgaccattctcgtggggatgtaacattgctacctgcattgagcttatcagccatggcaacagagtctgcaggttgggctgcagttaccactgggagagctacgctctcaactcgatcccgtggataccctaccacactagctgtttcaaacatatttccaaatggctgattatgcacgacttgtggtcccaaatgatgaaatgccatcggaccactcgctggatgctgaggcagaacagcaacaacagtagcagcacagttagaaggattcttgaatgtggcgctgtaggattggccactaccttgaacggcataggatgccacactacagtggttgggcttgcttggttgaggtgggcatgagctcaggccgtgttgctgcaatggttgtggctgctgatgctggatgttaaggtctgtcgatggaagcaaaactgtattgccttggccataaaaagaaggcatggcttcatgatgcttctgctgaggtgaagagtatggcgagtgcacaaccatgtttctcagaagtggctccgttgtagcactggcaggcttctgagaagagtatggaggatacaagacagcgacttgaggagcactttgagcctgaggagatgatgtttgctgttgaactagctgtggtggaacttgctgaatattgtattgctgcggttgcaccacaaggggctgtgttcgccatgcttgtgactcaacctgctgagcaggcagatgtagcctttggtcctggggttgagggtacaattctgtcacctggctagattctgagataggtcaactgcaaccctggcttcaggattctggatttgtgactgaataacatgtaccgcggattctgatggttcactctctgtgcacttaataggattttggctttgcatataatacacggcagcttgactcggctgctgctgatctggttgtgtgctcaaagagacaggcactagttgctgcaaaatataaccattgctgctttggactggcacagcaggagattgcattgcattaacttgctgaagtggcatgaaagcaacctcatgttttgcaacttgtgtgctgtgatcattttcccttccgaatgttgagaaagcagaggcttcatttgctctagcagggaactcatgcgctatttgaagtttggagaactcgttcggtgtctctgaaatctcatgcttatcctgcagaatctgcacagatttttgaacctgttcgccagaagaaaagatttcagtgtgttacaaaatgatctgaatctcacgagaacagcaagtcgttgaatccattgaattcaatcgtaacaacttgtgaaaaaaattgcactgactccttaagcacgagtgaaaaaagaaacaaattttgaaacgtaaatggcactgttaacaactacaaccacaagctcaagcttcaaatctgaacattgcatcaaaaagttgcaagccatggattaattaattaatttttaaacagctttattactttaccgtgcgagatggatcaatgcgagtaattcgaaaacatcgaacagtttgggtgcaagtaattccgttgaccgtgcaagaacgtgcatggatctagagccagagcacccacctgcctcagattcttctccaggcaccggagttgaccgtcccctcgctgtggtaatccatgacgtcgctgcgcagctccccgatggacctctcgagcttgtagcagtagagctccagctgcgacaggcggccgccgattccctcgagcgaatgcagcaagccctcggcctgcttcttcatgcactcctccacggccgccatgaccgcctccttggtgtagttctcctgcccaccgtacacgttcacgaacgtcctcaccatcctcttctcctgctgcaaatcctgcccccattcccccccaaacacacacgcacagcatcatcagaaaccccggacaacacagtcgggaaaccggaaaagctttcggggctcctgctacctccgggcggcggcgcgactggtcgaaggagcagcgggcggcggcggggtcggcggggaggccgaacgcgccggagacggaggcggcggcggggcgcgcgggggacgccatggtcggcgcgggcgggaggtagctagggtttttggcctggcgggaggagacgagacggtggaggtggaggaggagggagtcaggaatccgaggcggaggaaggggcgaggaaagtgagaaccgagctgggcgcggggcgcagtgtggctcactggctgtctctgtggagtggaagccaagcaccaaaaagcagagcaggagtagtagttgtagtaaaacagagagagagagagagagagagagagagaggggtaatcagatccggtgaaaaataaaaagtgtaaagtaaagag

SEQ ID NO: 41260 - DNA, 835 bp, Oryza sativa
atccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtagtcgccggccgagctccatccgcgtcgcgccgccgcctccgccgtcgccgccggtctccgtcaccaccgttaggtgcgcgggagggtggagaagcccggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcttgtcctccaaagtcgcagccgaccatccaatctccggcgaggtcgccatcttggttcggccattgatgaggtgacgtcatcatcgtttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtcttattcttcgttttgcgtgttagtttgtcgtttccgtcgttgcgaaggtttgtgagtgcgccggaagtattcaagaagattaattgaagaccgattattgcaaggcaagtcacacagatcctaaacacaatcctt

SEQ ID NO: 41261 - DNA, 3603 bp, Oryza sativa
  unsure (1)..(3603): unsure at all n locations
agacacattggtatctcgacgatgcaagccgctagagacgggaaaggttgccacgcctcagcttcgggcgaaagaagggatagggggaaggaggtcggtatggtggcccttgttggcattgtggtgccttccacgctggtgaggcagagaggtacattgatggcggtgacaagggcagtggggtgaggaataagagaagtgacatgtagggcttagagggtgttgcaagattcttaaagccatcctagtattttaaaactcgagtgatattttttcgcattttcagctaactgacaaatcgcaagcctcacctaatgcatttttctttttcatgatcctccaagatgcaaatcaatcccacttgttcttatttttactcaaatatgctaataaatttgtaatgctacgaaaccacactcggaagatttgcctcttgccctttttttttttgccgggtcggccaacgaccaatttcattaagattggaaagaaaaacaaggagaatgttacaacgacattacaatgtcgcgctagtccgggagagatcccagacccagcgtgaacaagcaaaggggaaagagggaaggtagggcaaaaccctgacaatacacaacacgattactctccaaaatgggagaagatcccagctaccctccacaccgcaatttcttcttttatatcctcggctagttgcttcggaatctttgacacatgctgaaaaattctagcattttgttcctccaaataagctagcaaattaacataaaggcgttgtcgaagtccaccctgtagctcgtcctaaaacggcgccgcgttgcaagccaccagtcgcaagcatgctgtcactgtccgccgggattgcaaagtttgcattgcaccatcttatgaacttgcgccatacttgctcttgccctcttcccccgctgctgcatgtcaccaatagagatgaaaatagagcggatacatgcggatagcatcatatcacatcggttttcgtactttagccggatatgaaaacaaatacgaatagctgggatatagacataaatatgaatgatctcgaatacaaataaggattgaataagaccagacacaatacataaacaaatatgtctcggaacacgaaatccacctaaacttctaaaatgtgtatccgtcgaaagtctaataccatatttgtattcaactattcatgtgggaaaaacatttgtatttgtatgattgtatccgtatctgtaccatcctaatgtattcaattttctcgataggctccgttttcatccctggccaccagcggtcatccaggatcatgcacgcgtttaccccccgcaacgcagccaaactcaacggcgacgcaacaagccaacaacgctcaacgcatgccttgcgagaccggcaaagccatttccatgtcgaaccagtggaattcacggcggcatgcgcgcgcgagcatcgcatgcccaagctaaatctgagggaagggaaatancatgttgcttatatttggccgcagcaatggcgcgccatcgcgcgcatgccccgtttttgcgtgcgtgtggcttccaatttgggctcgcccctccgggcgcaaacaccacaacacctcgcgcccatgngaggacgcagccatccatccatccacccagcccccacantcttngggcgcgcgcgtccgtcctcgatcgcgcgcgcgtcgacgagctaagccggcccgggaaacccaaggcccctctcccttcctcaagcgcgccggcgggcctcgccggcgcgcgacattgagctcaacccccccgtcgtagtcgcacgtcgagcgccaccaccaccgccagcgcgtcgcatcgtacgtcctccacgcgcggcgccgtgctaggcaacctcctctgctgatcgcccgcctcctcatgagcgtgtgacctgctgtcgaatggtgcggcggcacctgctgcgcggacacagcctggacaggttcctgccgatcaggagcctcatcatgtcgtccagctcttccttctcgtcgtcgttccgtcgccgccgccgccgtcgtcgtcgtcgtcacggggaagcagcaacggcaggtggtgcggcgtcagcgtggccgaggaggacgaggacgatgccgccgtttccgcgacgacgaccccgccactgccgccgctgcagaagcgggtgctgtcgaggagccacgggtccaaggccaagccgctgggcggctccgtcgaccacctgccgccggtggtgccgccatcgtcgaagaacgtccgtgacagtggaccgccttcaggtgatcaaccatatgcaaaatcacaattgctcaaatcttcttggatcaaccgcttagtttcgccattgatttgatcgatcgttcgatctctgttgcagagattgatctggtgaaggagaagttcgccaagctgctgctcggcgaggacatgtccggcaccggcaaaggtgtctcctccgctcttgctctctccaacgccatcacaaatctcgcaggtcagtatcacaccactcatcacatgctatctactacaaatctcttgtgttcttgcctgtcatgatgtttttttttcccgttcttcaccgtggcaaaatctgcagcttcggtattcggggagcagcgccggctcgagcccatgtctgccgaccggagagctcgatggaacaaggagatcgactggctgctgtcggtcaccgaccacatcgtcgagttcgtcccttcgcaacaggcgtccacggatggaaccagcatggaggtaggccatccacaagatcgttgcaacctcattactatttcatcgtgcaattcgcttcattttcgtccttgttgtcaaccaggtgatgggtacccagcagcgcagagatcttctcatcaatatcccggcattgcgaaaactcgacgccatgctccttgtaagcataatagcatatacaaatgtccaaattgatcttttccccattagttttctgaaccagcattactttgcggtggtccttttgccggtggagcaggagtatcttgacaatttcaaagatgaacaagaattctggtacgtaaaaaaagacgcagatgagggtgaaaagggcgatgcgccaagacagggcgacaagtggtggatccctacagttcgagtccctcccgagggtctgccagatgcgtcgaaaaaatggattctgcaccagaaagaccttgtagggcaggtgctgaaggcagccatggctatcaatgctgatgttcttacagagatggagatcccgggagagtacattgaaactctgcctaaggtgacttataataccattaatatttgtaaaaactcctttccatactttacgcatatcttttctcgaagtgagttcattttctgcttgatgctgagttgaacaaacttttcctggattttggaatgtagtacggtgttttcctgaaaaacattatgaggctaatctaaccgagactacttctcttgcagaatggaaggtctagtcttggagactcgatatacaaaattataactgatgatcatttcgatcccaatgagctcttaagttctgtagacttgtcgacagagcacaagatcgtcgatctcaaagaccgaattg

SEQ ID NO: 41262 - DNA, 1390 bp, Oryza sativa
gaaagtccaccgcatggtcacaaagaaacttttgcacattgagaaagttgataatttggggggtgggttgaaaagcttttctcataggtagctgtagcctgaaaaaatggtcagacagctgcatgcttggttgtgctaccggggggagcacctgtaaatagctcaaacttcagagaggctggatgggttgtattggcgatttggcggtgtaatctgctcatctcagttgagatgaaatcagtatgcatatttcacggcctcattttggttggaaaatttttgcatgaatagatcagaaattcaaaatgtgaaaccgctagtatctgaataacagaatgcacactagcatattttccttcggaatacaaaagcagacgtgcgcgcaccaacagtaacacaaagatatgcaagctacagttgctgtaaactatgcggagtataagtaattggcaagatggcccaggcattaagcctagatttatcaccatatttaccttgtaaatgaaataaccgcacagcctccttattgccatcttcgcacgctgatactaccttcttttttaatagatgacgccgttgactttttctcacatgtttaaccattcatcttattcaaaaaatttacgtaattatactttattttgttatgagttgttttatcactcatagtactttaagtgtgatttatatcttatatatttgcataaaatttttgaataagacgaatggtcaaatgtgtgagaaaaagtcaacagcgtcatctattaaaagagtattaagctgtgcagaggcagtatatgcctgttcagagaacgggcattgctgttgcgatccgatcagtttctaccataaaattctctcttcttgaccaataatccagtttactctagaagtcactgtctaagtgtcaacggaaagatcaaacctttttctggagatataaactgaagattataacttaacatgagcactgaacattactacttgattcaacagtggatacagattcaaacattatcataaagtcctcacaactaggcagctcatcgacaattttattcgcacaagtattttgcagacaaatttaaacaagattgacacgataggtccaagtgatcgctgccgttcctaagagctgaagctcttacagtgccttgaggatctcctcagcaccagagattgtgaattggccaccttcctcaatgtttgcaacagtaaccttgaggttgtcagcaaggagagcaaaccgtctcgaacgaataccaagccctttctccgaaaggtcaagctcaagaccaagtgccttggtgtatgttcccaaaccatcggcaaggaatttcacatgcttattctcagggtatgactttgcccacgccttcatgacaaaggg

SEQ ID NO: 41263 - DNA, 7804 bp, Oryza sativa
caataacagggcgagtaacaaagtaatatgacaacttaaacctctgtgatggcaaaatagaacagcgggttcttataaagggacagcaaaatgagataattggcagctagatatattaaaactgcggtgccaagtgccaacagaggatgatggcaaagggaaggataaaacatttcaagctcacaaatttatcgaaaccaaatagtacaagtaaaaaccaacagcatcagtctaatctaaagaatgaagacaaaagttagccagttaggagcacttggatatgagcactttgctctcgataaaatgtgtactctgtatttgtcagtcatgtgactcgtgtctccattttttctattcgaaatgtttgttttagttcagttagctgcatccaggtttacagattttctgtgggagattaatcaacaagaaaaggctatcagcttacgaaattctgagcgaatctccacggagtaactatagccaaaatctcccttttatatcctgccacccatcttggcttaactgcttctagcatagatgcccaaaaattataacattttctctcgcgtgctcagaagctggggaacaacacatggagtaaaccagaacagtggatcgaagtctactttttagtcatgcaactagcaatatataaacccacatcaagatttttaaccctaactctgacacccaaggaagtgggagtgacttcagagctcgtcaaatcaatcccataaattgtgagtatgtgtataataaagcagtaatcttggatttggtccggacatcagatagtacacatttcagttttgcagtaaaatttctcgatctgataaaaagaagtcccattttttaagaaatttttttttcagggaaatataatgtctccaagaaagaggggggagaggatatcgaaaaaaggagaaagacacctgcaggtcggggtgaaggcaccggggacgcaaaagaggaccctttttttcccggcggagagcctgtgcacgagacacttttgacagtttgtctctcccggtggacccactcaacttgcctgtcgggaagggtttcgcccggcaaccggggccaaggtggtttcccggaagaattttgtggtgctgcctggatgtgtggaggagaggaggaacagaggaaggagagaaggtaatcgacagggaagggagatgagtgatgatgaggagaggaatgcgaataaataaggggcccttccctccccactgattgtgatatgctttggggtttggttggttgttgggagcttcgagtgtgccgccgagtgtgaacccaaaaatttgggcggatatacgagtggtactgtactactgtgtagactttcaagtccctatcaaggtttggacactaattataaatattaaatatagattattaataaagctcattctataatcctaaactaattcgctagacgaatctataaaacctaattaatcgatgattagcctatatgatgctacagtaaacatacgctaattatagattaagtgggcttaaaaaatttgttacgtgaattagcttttatttatgtaattagttttataaggctgagtttgagaaaggggagatagagaagactgggaagatacgcaaaacgaggtgagccattagcgcatgattaattgagtattaactattttaaattttaaaaatggactaatatgatttttttaaagcaactttcctatagaatttttttaaaaaacgcaccatttaatagtttgggaagcgtgcgcgcggaaaacggaacaaactatctcccaatctcacggtggcgaacgcagcctaagtagtctatgtttaatacttcaaattcatccgatataagagtcacttgatccaaacaccaccttacactgatctcggtagattgaacggatcgtgaagttcagcgggtatactggagtttcttattattagtagaaaataaattgtgagagtacgcgattcccggatttgtcaggatatgcgcaccagaactgaatatgagaagaagaagaatcatttaccaaaacctggtacgttcgctcttgttgacactgcccgtgaggccgtttcaagttttcaacggatcgcggacttggtggatcatacgtgttcgtgcaaggaatgatcgtgccgcagtggggctcgaggaaattaaacttgtactgatgctgttttacctgacaagaaaatgaaaacaccgcagtggggctagaggaaattaaactttgtactggtgctgttttacctgacaagaaatgaaaacaccgcagtggggctagaggaaattaggctcccatcggatggcctaataagccaaagaaaaaaccaaattttaaatttttaaatttaattttttaacctactttttttttcagcattggcttttaagtcacaaagaacacatatataaatataaaaagttttatatacaaatttatttttatttctaataagccgtctggtgctgttttacttgaaagaaaaaagtacgtcgacagcaggattcgaacctgcgcaggcaaagcccaacagatttcgagtctgtctccttaaccactcggacatatcgactacttgatagtggatggaggtgacaatttatttatactctactacttagtatcaaacaattttccaacgcctatagctaacattacgtgccttggccacatcatctgcgttgctgtcctgtttgtatgcttctattggccgtaaaaatatgaagtacaaatgagaatgcaatacggctgtattttgtgaagcatataaccctagcttttcggggacggtgcgtgacattcaaaatctaaccctctattcatggaaaatgtcgttttaatcagtttcaagcccaattttcaaaaggaaaaaaaaagacccctttgaaaaaaagattaataagaaaacccaggaatgggaaggtaggtatataatgtcatgtccatcgagtttctacacgaattaaaaatataagaattttttttaaaaaaattgtagttggtatacacatatgagaaacacaaaaaagaattagagtcatgcatgggaggaagaacagatcgtagtagcattataaattattagtaaaaaatgtattgtttagagaagcgtagtacgtaaaacgtcacgtgtgtacgtaacggaagacaatggtaattttgtatggttattaaaaaacggtgaagtttttccgaatggtgaatattagttgagcttatagaagttgcacatcttctatgtaattgagaaaaacccgattatgttgcaaaaagactaaaaaatacatgtaatcttggacaaaaccaaaagaaagagatcacttgctgctagcaacaattcaattaataaatgtggtaatattaaacaatccttgctctgtagtaaatctacaaacggctgaagaagtactatactattctacgagacatgctaaggtgcttgggaatgatgacatccgttgatcggatgcaatccaacgatatgagatctatatatatgtctagaaaagcacaacaaataaaatgcgcagggtaattatcaaaaaaaaaaagagagtatattttctagataatggaatagaacattccgacctttgcttaaaagagcttcaattattacaactaggaaagaagcccgcgcatctatggatctatatatgtctagaaaagcacaaaaataaaatgcgcagggtaattgtcaaaaaaaaagagagagtatattttctagataatggaatagaacattccgacctttgcttaaaagagcttcaattattacaactaggaaagaagcccgcgcagatcattttgtttattgtttatgtcaaaagcgtttcctagattcaaacaaaaatcactgggtcccaattatatataaatttgcctaatatcgccactacttattattattattttattttattatggagacttattatcgttcttttgaaaccaaagtgattatgaccctgtttagatggaactaaaacttttaagtccctatcacatcggatgtttgaacactaattataaatattaaacttagactattaataaaactcatccataatcttggactaatttgcgagacgaatctattgagcctaattaatccatgattagcctatgtgatgctacagtaaacattttttaattatggattaaattaggcttaaaaaaattgtctcgtaaattaactttcatttatgtaattagttttgtaattagtctatatttaatactctaaattagtgtctaaatacagagactaaagttaagtccctggatccaaacaccacctatttaatagatgaaactgtatttgtaacatcaaaataagaacaatacatcgttaatcgactaaaaaaattatctccactactaacctaactgttcatgtcgatctgacttatttctaaatctatgtataaatattccaataatattttatcaaaaaaatatattataacaatatcgcttctatgagttaataggataataatgttaaaatttgatatgaatgcccatctaacggatgaagccgaacataactaccaaggctttctttctcgataccttgaaacatgggtcacatatcgacataatcgtgcccatcaagaccatcgtggataacagttttaacggctaattcactattagtaccctcataaaggattgcatcgttaattaagtacccatggtggcttaactcatccaaatgtatgcctttgctatatcatggtagtatagcaagctttattatctatgcttggcacccttttgagaatggaaaaagagaagacggaggtgattacaataatcctttttaaagattgagttgttttgtggtatatagtagacacaatttgtttatagtgtaaatcaatattactcaaatttcaataatacatatacaatattcttatttgaaagtgagtgaggttatcatgttagtagagtatatgacatacatccatcaactatgcccgacacatcggaattcctcaagtataaaaaatatatattatgggtgttacttgattgtttatttgttgccaaaactatatgacaaacaaaaaacctacatatatgaccatagttctcatgatggattaaggggttgtagtatagccatatcactcgctagaagtatttttaataaagtttatcatgtctatgtatcatgtgtgcttctcacttttcaaataccaatcaaatagttctgaaaaattcaaaaaaaatatttgagaatcgtaatatctcacatattaaaattagataagatctacttgaaaaaaatataactaaattctgttgttttcatttttcatttttacatatgtagattcaaattatttgtcaggtgatattgtacaccataattatttgaaaaattattatgatattaattattatgtgccattatgtatttatcagttagcactaactactataggtcaataatagttcatttaattaaaggaatacatcagaattattaaaattgatatatatatttaatagatgaacacttacagaccattgaattcatattacatctttgatctagtttaactgcgtatgttggttgggtaatattttttatatcatggaaaatcatagtttagagaccattgattttctctgatcatagtgtgtatgtatatttttagctatatatttatatttttacatgtgtatatgtgttactttgctttttcttacatgggagattttggtttttttttggggggggggtggattgttttttcagtagacctaatttaatggtataaaataacgggtttactaatttaaagtttgtagagtaatatattttagctctatatcatagaaaatgcaaagggtgatggtatggctcacactattttttaatttataataaaacatcaatatatagatttaaattattgatttaattgtcaagaatataaagaactaaattgatcataaaaccaacttatagttttcaaaagttaaaacatgcatggagccctccacgaagatgacactgacctaatttaaagttcgtagagtaatatattttatctctatatcatagaaaatgcaaagggtgaaggcatatatatatggctcacactattttataatttgataataaaacatcaatatatagatttaaattattgatttaattgtcaagaatataaagaactaaactgaccaaaagttaatacatgcatggagccctccacgaagatgacactgaccgtgataaccatgaaagtctacattcaatcgaagatataaatcaaatgttgtttagattttattatgctgtaatatctcaacaacctaaaaataagaagagcagataatgcatatacgtgcttgtgccgtgagctgatggtgattatcttggctgatcgtttgggctggtgcttttataattaatcttggcagtgattttttttcaatcatagttatcaatatctttggtttttatttcgttcgtacatacgtatagcttttgcctttttttcccggatgaattgtacgcaacgattttctcttgtatgtgaataggattttttttttcccggatgaattgtacgcaacgattttctcttgtatgtgaataggatttttttttaaccagatgaatcgacgcaacgattttctcttgtatgtgaataggattttttttttttgagaattacacagtacaacacagacactcacaacgcacgcgcactcacccctatgaacgcacgcacgcaaaccctactctatgacctttttcgaaaactgggccgcaaaatctggagagattgatgaagtcaccgtaggcgtctcgctgtcgacgggtacgtcgcctaccactaaaagcacaacgccgttaaatcctggaaaattcgctcccacggggagtcgaacccaggacctcaggtgctactgaagctcttgtaaccactaggctatgtgaataggatattgggagcgagagattattttttatagatttaataatttgaacgggatattaggagggagagattattttttatagatataataatttaattgtctaaaataatggtctcttagctttaagtgaaaatcgagaattaaatgttttattttaactaagaatttatattattttatttaatttattatagcgctacttagcaacgtagaagcgtttgtagagtgacacatggtgacgtgagagcgtttgtaggaaatttaatggaaaagtataacaaaataaatgataattacatatttctttagtaaataaacatatgttcaaacgccaataatattatggaggtatattaggtaaagcaaaataataaaagaaggggaataaaaaaggaaaaaagtggggtatgttacgttcttactcatatgtacgtacttgcaggcggtgagggaggcatacgtatgagggtctatttttaatctaatctaatggtgtaaaattatggacccaccaatttaaataaaattaagggccagatgtttctaatatattaaaacgccacatggcgacttaggagtgtttatagaattgctacgtgacggcttaggagcgtttgtaggaagtttaatggacttttactatataatagatagatagatagatagatagatagatagatagatagatagatagatagatgtagcactctaaaacgagcgaagttcaaataaaattaagaacaccaaactaagaagaaaaataacccatataggataagaaatacacatttattaaagtttatttgtaaatctca

SEQ ID NO: 41264 - DNA, 738 bp, Oryza sativa
ttcctgagatgatttccagcatgagtagaccaaaactgcacacgttcccagctggatcggcagacacaggctcatggtgatcaacaatgtcatcgttcttgggcatttttcctttagaaatcacttcttgccaaacactcatgtctgctacctgcgaaaaggactcggtttagaggaaagcataaacatgtagtctgatattacaactaaagtgtttgtgcaaacgaactagggagtacttcatattgctcaattgtgatgtagacaaacattttatccagtttgcttttccaaacaatgtgactctaaattgaaggtataatgtccagaaaaatggtttagaagctgaaattctgatcttacactatttcctttttgttttcatattactgaaattttggacaatcctgtgaagatctccacaaactagaacaaatacaatttgaaatttccataagcatatttgtacctttgcagctccatcctcagacaacaatatggcacttgaatgtaagtcaggatgtgtgatagaagggttcagctcatgcatgtgttggatgcagtatgctacccccataattactctcatcctaccattccaatcaatatgatcgaatccctcaactgcaaaaaggaaataaaaccaatttaatttggcataaagaacaaacattttacagtgggatcagcatttaacaggcttttaccatggagatgctcatagagtgttccattggg

SEQ ID NO: 41265 - DNA, 737 bp, Oryza sativa
cttcagtctccctaagtgtaaagctatataattcattattgtctacctcagtctccattttttctttgttgcgtatgcaggttaggttcctgaccaaaatataccaccccaacattgacaagggttgcagtcacattcctctttgttatttagtttacttcgtaatacattgtttattcattaataggtttacttttgtagcttggtaggatatgccttgacattctcaaggacaaatggagcccagcccttcagattcggacagttcttttgaggtctctcccccgttgcctgcacatgtgtattagcttttatatcctgcacaaattccttgtctgctaagctggtgtcttattacgattgacatgatttctggtgaatttgaattatttgttagcttacctgcatttagtcattttatcactgcccttgatgtgtttttccaacaaaaactcttgagcattgtcaactattggaagttaggggtatcactttgctatactaccttgtgacaacactcttttttttcagtatccaggcactcctaagtgcaccaaaccctgatgatcctctctctgataacattgcaaagcactggaaagccaatgaagcaaaagctgttgaaacaggtaaattgaagctagcaatccagttaacagtgtctcccctcacactctgattttattggttgcctgataagcgatggtctggcatttgcagcaaaagagtggactcgc

SEQ ID NO: 41266 - DNA, 1528 bp, Oryza sativa
ccaaagttgagctaaccttatctcgcgcggttggtagcgccaatcaggcgactgtcgcaagatggaggcttcagagtccagacaagaggatggattcagacctgtccgaacgtgcgagcaaacaagtgcctggtgttggactactcgtcaggctcgagagttcccaatcggctgcatgcgtaaattcattatgcgaggacatctatgtgtgtaattgacccagaaattttcacacctgtagctcttctccatgtgttctttggtataccagctgaaagtatcaaagttttgtcggaacaaccaaagagaacctaaccaagcagctgacatgctgacatgagaaaattgatatcaacatgagaaacacgggtagtgagtagcggagtaggtgatgtttaaaacgaggcgaagtgccatgcatctcaggatgacgccaattcagagttagttacttctgccgatatgcaatcccaacaaataactagcccaccaagctacatgcatacgatcacttatcctcgtagaatagtatgatgcagtgagcaaaccgatggatttgatgatcaaactttttggagcacgaaccaaatgaccaatgaccaaactctgattttcttttagataatggcatattaatatatagtactatgacgtccagggaagcatttgctgatcagaagacgccttttctacagaggtggaaacagaaaggaattctgtacagctacttataatattttgatacaaagaatcagagtgaccacttgagcttacaaggttgttgagttcatgaagtagcttgataataatatcctccttcaagcgatccccattacggttcagcagattgaaccaggacatggatgaaacattgcgtatcttgctctcctgaaaggtattgatgcaggacatcgccgccactgtgtccccttgtctcagtttcaggcaaaatctttccattatcatgggggcaggcggaactcggccatattggcacatgtagtcccatacatcttccaataactgctcctgaatagtgaaaggcagtaaggctaagaatagctacaccaaataattaacgaagcagtttaatgggaaaatgatcatatatcttgcattctatcattgtccataaaatctgaactctaagcatagttcatattgacagtaagccataaaatactgaaggaattggctcaaattgttgccaaactggggctagtactattatgctgtgcttgtagttgaaatttccttttaaatctagtgaggtttgttctctctgagggcatagaaatataagctaaaaggcccacatgtatagatttcagaactactaagatcagtcaccatgcaatcttatgatcacatacatatgggggaaaaacagcataatcaaacatcctccattcattgcaataacatgacctatgttatgaaccaaacatcttcaacttcagatatgaaagattatgcacaatgaatattctatccttataagctacatttacggagattcatggatagt

SEQ ID NO: 41267 - DNA, 1493 bp, Oryza sativa
tgttcttgacctcaacataacattgcgcaatgaacgcccagatagatttgatgaagcttcaattctgcactgagattgagatgggaaattttcatcttgctcaaattaaaaactctagattgttctatcaaactaatgttaaaattggaagtcagcaagaaaagaaataaataaaatacaggacctgtctgattttttaattctactactttccacagttgtactacttgaaatatccataagtgattttgttctgttcaatttctgtatatgtttgatgttgacacttaaatcatggcaacaaaaaattctcagagtcaaatgttctatacatttccctttatttcactgatgtaaagattgacctatgtagccagtaaactatcaataaggttccaatcaaccacctaaaacaagtgagggccatatatcaacatatcttacaaacatttttttcctaaatgaaacaaatgcacatatgctagaagaatacttgatgttatagcactagaggaatatttgatgttatagttttattacacgactttgtatttagaagcacttctaccagcccaataatgcacgcaaatgacaatgatcactattcagtatagtggaaaattgccttgaaaaaaatatggatctgttgtttttccaataattaagatagcagttcagccatggttgacttgttttctttctaaagtattctgctagacattcaacatggaaactaaaatgttactatggaccctcgcaaaaaaaaatgttactatggaccatcaccaattacattcattattttctccaatgatcgaatcattaactatcaacatagtcaacaatggataaattacaatattggaaaaggtcgagaagaaccgaatcagagaactaagaggagaaatttgacatatactcatacccttcagcttcaactttatctgataatccatacagaggactgttgggctcaagaggggaatcacatgagtcattttcggctgaatcactctcgccagcagcagagatatgcgatataaagatagccttggctgagaacgggattaattgccctggaaatcgcataagatcaactagcagttccatagagttcagtgaaacaaccacggacatgtgtttgtaggaatccacaaatccaactccaccatcatcaggtagaccctatgaaagacatgaatgcttgatttacgataaagaacatggaatatgcagaagaatgtaaaggaagtcaacataccactacaagtttactttcaagaccaacaccttttgcaagaaccttaaacaggatagctcggggtcggcatgatccatgctttatctgccctagaagttgtgaccctttgtttccaaagaaatgattatcttcagttggagatcttgcaggacttacatcaggatctaggctcttgaagcagtcaaaaacctgttccagaataacttgcaagttttaagacaaataaattcag

SEQ ID NO: 41268 - DNA, 2191 bp, Oryza sativa
  unsure (1)..(2191): unsure at all n locations
ttcccctgcttttttttgttctggctgctaaatgaccggatggatcaaaacgcaccgatccatcatctcgtgatttttcttaacctttccgtgacctgcaccgttgtggcagcaggacctccactgtgcgtccgccgtggcagcagccaattcctctggacgctcttcttctggcccgccgtcccgaccagctcaggcatgtatacaacagcccagacctgctcacggagcccgccgtcgggaaaggccacgtctcggcgtaagacacaggggtgtaggtcgtgcgatggtggcatggcggccggggaccggttcccgaccctatgcggcgtcttcccggatgtcttcaggcttcagcaacaggttatgtgacacgtcactgccgcgcccttacaccgacagtttcctcaccgtcggcgcctacgagcttgtaacggggcgtgtccaatcgtcgtcggcgcggtgggctccttcctgaggctctgctccatcgtgtactgcctcctcattggcttctgcagctacgagatgtgtacagctccggctagctcaacatcgccaggcgccagcaacaacggcggcggtggcatctctacaggaactttcttttgcatgacgtctgaaggtgagcactccaatgaccaatcacatgaagtctgatgcactaaattaaaattacgacatatacatttcattaacagtctgtaacagattcccaggggcactgatctatgaacaaatttacattttcagtttcaggtgaagcacaaagaaagctgctcttcatttggtttaaagatatacatttctcttgtagtgatccaacacaaattcagcagttccctaccttggttaacctgaatgcttcactcttgagagatgtatatgttgctaaaatatgcctgataaaaagaagtcagtaaacttacccccattctcatgcatataccatcattaaaaaatattaccgtagcgttagcacgggcacattactagtgtcttataacgttgttgcgctaggaatctgtaaatgttatccactgtttcccttgcactgttccatgcagtcatctcattaattatataggggtccatatgaacccaaccatgaaatagccatgctttgggcaattttgaatcttcattgaacaacgcaaaaaaagaagacgtgagttatctgcactcggcgaatattcaatgttacatacgacgggctaaggaatgaaataaaattaggcctaaaagattccgggtagaagctaaaagcgactaggttcattatatctaagtcacgatcaacttctaacggatcttggaaaactttaaacaatggccatttacattaaagatgttaccttcgtcgtctcgcagcgtgacggctccatgtgatgaaacatcgacgacggtatatggatccattcatttactttgaagtttcctatgtccgaaaagcttcacccgtgagttgaacaacagcacctcgtcccctgccttgaactccttgtgcttgatccgcttatcatgccatcttttggttatatctttatagatcttggcattattgtggtaggccttgtccctccattccttcagctcagagagctgcatcttcctgtgctatcggctccctttaagtccatgttccaagtccggatagcccagtgcgccctgtgttccaactctaccggaaggtgagaagtcttcccgtagacaagttggttgctaacatgccagggtgtcttataagcagccctatatgcccaaagtgcatcaggtagcttgttcttccatgccttcccatctcattaacagtcttctgcagaatattcttgatctgtttgttcactactacaaaaaccttcataggtaccggccttataggtgccggttcatttaaaaccgacacctataggccctttcccacgtccgcaagatgaaaaaaataaagaaccgacacctttacgaagtataggtgccggttcattagttaaaatcggtaccaatactataggtattggttttttaaatagaaccggcacctataatatagaaccggcccatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41269 - DNA, 4974 bp, Oryza sativa
attggtgccggctggcaaaccggcaccaattgccggttgggaaccgacaccaataggggttttttacttgtggttgcttgtttatgcctattcacttgtctggggatgatacggagtgggaatgttgtgctgagccctaagttcttgcaaaaagtttcggaaggtcttatcgatgaaatgagaccctccgtcacttatcaccatccgcggagttccaaaacaagggaagataatctcatggaacatccggcaggcgtgcttggcctctgtggccctgcatggcattccttctacccacttcgacacatagtcaacggccatcaggatatactcgcagtcataggactttgggaaaggtccaatgaagtcgatgccccatacatcaaatagcttgacttgcaggttgtatgtcagtggcatcgtatcccaagcagtgatccctccatgcttctggtaccttgtgcatcttcgaacgaattcctttgtgtcatcacacattgttggccaaaagaatccattctgccagatctttgcgtgtgtcctgaatgctccatagtgacctccatatggggtagcatgacacacttctcaatgatcttcatgccttcatctactggaacgcatctccgtagtagaccgtctgaacagactttgtaaaggtaaggtgcatcccacaagtgcctgcggctcttgtagatcaacctcttcttattctctcccggtggcacatgccccgcgaccatggagttgatgatgattgcataccacgggtcagaatctgtgactttcaacagcatgtcatctcacagatagtcatttatcggtagctcctgcatgttagtgatttgcatacgcgacaaatgatctgcaacaaaattctctaccccttttcatccttaatttgtatgtcaaattcttggagtagaagaatccacctaattagccgaggttttgcatctttttagtgagtaggtattttagtgcaacatggttagtacaaactattaccttagctcccactaaatatgacctaaatttatcaatggcaaacactatggctaggagctctttttccgttgtggcataattaagctgagctctagtaaaaattttactagcatatgtgatagcaaggtgctttttatccttagtttgcccaagaacagcgctgacagcaaaatcactagcatcacacatgatttcaatcggcagcaaccaatcagggggttggatgattggtgctgagatgagtgattttaaaggattttagacactcatcatcaaagtcaaacggggcatccttagctagcaaggtagttaggggtctagtgattttagagaaatcttttatgaaacgcctatagaaccccgcaagactcaagaagctatggactcccttgacattggcaggaggtggtaactatcgaattactacgatttttgctctgtccacctgaactccccttacggagatttgatatcctagtactattccttcacgaaccatgaagtgtcactttttccaattaagtaccaagtcgttttcctgacatctttgcaagaccctatctaagttctccagacaatgatcgaaagttttatcatagtaaaatcgtcgatcatgtcaaagaaaatagacaacatgcatctttgaaatgacgctggtgcactacacaacccaaacgacattcttcggtatgcatacattctgtatgggcacgtgaacgtgatcttactttgatcatcgggatggatggggatttggtgataaccagaatacccatcaaggaaacaaaagaaggaatggttcgctagccgctcaagcattacatcaattaaaggcagcgggaagtgatctttcttagtagccttgttgagtttcctatagtcaatacacatcctccatcacgtgacggtttgttgtgggcaactcgttgttcgagttttcaagaccatcatgcctcccttcttaggcactacttggacagggctaactgttggtatttcttacgatcacaaatagaatccgcaagcgcacggatatactgatgtagtacttcccctacggagtattccaagggtaccgaatcgaagggaacatgtgtgattaatttttcctctggttcatccaaggacaccaagcaaatgataggctaagatagagaggatttactggtgagaaatagtgtctagggaaatcttaactttaatcctagcacgatacttcaggcattggcaacccgctattcctagatgtcgctctactacgtacccggacagggacgacataagtgctcttgagggctgtcaccacctctacacctacctcaaatgtactgtgggatacacagcaattactggataaaattacctaaacaccacgtctaagcaattaatatatactttagtgtttataactcaccaaagcaatcactatattttagttgattatagtgaacaataatcccgtgtgataattaggaactaaccaagagataattctcacaaaataagtctaaattactcaggaagataattctattgatattagagtaatgaacagaagaaaagaaacaagagaagattatcgacagctccggaattcttccgacttcttctactctactctcttcgtaattctagtatacaaatagtacaatagagccttttataattcagctcaagcttgtaagcgtgtgaagaagtgaaggagtgaagctcttaaataggcaggtatgacggttgtaactactgcgaaatatctgaagtaccccacaactgctatcaggagaagatctggagtgttccagcacaacaagggattggcttttcaatgatgacaaaaatcatcactataactatatttttatcaaagttgctaccttgtgacgaacttatgattcgttgctatgtcatcactgaaattggcgtcacaaataacatagtgatgattttttttcaccacaaatactaattgtatttgtgaccaaaagtcttgtaactaatgatcataacaatagtgatagttaaatacgagatgtactagtgaccgcaacgacatcacaggtgtactcactccttccaaaactctaaaacctatttcattctttggtttttccaaaagtctaagtcctatttgtagtcattatgtgctaaattaaattgttgataggaacccaagaagccattttaatgcttattggtttggtcacatggtgaaagaattaattgctttttggtcttggtgcaaaaagaaataggactcacatttttggaaggagggagtacaagattgtgatggattatttcctcacgttttgttagtaattagtgagaatcatggtcacagttgtatgattcaataatgataaattttcatcacatattattgatatactgaaaacaatttctcacaagttaatttgttatagtgacgagattatataacgctatgaggaaattttaacttcaacaatacatctattgtgaggaaactgcattttattgtggcaatcttttcaccagataatattagcatattgcattagttttttggcaaaatttgctacaggacacttgaaaaacgtgtaattagctgagagacaccgcaaaaacgagacacggctgatgaacactacaaaaattgtgtaattggctataggacaccgaagacaatattttataatatccgggtcaaaagtggtaagaaatttttcgaaatggcaagattgcccctggctccaatcccatcttcctccacctgaaatcacaccaaaagaaaaatagcagggagaagccgccggcgaggttgtccacggcagggagcggataggagcgaccgcacgccaggagcggccgacggcgcggctgtgcgtggagcgcgagctggaggcggctgtgcgcgaggccggcgacggcagcgcggagcgtgagcaggaggtggccgtgagcgaggaggctgttgaacgttggccgatacgaggcttgctgcggccgccggtctcgccgttacacctacacatccattatcttgggtctcgcaatgccggccaaggcgaggacgccctgtctctattcgccggcaggcaatgagccggcgtgacgccgaacaaggtgaccctcctcggtgtgctgtcgcgccggactcgtcgaggaggggctccagcaactcaacgccaagccagaaccacgcatcgagcattacggctgcgtcgtcgacatgctcagccgcgccgggagactagacgaggcagaggagctcgtcgcggcaatgccaatacaccctgacgcgctcatctggggctcgctgctcgccgcatgccgcgcgcatggcaaagttgagcgcgccgagcgggtgatgcggcggcgcaccaccgacgccgatgcggacgccggcgactacgtgctgatgtcgaacacttacgcgtcgaatggccggcacggcgaggcggtgaaggtgaggaggcagatgaggaggaacgagatcgacaaggtccccggctgcagcctcatcgagatcgacggcgtcgtcaacgaattcgaagcaatcccagcaaattccatccgataaaaacacaacaagattcatcaaagaacaggttatccgagtggtcgtggttttcggtgccggagatggcgccctcgtcggcggggacgaagacgccggtctcatggtcgggcacccacgcgtcctccgggcccgccctccaccgtctcctcctccgggagcgcctccacgttcttgcggttcagtgccgcctccaccaaggttctgggattcaattgcagaaaaatttcgggccttaccgaaatgggcgaaattcggaaatttcggaattttcggacaaaatttggccgaatttgttgcaaaatttgaaccatcattagaaaatttgaggcaatttgttaacaaccaatagataaaacagaaaaaaatgaataggcaatcatacgaggatcaacacacaaggagaa

SEQ ID NO: 41270 - DNA, 3000 bp, Oryza sativa
tgcactggggggtgtgtcttgttgagtacgggggttgtactcagtcttgctcaatttttcccaaaccccaaaagaggagttcctaaaggatgaggctttggtgtctagctcgtgcctgccgtcaagcgcctgtggtcgtcgccctagtcttccgctgcttctcgtttgtctttgtgtgtgctgggccttcgtcgcctatgtaataaattaactatttacgcttccgcttgttaaactctgaattgtatcaacttttggtgtaccttgcctcctgggacaaggataatgcacgcacgtcaggaacgcccgttgggttatttccggtcgtgacaggtttaaaatcaagcaccgactcttctaataccagaaataatcccttcttcacattatagcaagatgcttgttgtgacaaatcatttgctctagaattatcatgcctagcaatatatctaatagcaaaattatcaaaattggcaataatatccaagcatgagtcaagatacctatttagtgatccgtcctagcatttgtagactctggcaacttgttgcaccaccaattctgaatcaccaaaaacttccacgtgcttatctccaaccaactccatcacttgtaagccgaataataaagcatcgtattcgggttgattatttgtacaataatacttcaaacggaccgatgcctcataacacatgccattaggtgaaaacaaaactacccctatgccttaaccatctttgcaagaagaaccatcaaaataaatctttcaaggtataacttcaactaagcaaacctcctcctcataagcaatatccacatgatggtctactaaaaaatcacatacaatttggcctctcatagattttaatggttcataagccaaatcatattcaatcaaagcatatgcccacttgccaattctcccacttagaattggcctttgtaacatgtgtttaataacatcggcttgacaagcaactatgcatgcactagataacaaataatgcctcaatttggtacaagcatagtataagcataaataaaatctctttataaagacataccttgtttcggcatccaaaagacggcggctcaaatatgtaatgatatattccttgccatcttcctcttgcgtcaaaacggcaccaatgactttgtctttggaggcaatacataaccgaaaaggctttacggttttaggcgcccgcacaacgggtgaagtagacaaatacttcttcaaccctttaaatgcctcttgttgttttgccccccaagtaaaatcggcttattttttcaagcgaagtatagggacaaaagcatcgattttacccgctaggttagaaataaatcttctcaaataattcgccttacctagcaacttttgaacttccttcttgcgtgtcagtgctttgaaatcacgaatcttctctatcttcttaggatcaatctcgactcatctctcatgcaccatgaatcctaagaacctcaccgccgacacaccaaaagcacatttaagtgggttcatcttcaaaccagaccggcgcatcctttcaaaagctaacctcaaatcggctatatgtccctccataccattcgatttgacaacaatatcatcaatatagatttctaagataatacctaacaaatcatggaagatcaaattcattgccctttgatatgttgcaccgacgttcttcgatcaaaagtcatgacaacccactcaagcaaaccaacaaatcctgggcacctaaaagccgtcttgtacatatcctcctccgccataaagatttgattgtagccggcattaccatccaaaaagctaatcaccttatgacccgagacaccattgatcatcatgtcggctataggcataggatattcatctttgggagtagctttatttaaatctctaaagtctttgcaaactctaatcttacaactcccctttttttccaccgggactatgctagaaacccattccgcataacaacgtggcctaataaacccatccttcaacaaccgatcaatctcctctttgactcggtcatatagcaaaggattaaaacgacgaggtggttgttaataaggcctaaaacctggtttgattggaagccgatgctcaacaagctcacggctaagacccgggatctcatgatactcccatgcaaagcaatccacatactccttaagtagctcgattattttaaccttataatcggctctcaaatttttatttataaatgtcggccttggcttaattccatcacctatgtctacttcctccaatggattggccgatgtaaaccctttaccaagcttctccacttcatcaaaatcttcaatagtttcaccaatatcgttctttgtagaccgatattcttgcaccctcttttgcaacaactctaaattagcttctttactcattatacaaattgatatggcctagccgtgctatacaagccggctttacagagatgcaagaatagctagagagatccatccccgacaagcattgaatattcccatgacgccactcaaaagtagcatcggtcattgcaacctcggccgatgtatcgcttgaacaatctcaacatcattgatcgtctcattgaattaaacattgatgcaaggtagaaggaacaccacaattggcatggattccaccacgacccaaaataacattgtagttacctttcacatcaacaatgaaaaaaacggttggtagggtcttgtttccacggtaaactccgccgaaaaaatacccttcgcctcggtggttcaccattgaagccaatgaaaatcatgttagtttttttcaacttattattttcacgcccattttttgaacaacgagtacggcatcaaattcacggcggcacctccatccaatagcatcctaaagacctgcttcccatcaacatgaccttttaaataaaaagggttcaagggacggttttatttaatggggtttttcaaaaccggaatcttaaggacttagtc

SEQ ID NO: 41271 - DNA, 4365 bp, Oryza sativa
  unsure (1)..(4365): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcctgatggtacaatcgaaaagtacaaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacagctgcaggctttgttgtgaacgaagctgacaaatgtgtatactatcgctatggtgggggagaaggggtgatcttgtgcttgtatgtcgatgacatactgatctttgggaccagtcttaatgtgattgaggaggtcaaagactatctgtccaagagttttgaaatgaaggatttgggagaggctgatgttattcttaacatcaaattacaaagaggagatgagggtgggattacacttgtgcaatcccactacgtggacaaggttttgagtcgctttggatatagtgactgcaagccagctcctactccttatgatcccagcgtgctattaaggaaaaatcgaagaatagcaagggatcaactgagatactctcaaatcattggttcattgatgtacttggctagcgcaacgaggcctgacatctcatttgctgtaagcaagctgagctggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagaccagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttccatgatgtgcttctcttctttcctgcatggtaggatggcttatgtcttaatgtgatccgagtggcttttccaagcagagatgttgacctgcagaacatctcagaaggaacacacctatatgagtttgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaatttataataattaaatctcaaaggcccataataaatgttgaggataataataccacctcaggatttaagcgagaaatatctcaacctaaatagggagttattagaggctcctgttgaccagttgaggtaggggtcggaatgccacacgcgcgcgcgcgcgccgggccgggccgtgggcgtgggcgagggcgagggcgaggcgaggcgtggcgtggctggctggcggtgtgcgtgcgtcacgtcacaatcctttgccagccactaacccacgttcccacgattccctccgcaacagcgcgtccacgttctttctcctgatagataangaggccgcgagtccgatccgacttcttagcttttttcccggtgttagtttctccttctccgcgcctgagttgctccgcttccccgcttctgatctcttgcgcgcacgagagattggaagaagcagtgcctccgaaaccacacctttgcctgagatctgcaccgggtaggcgggagatcaggtttttggggagtgcctcctgcacgactgctcatcgccatgtctggagttgctgctgccgccgctaccggtggaggtggtacgccgccgccgacaggagctggtgcgccgccgccgacaggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctgttctacatgatgcctctagcatgttatcgcgttactggtatgttcctgtttctgacattcatgatgcgcatagtatgctactggttatgttaagatcaccctacactgcttatgccatgatcattgtttcaatttcttggattaaaatatgccgaataatgactatatttccaacacaacctagttcatctgcataccgcttcgcttcttctttctcccatgtgtcctgttcatcttcttcccagcgccgagcacatgtcgccatgaactccaagacgccggctgatgcttgaggatacctagttgatattttttttgcaaaaattggaggataggctagagcctgatggagcctacctgctagaatcgccactggccgtcacctttagggtttgggttttgcttattctgtcaagaacagtttcgccgctagatcggtttgtaaggcccgaacttgtgagcttaatcattcatctgcaattttggttgtattcttctttgttcctatttgtgttctttgattcgcaaatagggattagccttctcggcaaggtcgtccgcgtttcaacacgggtgataaccagaggagacatggtgctgcgattgcagggctcaagagcgtgttcgttcaagaagccgaatcgatttgtgtcgcgactccacccaaatcattgattatcagaaccttccgaaagatcgaaccctagtccacgtcactttccacgcaaatagaacaattgtgctattggaatagcgatagcagaactacaatccgcatagttcagaaattcaagtgcataaggaaagatgtaatctcaccatttgtgagcacatagttagaaaataaaacttttcttgctttacccgcatgcaggccagtcatttgttatcagaatagaatgcatcaagaattcgacatacataacatgtataagaataagtgattaatagcctgtaacatgaaatatacgatgatacccagttgcccattgcagataccaaaacacataccccatggcagcttgtttaatataactgatttccaacgagacagacaaacacaagaaaatctttgttagcaatactaatggacgtgcagtgaaatagagggatttgcagtcttcaagcaggtaagagtgtggggtgcagtttgcttcaatccacattatgctacttgcaagattgcctaagaagaattcagactacatgctgaaaataataactcactgattcatcaggtcaatacattaaaatactgatggatcattaagtctacataactagctaataaa

SEQ ID NO: 41272 - DNA, 908 bp, Oryza sativa
aaaggccccaagactagaaaaaggattattattacttttccaattaaattaatcaatgaaatgatctttgaattgttaaaaataattcctatgctcaaataattccaagaaaaatcttgaacatacttggagacccaaagtatttaacaatattaaaaacagaccatttaatgattaatttaatatgtgggtaattactgaaatgctctttgtatgattaaaagttaagaattgagctccgaaacatctgagaaaatttcagagagtgtaattaatcatggagaatttaatcaaaattaaatccatccatgctttatatttaggaaattttatttcccacatttaacttcacttgtaaattaatgaacatttaatataaattctaataataatttattaaataatttataaatcctgaaacaaaaatcaggatgtgacatttgtgcataaaatcctcgtccagaaatcagctaaggtacacaaactgacaatttaatatacagattcatcaaattaactaaaacgataaatacttacttaagaggcacttagtcctcaccatgaagaaaactgcagcggaaaataaaatctagcgaagctccagctccactcccataggtagctcaactgggtataagccaaacgtcttctccttcgcaacttgtcttcaactgaggtttgattgattattgcaaggtgagcatatgacatactcagcaagccacacagcaaatatgcaagtgccccaggatacccaaaaatggcataatacagggctcatttgcaaaaacagcatttaccaaacatttgagaattgtaaaacaatagagtaattaatcatcaatattaatcaacactgaacagcacacccatgctgcacaggcccaaccatcctgaacaaccatacc

SEQ ID NO: 41273 - DNA, 1191 bp, Oryza sativa
cgaatgaggggttcgggtctctcaagtacttcatgtttgtctgtacagcaccatgcatgacttttgtggaaggagcaatgccgagtgtgcaaagattaaatctaaggttcaatgccaacgagttcaagcagtatgactctaaggagacagggttggaacacttggtcgcccttgcagagatctctgcaagaattgggggcactgatgatgatgaatcaaacaaaactgaagtggagtctgccttgaggactgcaattcgcaagcatccgacgccgagcactcttatggttgatatacaatgggtggattggatctttggtgctgaagggagagacttggatgaagatttggcacaacaagatgatcacgggtatggatttttcattctattcccaggttacaacttacaaggattattgagcttctttctttctctgccgtggcttctatctttaccttctatgcatcttcaacctgacttgatgattgtttgaaaccaattttaatggaagttaaatgttattgttgtgaccctgaatcaggttttgtatgctaccggaatcctcttcacgtcttcagagtagaggtaattttgtttcttgtcattttacagttacagttcatctacttaaggaattaatgggaggtcctatattttctcgggtacctagaaggtgtggttcctagtcttacctccttaagaaccgtagaatgttggccctaacacttggatcaaagaacgaaaggtgtatgcactatagtatcctttatatattgcacaagtcaagacatttgttaaaacacacccagtgctagtaatttgtttactgagatatgaattatcgccaaatacccatactgagcctattagtaaaatatttacgaggtgtttgaggacagcataactttcagtaaagaatttactacgtgaggtgtgtgttttaggtattgcgcatcttgggtgcattttagcgcaaacgtgtataatatatatcccatggtactaactcatgtcttaaccataattgcacaccaacacaaaacatacactactacagagataagtatcgaagaagacatgcccaccggtgcggaagggacggtgattgtgccccacacaatggagcagttcgccctccacatgagccaagccaagcaatcccacaagctcgtagtcatccagttcactac

SEQ ID NO: 41274 - DNA, 6210 bp, Oryza sativa
gagttgctccgagccaaaattcgaaggcacacagcttctccttacttcctccgttgataatgacttcttttatcgtctttgtctagtatatatatggcacttatatagttaactaggaagggcaccttgtttaatgtagctttcatttttattatgaatgttaaggatgatattatattgttgaagtatttttttactccttgtaaacatgtattggttaataacgaagtagtttggacattagttatgattttcttctgattacccttgcaacatataaactccatactaaaattattaaaaaaaatgtgtcataataatggagttggtttatatctatttgtactatgtgtgatttttttaaaatatctagcatatcagtttccaaaattttactaacaatttttcttgtatgctatcaatgactttatggatttattatagtaatgaaaaatatttttcattaaaacgtagctaatagattactttatttaagtaaaggtagacttatattggttatactacctccgtcacagcacgcatcatgaacgataaatcaaatgaaattgatgaatatacatgacaatcaaagaactaggcatagaggctgtagaggctaggtccttctcctagcctcctcctgccatgcatggcagctactgcgtccctcgatttccctgccatggcagctgtggttgtcgatgatttggcggcaatctggcgcacgaaggtcaagtatgagcaaagcggcaataaatgagtctgttcgggaagcttctagctgatatagtttctctcataattaaaaggtcccctaaataatatagctttgattctaaaaaactgtagttatttaatatagaaaataaactagaaattaatcaaacgctgggaaacttagctttttcacattctcagaaattgaccaccaaccaactacttcccgtaatcttaagcaccctaaacagacgcggtgatgacatgcgtcgcttctgcttctagccgcgtagtccgcatccccagcaacgagcaaagcggagccgagccgcgcttccacgcgtggagatcgtgcatgcggctagctgtccgtctcttcacgcaattggagccgtgcagtcgcaccataagatcccttcctcaaccacttgtcgctcatctggataagggctgctcgggtgaggtttgtagccaggtatccaccaaattgccctacgcattgtagccaatgcaattagggatggcaatttgacatgtttgcctattacccatgggtaaaaaaaaaccccccccccctaatagaattaggtttattctccatttagtacccatgggttttttattaggtcaaaacctgtacccaacgggcatacggtgtcacgcctagaaattcccgaatagaatttcaagcagaatgtgcattaaattccccgtccaggaccagccggggtacacaaacgacaatgttgacattcagatccatgtcttacaaacatcataaaagtcttacataaatgcaacggaagaaaagaaagacaacaggagctaagccttgactaaactgcagcgggaacaccactccacaggcatcctcgacggcacgcacgaagcctactcctcagagaaaccttcatctgacccgaactcgaactctggggttgggaaaagtagagcaagactgagtactacccactgtactcagcaagtcataccggaataggggtatgatgcagggaattatcaaagaagagctagagcagttcatttgcataaagcgagcatttataaacagaagttgaaagattaaaccgttgtaataattaattaatatcaactatccactgcccaacgctaacccacgttgcgacaggcccaaccatccacctaaactatccaatttcaaaagattacactagggtgagactaatcacggtgaatctggttgaccgcccataaccgcgggcacggctattcgaatagttttactctgatcagaggtgtacaactgtacccacaagacacagccccacgacacgtttccatgcgccgacatgccaccacgacatatcagaaagaggccgtgacaggacccttcgcataaccccctctagccaagcacaccacacctcaggtttcacccccgtccccagcgggcaacgggcagtcccctctcgtgcctaggtgaatccggaaacgacagaggccgtcgcagggcccgccccgctccatcacgcccacccttgcctggatgcgtcgactagatgagagctacactacaagcccagccgttgcccacgctggcttgtggtaagtacgataagttctttcagggcatcccgcgaaccggtccttaactgccatgggtgcgaccagcaaaaccatgcacccacagcccaccatgtgatttattttaattaaccaacaccaaagcggtggcactaatccaacaaaaccattagaaccaacagtctaaacattaataggattttccccattgtgaactagttgaactaagcatggctaagcaattcctagtccaaactctaatcatgttgtaaccccaagctaacaaaggagcatggtatccaaaaagcatagctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatttcgaagtacaccggagcgtcggaggagtcggaatctagcgacatacaaagcaaacaatgcaaacaggctataagactactgaaacagggaacaaaaccatttttaatggattctacacattactcttgatttactgagacttgaatgggcttaaacggagctcggatgaattagttatgaattttagaagattcactgtgtttattactataacaaaaattcttaaataatttattgcgcaatattttccagggctgacatcagcacggggaagcggcgctgacatgcggggcccaccagtcagcggctcgggagagagaggaagggcgccggcacgcggggcccactggtcagcggcggggggaaagaaaaggggcggcggcacccggctcggcttggctcaaggccggccgaccggccgcggcgacggcgcgcgcgcgaatgcgttgccggcggcgcatccggcggcggggcgacggcgcaaaacgacgcggaaacggcggcaacggatggcggcagcgaccgaaggcgacggcgagcgcgggcgacggcgacgcacgggggatcgggggaaggaaaggaaaggggtgggagtcctcaccgaatgggacggcggcgaccgtcgacgatgagccacgggaggacgacgtcggcgggcggacgagctccgagatgccctaagaaaggaaaagagagagattagagggagaggggtggtccacggcgggcggaaaccatggccgaaggcggcggtagagatggtgctcaccagagtgcgagggggtgagggctccggcgacgaacctcgacggaggaggggtgaacggggtggacctcggccgcgcgaacccaacggcgccgacggcgcggtgcggcggcaagtgtagcggcggctagaggcggccggagtagcgggagaggcggcggcggatgggcgcacggcgcgggagcaatggagggcacgggagagagcggtggaaaaagaaaatatgtggaggggagtgcgggcatgctttataggggctcgggagagacggatgtggccaaggcgctcccgatttcaccggcgacgtgggaggttgaaggtgggggagagagagagagagagagcggcgggattcaaatttgaatcccggccatctcggttgagggcgcggcgagagagagagggggagtgggtgcgggaggcgcggcgcacgcacgggcgtggccgatgtggaccggaggaggcggggtgcggcggatgggctacgtgggcgagtgcccggaggttggggaagggcccgacaggtgggccccacctgtcggcgaccccggggagaggagggaggcggccggcctggctgggcctcggcctgcggccggcccagcagggaggagggggaggaaggagagaatgggccggcggcccattcgaaaaaaggaggaaaaaaaaagggaggaaaaagaaaaagaagaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttgcacctgcattttcttggggggtcgtttataaattaaattttaggcctgggaggagaacttcggggtgtgacaaacctaccccccttaaacggaatctcggccccgagattcggaggagctggtgaagaggtgcggatgggcggctttcaactcatcctccctttcccaggttgcttcctcttctgaatgatgactccactgaactcggcaaaacctgttgaccttgtttctggttcttctttcgctggtatcaagtatacgaatcggcttctccacgtatgttaggtcctcctggatatcaatgtgtttcgaatcagcctgttcttcaggtacccttaagcacttctttaattgggacacgtggaacacgtcatggataccgatcatattggatggaagttctaactgataagcaacttctccccttcgttccaagattttgtatggtcccacgaagcgtggtgccaacttgcctttcgtctgaaaacggtgtactccccggagcggagtgacacgaagatacacgtaatctcctgcctcaaaagtgagctcccttcggcggttatccgcgtagctcttctgtcgagactgggcaatcctcaacctttccctgatgattctgactttctcttctgcttccgctaatacctctgtcccgaacagttgacgctcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcgagagcgcaagctctcaacatatcttccaagatttgattgactcgctcggtctgaccatcagtttgcgggtgataggccgtgctgaaatttaaacgggtccccaattcttcctgcagcttctgccagaattttgaggtgaactgactccctcggtcagatacaatctttttgggtactccatgtaggcacatgattctcgaaaggtaaagctccgccaaccttttgcccgtatacgtggtatgtactggtatgaagtgagcaaccttagtgagtcgatccacgactacccagatcgagtcgtgacccgacgatgtccggggcagtcccgttataaagtccatcccaatctcctcccatttccattccaggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgaccctcatgttctttttcagctctgctatttcagaatcatttacttgagctgctctgacttgatccacgagcgtaggccgtgcctccagagcggctacaaacccgtgttcaacaattcccacgttgagatgctcaaactcctgccacaattcctcacacatgccctcgatgcatagggcagtgcagtaacttttccggcttaatgcgtctgccaccacattggctttacccgggtggtagtgaatactcatgtcatagtctttgattagttccaaccatcttcgttgtcggagatttaggtccggttgggtgaagatgtatttcagactcttatggtccg

SEQ ID NO: 41275 - DNA, 2406 bp, Oryza sativa
acttctcatctttcttaagcaaatgagtcatgggtcgggcgattctggagaagttttcgatgaatcggcggtaataacctgcaagtccaagaaaacttcgaatctgcgacacggtcttcggcggggtccatttggtaactgactccacgtttgatggatcaactgccacaccctgagctgtaatgacatggcccagaaatttgacttccgtcaaccagaagtcacacttgctgaacttggcgtatagctggtgctcctttaacttctcgagtactagacggagatgttgttcatgttcttcttcggacgttgaatagataagaatgtcgtcgatgaacaccacaacaaacttgtccagaaattccattaacactttgttcatcagattcatgaagaatgcgggtgcgttggtaagtccgaacgacataaccgtgcactcatatagcccgtaccgagtggtgaaggccgtcttcggaatatcctcctcccgaattctcaactggtggtagcctgatcgcaggtctatcttagaaaacactttagctcctttcagttgatcaaacaaatcatcgattcgcggcaaaggatatttgttcttgatggtgacctcgttgagtgcgcgataatcaacgcacatcctcttcgtcttatcctttttctctacaaaaatgaccggagcaccccaaggtgaagtacttggtcgaatgtaccctttctgcagctgctcatcaacctgcttcttgacctcggctaattcgttggccgccattctgtacggtctcttgtaaattggggcggttcccggtgccaagtcaatccggaatcaatctctctcttgggtggcatggtagtgaggtcttcgaggaacacttccggatactcgcagactatgggtatatcttccaatttcctcaaattcttctccacggtgtccactgggatttctgcttcaatctgattcaaagagaccccttgctttggtgagactagtgatttgtacaccacggtttctcccttctcgttggtcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcatcggtgtgctaagttcctctcttattaacccatgcatcccaacaaacttctttgaaatgaacgaatgcgttgcaccagaatcaaaaagtactgttgcagggattgagttaatagaaaacgtacccagtacaacctctggtgctgcttgtgcctcctccgcagatgcgtggttgacacgagcctggataaaccttggcccggcacgcctaggcttcgggcatttgtcagcgaagtggccaagctcaccacagttgaagcaggaccctggttttgctccagtctccttcttggcttgcgcgggcgggcctgactgtgccggtgccattggtgggcgtggagctgcaccgcggttggactgacctccatggtggttctgactgccactggcgccctggggaaagttgctagggttgaacgggcggtgctgaccaacgatcatggtggtaggtccaccctgctgcctgggagcgaagcgcggcctttggtgacttccctgaggtgccctgaactgtgcggctttctttttcctgtccatcttggtggcgtggatctctgaccgatggcttgtcaacaacttttaaacgtcagcgtagtccccaaatttcaagtgggtgggcaacttcgtcttccaaacccgccatgaacttttcctgcttttgggcgtcggtgcggacattctctggtgcatatcgcgcgaggcgattgaactcgtggaggtactctgtcacagtcctgttgcctgatggagtgcccggaattccctcttcttttgtgccacaaccccatctggcacctgcgccttcctgaagctacggcagaactctacccaagtgacttcagtacctggtgggcgggtggccatgtgattgtcccaccaagctgacgcgggaccttgaagctggtgtgtggcgaaagcaaccttctcctgatcattgcattgcaggagattcagcttcttctctatggcatggagccagtcattcgcctccatagggttggtggtgctggagaaggtgggtggcctgacacgtagaaactctggcaacttggactgagggggagggggaccaaactgttgatgctgctgttcggcgtgctgcagcatccgctggtgcatctgctggtgctggtgctgcatcatggctgccatcatctgggtctgatgtgccattacttggactagcgt

SEQ ID NO: 41276 - DNA, 4239 bp, Oryza sativa
aagaaaaacagaagctcaaaaactaaactttattaccaaagaatttaaaccggcattggtccgaacctgattaaaacccttaaaaaaaaccagccaaaatccttattaagacagccatatcataggcacatgatatcgaccgtcgactgaccccaagcaagcaacctaaacacacaaactaacaagcagaagctagacagtcgattaactaatggaaaacgagcctaatgctcggaacggctcctgcggtcggtggagtcgaaggcgtcctcctgctcgtcaccaggtccctctgagcgactcctggagcctggcagataagtctcgccgctgcccgactctgagccactggagctgctgctgctgagatcgcggctgccactgggagtagcagacaaccaacctccgttgccactggctggacccctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgccgtcgtcgtcttgcggggtgtggtgcggatccggactcctcctggcgcgggaagaccctttaactgagcattctccctcttcaggcgcgctatctcgtccatcagagcgacgatcctcatgagcttcccatcgttcaaggccttggtcgccttgtgcaggtccgagtgcatcctatccaatccactcatcacagcacacatgtgaccaaaggtggtgtcgttctggccggttgtcggacggaaggtgctgacatcatcaccactggctcgacgagggtgaaaacggtatgccatgtcatggaagatgtagttgtggcgctcccgtagtctggccatcatcaggtatgctgcctcctgacaggcgtgatctgctgtgcctccggacgcctcaaccaccatgttagctaggcaggtacccacgtagccatggacctccaagcgaacacggtgaggaagctcgccactgagcggtggaaccgtcgtctactctggcgcgttggggtagcccaccaccagcgtcatgcgtgccaactctgccacaaaatcaatcatgccttctccgcggtggttgggtgggtgtccggccatctagagaagacaaaggagtaggatcaatgcatgctcaaatccaaatttaaataaagcaataaaagactcaaataagagaatcgaataagagcgaaattttatgcatagatcattttgcatgagtgcgaataaataagacagactcacataacgataaaataatggggaaattagatacatactaataataacaataagagctgaaataccttgcaacccatgttcctgagctaggacctaatgcatttcacccatcaaatcccaactgactaacgaataaatctcaagagttttactaaaactctagattgactcgttttgacaaatctcacttaaacgagcgaccaagatttttcccttgaaccacaagaacggatcccaattttcccggaacaaatccaattgccaagaacatatgcaatgaaaaggattcagagggcttttaggtttttccatttggcttgtcctacggtcaaggtcggctctaataccaacttgtcacgcccagaaattcccgaatagaatttcaagcagaatgtgcattaaattccccgtccaggaccagccggggtacatgtcacgcccggaaattcacaagtgatttccaaacttatttgtgcataaaatcctcgtccaggaatcagccgaggtacacaaactgacaatttaatatacagattcatcaaattaactaaaacgataagtacttacttaagaggcactaagtcctcaccaagaagaaaactgcagcggaaaataaaatctagcgaagctccggctccactcccacaggcagctcaactggggtatgagccaaacgtcttctccttcgcaacttgtcttcaactgaggttgattgattattgcaagaatgagcatatgacatactcaacaagccacacagcaaatatgcaagtgcacaaggataccaaaggatggcataatataggctcatttgcaaaagcagcatttaacaaaacatttaagagaagtaaaacagtggagtaattaatcaaaaattttaatcaacactgaacaacatgcctatgctgctcaggcccaaccattctgaaacaaccatacccggctgtacagatctaatctccaaaccaggaattatccattccaaaccggagctaagcaaattattaccagttataacatccataattattgtgagaggtgtgagactaatcacgaaaaacattgctcaactcgtccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaattatatctaatatctagttgaaccaatatatataaagctcaactagtccaattataatcacccaaggtatcaaggaataaagtaatcaatgaaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacaacggaaacgacaagctatcacgcaaaacgaggaaaaagactaataaaaaccaattaaacaatacataaaaaataaacaaacatgtagatcataattttagatgaattatgagacttgaacggcctcattctgacttcaaatgaatttattacgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaaggatttattgcatcagcggctagggtttgcggtggaccgggtgcacggcgacggttcacgggaacggacggccgagatcaaccctatccaaaacggaaggccgagatcaaacgggtccacgaccggctcacgggagacggcaacgatgacgtcagcaccggcggcggctcgggagcgcaagctcgccggcgaacgacggcgcgacaactgagaacggagggcaccaggacgtagagcgcggcgcggcgaacttaccggtgaccaaagaagcggcggaggaacaacggacggcgacggcgacgaggaagaagcggcggcggagatcgggtcgacggcggcgacggtgctccggcgatcttcggcgacggcgaagcggcggacggggacggcgacgacttggcgatcccgacggtggccttcccgagtgacgacgacgaccgtagcgacggcggcgcacggctggacgaacggcggcgacggcggcgcaaaagctcacgaggtagggcgctacacacgacggcgggcgaaggcgagagaggcggcgggtagcggagacaccgggggtccttttaaaggggcaaggaggcggcagtgaaggcccacggctgccggcgacgagaaggaa

SEQ ID NO: 41277 - DNA, 900 bp, Oryza sativa
gtgtaactatactaggttgcttgcttaatcaacttgaacaatataatggtctacgcacaccagatcagtggtaacctggttaaggtcttgtctttagtgtaacctctctccttctatcttctctaatatgcaatagatggtgaacactcgcgccagtggaagtggaaacaataacaatgaagggaacccaactcttgctcaagtcctggctcaacagactcagttaatgaacatgatgatacagcagatgcagaaccagctcaaccaagggaacaacaatgctccaccgccgcagaacaagttaactgattttcttcgtgtaaggccacctaccttttctagcactaccaacccagtagaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggaagagtttactgaaggattcaagaagacacacatacctgtaggagttgttgctttgaagaagcgtgagtttagggccttgaagcaaaaggatcataccgtggcagagtatcttcatgaattcaatggcacgttatgctccagaagatgtgcgtactgacgaggaaaggcaggagaagttcttggaaggcttaaaggatgaactgtcagttacgttaatctcccatgactatgttgattttcagcagctggttgacaaagcaattcgacttgaagacaagaagaacaggatggataaccgtaaaaggaaaatgattgtattccaggaggcacaaggtagtagccagaggcagcgtatcaagccactccaaattggtgaat

SEQ ID NO: 41278 - DNA, 1179 bp, Oryza sativa
tcctgcagccccgggcggcgccgtcatcccgaccaccagcagcacgcacgccgcgatcacggccacaacgacgccgacacgcctcgccataagtaaatcaagtgctaggcgctacagttagcttaatttcaactgcttaactacgtcgtcaggtgcgtgtgtgcgacgtcgacggcttagctagcgagcgagctactgtgtctgtgtgtaggtacgtaggcgtgtacgtcgatggatgtatgctagcctcgacgacgagctttatataggagatgatatcaggctagtgattgctcagggcgtacgtgcggtcgctcatcatatcgatcggtcgatgtggcgcgcagacggagccgtagattaacaagccctcttgtgtttaagttaatcagttcttgggatcatcgattccacgtcggttcgccacgggaactatgcctcatacgtcttggaagatctcacagattacaagttaaactggctggtaccattataccaaaagaactctggtgctattcttgtatagttttaaacagcttggtcggaaaggcaggttggatgtggggattcgatgacgcactagacgcttaatttgcgcgatcgtataactgtacctatatcggcatcacaattctctgtataaagtatgactaatgtatggactttgttagttatagtggatcttacgtggtagcaaacgaggggttggctagctggtacagtaccacacgcgggatatattagggaggcagttggttgttgaagaggactgtttgattccaaatacatgtttctttcgctattgttgccatctaatttggactaagcagcaggtagtggcctagagagaatcatggctacccgatgcaaatagcaaaagccgatgcattatctgacggagctggaggaagttttttagtccattagcataattaattgccacaaatagaagaaacagggacaagaggacaggggttggtggtacccagtacaaatgtacaatgtttctctcatattccgaaagggcaaggattaccaaatagcttattattcgcaaacaaatgataatatacatggtacaggaacaaatattgtgtaaagagaatgctcattagttgtaaatacatcagcggtaactcagcattctatcaaccatactaggtgcaaatgaaaagtctt

SEQ ID NO: 41279 - DNA, 1782 bp, Oryza sativa
ccttccttcaagaaccgacattaaccttctaaggggttgcattgccgcctccttgcacacaaggcgtatatcagagcctgaatatccttcagttttctccacaagaacatcatatgggatattcattgtgccaggaacagatggcaagagctcttcaaacatggcatgtctagcttcttgctctggtaagggaacaagaatctaattgcaagttaaggatggatttccctttttatgtggaaaaatcaagtgtggtcctatatacaaactccagtatcgcaataagaaaagatacaagaatcgagattgaattctttaacagtttttagtacaaacaataacttcagtaagaagcctatgatgtgtcagttacaactacaaatagatttaaggcaagcattggaaataggcaacatttacaactacaaatagatttaaggcaagcattggaaataggctacataaatgttcatcatcaaacattctctttactacataataagagaatcacttattctcaatctgaaattcaaatcagtagttcctcacataagaaaatgatctttggtattgttacttctggttaaacatatttgagatttgaattttttttcatggtcttcaaggtgcgattgttaccatgattttattagaataggtttataaaatctaataagtttatgagatgttggaagtactttaaaacaaatcaaagcatatcatatttatgtttttgaactaagtttttaaagttcatcgatagtcaaggtttcaaaagtttaaccagattttgtccaaaacatcaagcatttgcggacaaaacaagggagtttacctaatagcaaaactggcaattacggagtagtatttaggagcactcgtgaacaaagaaattacaagatggtttgagaaaaaaggatacacgtttctccaaacggcgcaacattgctgcatccagttcccatggcaaatttgtggcggctagaacaaaaacgagatcatctgtcttagttaacccatccatctgcagcaacaaattatcagaattcatgactgcttttatcaccatgtgaatgaaatcacacaagttcaggattattatacatatcaatttatgaaaggtttcatatactaacagaatcctgtatgttgagaaccaccaagggtcttccggctagctccacaagatggtgggctagacgacctgggttcgaagcctcaccccttctagttatttgatattagatccttccctaatattcgcgtcctttttaacagaatcccatatgctgagatatatgatatctaaagagtttgttctttgttaattttcctccatagggttatgttcacaatttagggctgagaaactcatactacttatgaagcagtgaaagtttcagcataatcactttacaaagcctcaagaatgctacctgtattaatagctcagtcttcaatcgccgactggcttcatgttcactacgagcttcaccacgttggctaataatagcatcaatctcatcgagaaaaatggtggatggtgcatgatgccttgcaagctcaaataagactttcactagtttctccgaatcacctgcaccgttgtaactattaggtagggaaaacttactaaaatatcgatagaaatggagcaaggacagaatatcatgtatggtaaggatgtgagttagaaggtataagttcgatctagtcaggtacaggttcatccatccgttattaatagcaagaaggaattatatagttccacatatctgttct

SEQ ID NO: 41280 - DNA, 2616 bp, Oryza sativa
taagtccaaaagaaatgtggcatatgctaggatccatagaatactgtcatgcacaacagtgattattgatatttttcaagctgctagtacatgaggccaaaagataactgcctgttaggggaatatagaaagaaggaaatgaaaaaaaaaaaaagaattatgaatgtttcagtcctattggtggcgcttaagtgagtttaaggatacagttgagtagtatcaatgaatagttaactgtggacctctttagtgctggagaaacatgtattaactttataaaacttggaagagtaaatactatccaatgtaaatctatagaaatttgctaatacggattgctttaaaaaatatataaagagcagatagaaacacaaaaaaatagtgcatgcatgtatcacatatctacatgattagttggtcatacaagcaatacaacatgacaagaagtagaaactacaacaacaatagcattaaaagggaaacaatgcaaatgcatctcagaacgcaagcaaaagtaatgccataccacgccatttactgacaattgatgaggctgaaatattgaagaaggttgttttgcactcagtagccacagcttttgctagcattgtctgaaacaaaatatatcaaaacagttacatcaagcatacatgatcagcaatttgagttcgtatagcacgacaagcaacatatggaatggaaacggagttggtatgaagggaaacgtatgcaaacaagtacataaacaaatgcaatagactagtggaacgttctgtagcacaaaagacaaaagaagcaagggaaaacataacagaccagccacagcttattgtaggtgctaactatatagttatatgtgtaaaataatttaattatctatgatctttgacagataaatgctgaggtaaatctactatctttaacagacaaatgctgaggtgaatcccagtagagtatttcaaatggcgattgatgttttttttaatacaaggcagcaataatataaaacaaagatacttcaccaaataattcaaccactatagtccatgatgaaatgtaacatattttaggacagggagaacatagattcattgttatgccaaaaaaataatcttacaatatacaagaaaagttccttgctaagcatctaaatagtacaaagataacaatatagtcttagcatatacactatacaactaaaatgcaatgatctttgtaaggtgcaaacctttcctgttcctggtggaccaaaaagcaatatacctttccaaggtgatagcagacctttgaagtacctacagttcaaaaagaaaataattgagaaccaatggtaggtccaaaatactgatttctaacacaagttatagaagccatcagataagctaatttgggagttttttcctgaatctaattagcaaaaaacgatatagaaagcatgcggtgtaacaactagcaaaacgaatatacaggttagataaataattgcctgactggtaaagattctacatctaacaaaaaactttcttcagaagataccaaaaacacacacatggggcattgtaccatcaaactgaaagagttaaagtaaatggtatgcgacatattatcatgaataacagtggttgcttaaatgcaatcttagggagatctgatctgaccttttaaatatgcaaacatgaccatgcagatatgtgaagcatcaccaatcacaaaattcgatgcaagaatgcaacattcttttgagccacgaatgtcaggtatgaaaatattttccagacatgttaaacgacaaagttacttgttcaaaagtgtttagatagttcgtctgcctatgctatacgttgatgaaaggaagttaggaagagacacatcttcttggtattgcaggtcatatcaagaattttgagattctataagcagaaaagagttaggcttaatagattcgtctcgcagtttacaggcggaatctgtaatttgttttgttattagtctacgtttaatacttcaaatgtgtgtccgtatacttcaaaaaaaaatttgaaaaggaactaaacacggcctatgttgtgagcatatatcatatatattatttctgtgagaagacagaaacctacttggggtattttataggcatcacaactgcttctttcagaagacgctttgcattctccaaacctttaatgctttcccatttgacatctggactcccacgaatgatatccctattggcattacaccaagaaggtatggttataagtctgtatacattacagtaccaaatagataagtctggccacatttaccaaaaggcagtgttacctcaacaatgtctcagctaaattgcgcatttctgcagattcaaaagaaggaagagggatttctgcctgcaaagattttaagtcagttatcacaaagatacatgtgtaatatacatgataggtgaaagaaaggaatgggctggggagttttattgtgtgactggacaatacaataatacttcagaattatggttgacaggggaaaatatagctggaaacttcctttgaatatagtaggtactgttaggaataaccagatatttaattgacattaaaacgataagttccagccattttg

SEQ ID NO: 41281 - DNA, 2473 bp, Oryza sativa
gctcgctagctgttcttcgctatctagtagtgaacgggcccgttaagtcctaaaaagtttttctcaaaaatatcaccttggatctttggacacctgtatgaagccttaaatgtagattaaaagaaaaactggttgcacagttagggaagaaatcgcgagacgaatcttttgagcctaattagtctatgattagccataagtgctacagtaacccacatgtgctaatggcggattaattaggctcaaaagattcgtcacgcggtttacaagcgagttatgaaattagtttttttattcgtatccaaaaacgccttccgacatccggtcaaacgtccgatgtgataaaaaaaaattttattttgcgaactaaacagaccctagtgagagcatcattccgatggctacacataaataattattgattttttttaccatactactgtttagtggttctgtttgatgttacatgcactctaatatcacggggcgtatacatgaagaaatagtaaattttggcgtgcatatcacactcattttttggtctcgctcaaacgttttatagaccgcgacctatgtgagtacatacggtgcattgcagaaagagaaagaagaaaaagaagaatgcagtggagtgtactccctccatactcgtagaaagtcattttggacagcgacacggtctccaaaacacaactttgacttcttatttctataaaaatatttattgaaaagtgatatatgtatatttttatgaaactatttatcatgacaaatttattcatataatttttatatttttaaactcaacaacttgaaagttatttataatttatatttccaaagtttgacttaaaccttttcctaaacgactttgtttacgtttacgagtacgacagagtattcagggaagccatacagtcgaaagctcaagttgcagttgactctccctacacgtgtagaatacatgcacatgcatatatacacggaccaaactgttcaggatttcagatctcatttaactagataaaacttggtggatatatggaaatgaatatatgctaaatattatagaaatgaaggacacatttggtttgggttaaaatattatgaaaatgatgtgaggaatgataatttattatgctttataatgtaataaactgtagatgtaattgctaagcttgaatcaagtactattcaattcaagttcctctatttgaaaaaaaaaacataaatccaagtctaactaacgaataggaagagatatacactactaaaaatgatttttctgtacgaacacatcaataggttgcaaacgggttataagtgtccgcgtctataaatcgacccatattttcccatacagctcctcaagagacgcgtatgcaaaaaaatcaatttttccaagtgaaccacttaaaatatccacacgtgaaaataagggtattttcacgtgcggggctcttaactcaccctcatgcaaaaaatcccccctcctcttcccactcattttttttattctcccccctctctctctctttctctcacccacttctcctcctctcctctctctcggcctcccccactcctcctcctactcctctcccctctcttccctcctgacggcgggcatcggtggtggcaggcatgggcgacggcgacggcgcgcggcggcgtcctccgccctcctcccccccaacccccaaatgcaccctgacgcgtggcgggcacctccagcggtggagagcttggctgcgagttctggcgggcggcagccaacccccgcacagatctggtgcccagccaccctctcctcgcacgggtctggcgcacggcagccccctccggtggtggagggctcggctgcacggcggctatcccaagcacggatttggtggtggcggtcgtccccagcatggatccagcaggagccgccctccccctgcgaatctggcagcggtggccatccccccccccctccccctccccccgctgatctagcggcagcggccctcgcgacgatgatgacctcgatggctagcgggtggcggcagactggatggcagcggatctaggtttcgggactagggtttggatttttagacttatatttttttatattgcagatgggcagcttatgcgcccgcacgcaaaaattggatttttgcgtgcgggtgcgtcacccgcatggagaaatgataattttttgcatacctcttggtgcataagggtcttcgatccacacgcaaaaatctagttttggccgtctaaaaaaatagttttttattagtgatagttggatttatgttaaaatattgtgaaaataatgtgaggattatttgatatgcttacatgttaagctcttgaatgcaataatttacagatttgcacgtgtttgtatctaaaaatataataattgctagtgaatgatgataatatgtttacatatgaagctttagaatgtaatgacttgtat

SEQ ID NO: 41282 - DNA, 36723 bp, Oryza sativa
  unsure (1)..(36723): unsure at all n locations
cgttgcatgcatattgaaaatttagggggatgaaaattatcttaaaattcttggttccctaatcacagtgcatcaaattaaccacgttagaatgatgtgaaagtataagtagaatgctatgcgtacgtgggcctgttacatatatatgggatctaatactgatattgaaggcaggttatattaatttaattcgttatttttttacgtgtttaggatattacttcacatagtttttagtgcatacattttatcattgtttttccatgagaacctttaaaaatataaatttgcacggaagaagtggcaaatctgctatgatgtcattttcatatctatatattttaatttttgcatgttgatattaattaatagttttatatgttagtgagttaagattttaagatcttttgagaataaaaagtcaggggagtgggaggggtccttcgccaattgaatgcatgcttttatcgaacaaaataaaagtcgtacaagtttgataatgtattagagtagaagcagaagaacggataaaagagatttggagaacagatacaacatgtcaattcgtagtttgcatgagttcagcccaaagagttgcatataatttggcacagtaacatagtacttcctccggacgaaattatttgacttttaggataactagaagggtggcccacgcaatgcgtgggcatccgcattattaaaacatgagattatattttttttttcagaaattgcatctcataaggataaactatagggtgggcatatctaaatatcattcatgttagatgataaatcaaggtcatatgagttcgacttttggatcaagtaagtaaatattatgtacaatattgctataagcacaaattgtgatagtaagaaattcaaagttattgtgactgaatcgccttatgaagatgcatgatttagtaacaaccaaattaaggatagattaatggttggattgttcctccattcgtagcagttcaaaatgttcatatttttccacacttttaaagaattgaagactttttatgttaggacacaaatcatctacacaattgcttgtttaaagccttttttttttgtttttcacatgttcaattgttttcttcgaaataatatttgtttgaaataagagagaaattatataaatttaattagtatgtgtagtgtttattgatagtcatgataactttggtaatcacttttagctgcctcaggtacaatgctttttgtcatatgtgtaaaaggcaaatatgaacacgtgttgtgcagaggactgaaaagaggtctttagaagctttttttactttttatgaaagatataatgatttcctaattaattaattaataggtccgtcagtttaagtgaaaatcgatggcaaaatatttttattaaaaatagtatactctttagcacacgtttgaccgttcgtctttttcaaaaacttttgtgaaatatgtaaaactatatgtatacatataagtatatttaacaatgaatcaaatgataggaaaagaattaataattacttaaatattttgaataagacgaacagtcaaacatatttaaaaaagtcaacggcgtcaaatatttagaaatgaagggagtataaattagttaacatagatcataaattgataattaatggtataaaatatagttgtgtaacctttattttaaacggtgtgttttttaaaataatggttctatataaaattatattatattgttaatataatgggtaaaataatagaatcctaaaaattttatttccaaagattatggatctaatttatttacgtatatattgtgatatatataatctatttttataaagttatagttctttaaaatttaatatcactaattatagttacgatctcatctatacatgcatagagaaaagaggggaggatacggaagcggatgtaatttttaatgatatatataatatatcattatttgtttttaatcgtacgttgcattacagttgttttttttgtttttttatgagcagtatataagtacctttctctcgttggtgcgctgagagagattaggtgtgaggttattaatagatttaatttaatgatctgagataacatatctactaatttaaatgaaaatcgatgactagatgttttactttttttcctcagattttcttgaatttttttctaatctattaaagtgcattttagaacttaaaatattaacagttaatatgtgtattaaattattaatttggttttctatctcatctaaccaagaagaagggaagaaaaggaaaaaaaagagagtatgtatgtatgtacgtgcacgtatgtggaacagtggaactttttttttgtacgtgcaaatctttcataggtaaacatagttagaaaatctgaagatagatagaggtgttagctaaaaagtaggagttaccgagaaaataggagagaaagagagaggccggagggagggagctaggtatagcacgtacctgcacatgccgcatatatgcaccatggagatgagggctaccggattttttgtttctcaagtggtctaatggttaaaatatgtgggtccaccaatttaacggaaaatcaatggctagatgtttattagattttttatgatattctatattttattagagtgccacgtggcaactcgagagtgtttataggatgacacatgacggtttaggagcgtttacagggagtttaatgaacttttagtatataatagaagatagatagatgtaaatgccttgcacataatattatttagccgtcagaaatgtcacacataaatccgaaaggagggagtattcttgatatggaacatgttacatgacggtgattctggagttgccaacagtaaattagagaggaagaaggtagtttgttgtaggctcctgatttaatcaattctccatttttaaatttatatatactacatttcagaacgtatggtaaaattgaacaacgacagggtagcagtgaggcatatcctctagcgatctagttgtcgaaaggaaaagagagctagggagcatgcatgtgggtgatgagaaaaccgcatgcctgtgactgtgagaaccacattcctaagataaagtgggcatctgacccataccaccgagacagagtgcagcaacatagaaatgtgttcatcctgcatatgggaaatggcccccatctaatgaagatgcgaattagtggacgattttttgtaatatgtgggctgcttaatttgtgtagctacttctaagagctccactataacgtaatctactggtagtagaaagtaatctaaaccattgatctcatctgatatattgtgtttaatttgaccaaggtcagttaagcttctcttgttatattcctgcaaaaagtatatataaatgaaggcggcatgcatgcatgaaaagaggcgcatggaaatttctagtacttgactaatatgattttattcatggaaaaacacccctttaaaatgttagaaaagttaaagttgatggcctttggtttgcttatcttaatttgttgacatacgttgtaggtcttgcaatagataatataggacacaaagaatatttgctagtacctaatcggccactttggcttttaggatgaacatgcatgcatgcatgcatgcatgcatgcatgaggcttgttatatggccgtgccaaaagctggatattttgaatctgaaattgcgcttacaacgtactccgtactagccaatgaccgcgttagagcatcgcagtgccatatactatgttgctgtcacgctaactatagtacatatatcttgtcgggcaatttgtgttaaagtatgttgcttaacttatttgttcatttttatattttggtgagcgatattccggtgctctctaccggtattaatatactaccaatattattagagattaattagtaatttatttaataccacaattaggcataatttagtaatttactataataccatgattaggaggaactatcatttttttttcctggttaaatataattgatctatgatcatccatcgcactggcatcactcatattccatgaaaaatatcaaaacaaggtttacccactactaaatgatgattcccctccgcacctatttttcagacaataatacccctccacgtttctattgccgctaactaagatggtattataaataaatgtgaacccttcgatcaaatgagatcaacgatttatattactttctactaccagtagagagcaccgtaagtgaagactctacatgataatagggtgaactaatgtgccaagcttggtttattatcttaatgaactagctcgcactgctggaaaaacctatctttactcccggtttgcaacccccttaattccaggttgcaaactaggaccccaaatccgggactaaagatgatagcgccacgtggctggcgctaccatatttttttcttttttctttttctttaattgttttttagctgcttgcatctactgatttcgaccacaaacgccgtcacacccaaatccctagaaatcatccacaaatcatcatccacaataaatgtccatccacaatccacaaatcaatcacaaaatcatccccaaatcaacaaaaatctaaaaaaaatatacaaatcattcacaagataaaaaaaatccattggccgccggccgcccggcctccctccttccgtcgggccaccgcccggcttcccctctcgctgaatctggcggaggcgaggccgccgcctgccgccacggccgacctaccgcctcctccaccgctgtcgccgtcgtcgaaggggagggagccgccgtctgcaccgccacggcctcgtgcaccgcggcggccaattccgccctaccgcctcccatcgcggcctgcctgccgcctccacagttgctgtcgccgttgtcgaaggggagggagccgccgcccgccgctgtctatgccaccgcggcctcatgcaccgcgttttgtttaaaaactttctatatgaaagttgctttcaaatatcaaatatatttatctgttgagtttataataattaaaacttaattaattatatattaatagctttctctttttttttgcgaggaatattaatagctttctcattttacgtgcgctaaaacttaatcttcatcttcatgagtttcaaacaccaccaatgtacttatattaaatagtctctgttttttcaaataaaactctttgattacatatattcaagaacttccatttttttaatcaaaataatcttctgatgcgatagatataaccccacataatatacttcattcataaatctcgatgtgacccaaaataatcagtacgtagggacaagagacgtgattcgtctaggaggctatgacatttccacaagcagtaacattgtattatgaccactcctttcatgcttcttttttggtccctagcacatcacaaacaggggcaaaaaaaaatcatattcacgtagctctcttgcatgtgaagcatattccatgttttgttgatcacaattaacggagaaaaaaagattaattggtgcagtgttgtgcgatcgagcacgacaagttaagtactgtgtatgtgtatggccatttcggtttcttctagaaccatctgatgtaccacatcgatagaagaggacgacatttgtgtacactactacagaatagaaactgtcagtgaattaagcaattgctgtctatgtacgagtgatatatataatccctttgtctttgaattggtacctgagatgtaacaaccttggtacactgaacaagctagctagctaagcatagaatggcttgtgtaggaatgcagatcgagaagagatttgatcacgttggagaatcgaaggatgcatgtagccttgataaggctaatttgagcaaatgcaacgacactgcagctagctggtgactgatcacgacagccaaatgcaaattgagaataaagcgaaaattaacacattatcactttaatgatttcagggtggcacgcattagagggtactcaataaaaacatatttttctaaaacaaatgaataacatatgtgcgatattttatcacatatagcaagaaaaaaaaattatggcattataaccatgaaaagctatggaaaaagaaaacaccaccactacaatccgactagctgtcactaagcattatcgaccaccgctagactaacaaaagagctatagctataccgctcaacaacttcctacaaaccgtttaacgcctagctagcacctataaaatgtgaactcaaactgtgtagcaaaactagaaagttcgcgtctataggtcattaattattctgcatctcaaacttgcacaatcaaacctttcatatattcacattccgtttcctctaaagcatgattctaccaaattaactttttgcctctccggtcatatatatcccaacagctgatggaactgaacacccagataaagaaagaactgacgcgtaaaaaatgcgacgagatcgaagaaatgaattaactaaaacgaagtcgtcgcgtctcttaagatcccggaggatacaatcgatcgccactaagcaagtagcaaagaggatccctccagaataacctcgtcgatttccacggtcccctttgcattatttatcctcttccaattcgcagcctgatggaaactaccatggccacacaaaacagcccccatggatatgcagaattagctgggttgatgatgattcagctagctaggagggccatgaatgacatgcaaagtgtacatgtcgctcagaggagatgaggtttccatccaaaggccgggtgcacgcatcgaccaaccaaatggagtcccaagcatgcgtgccggccagggtagtccatgtcaacatgaagcactgaaatgtgcagaccaaatagtaaagccactaagttactatataaaaaaataattcaacccctcttatcacggtcaattctttacctatcactactattttatgaaaaccatttttgcacacggcaaaactaaaataatttttccgcagacggctggacacatggcttcatgtgaaaatgaagctttattttcacatacgggcacttagtcttatatcgccagatatgacgggtagatacggtgtgacggtaggcaacaagcgtggaaggaagacactcaggataagcgctccctacccctgccctcccaccaatccatggctggcccctttcgtctccctctctattcacaactagagtcaccactcaccccctcacctagcagctcggatcacagctacagagttataccgacccaacggctgtcagatttataccacccagggttttcaatatcgaaattgctttttctgcgcggggggggggggcgaaatttcccagaaattttgaattggcctaaattgtttgaaattttgtatgaatttaaataaaatttgaccaaattcacaaaaaaaaatataaaagagatatgagcttgccggtgggggaggggtgcaaatatcggaaatttcaaaacaaaatttgaaacgttgataccaccctaccactgcttcaccggatccaccatggcttcactctgttcttgacctagagggaggagagggagggagatgaagagggagtgggaagtttggatgagggagaaaggagagaggaaggaggataggcgatgttgttagggccctagggtgcatacatttgacgtaaaattattcatatcaagatcacctgatgttttcataggtgatctgcttagacaccagtcctaggagtacccatttttagaggtggtcatctaagtgggctacctacgaaaattgacccaagcggccgcctctgggcatcaatttttagaagtggtccataaccttacacctccttcactatttgtaccaacatgttcctatttaactgcttttatagggaaatggggtgttgtggaaaattattgtacagagggtagcgatagaggagtttagggataaaaaggaaatcgtgatgcgacagtgatcaagtattgttcgttacactgttcatgctatcactgttgtttcttattataaactgcatgataatagtagaatatctaatattttgatattcataattttatacaatgggttgtatatatggagctaaacttctatgaaagttaaaagttaatgtctcaacaacatatatctgttactacttggtgttgtcacatatatttgttaaattactacttgatatagttgatactttttcttttgagaccatataattataagtattcatcaaaagattaaaaaaatggaccaaaggaagaaacatttatactccaatggtattactaataaatagatgagaaggtacttgggtgtttgtggtgtaattcgtcttctatttagtttatcttgctattgttaggtgatattgtgttggtaacaaaaagcgttaacaatgagcttcacgtacatggaggacaaatcctgatgtttgaatcatgtctactgcacacatccctattttgcatgatgttagttaatcataaccaataaatatagagtactctatggtagcgatacgtacgtacgtacggtgcagatagcaaacaaagtcgtcgtgttcaatcaattggcataacattaacaagctagtcgtcgtacacgtactcgtactggctagactagtgcaggttacaaccctgatacgtacgtaaaattaaccgcttaattatatactgccctaccctcatcggcacaccgcacaaataatggaaaaacggtaatactgcaaattgtgcgtcacactcttgatcgtgctatcagttcgtcagttacgcccgatatatgagtgcagggcccaatcacttatcttcaaccgcaaaggaaatggaaaaaagaaaaacacgtgatcatttggaaaagtgtaaaacaaccatgcattaagtcaacaaggatatatatatactttatttttcgcaactaattaacaaggatatgcatgcatgcgtgatcatgtcaacagcgggaaataactcctcacttaagtataactagctgggttgcccgcgcaattgcgcggctagcataaaaaaatcatatatttttttaagtataattttacttaaaatttattaaatagctatctcattgttaagactttgaaagatcaaaccttatcatccttgtgtttctaattatatagttttaaaaatcacaccaattgctaccccttatgtcatcttctttatttgcttactcgatctatcactgtttctattcattcatcttggaacctttaaaaattggattttatagtttttagagttaattgtcacgttgggtttcgtttttataatttctagatgtcccgtcaaacgttgccattatactcctctacagcccgtccactatctcttctcttttattgtcattgagattttaaaaatcgaacataattatagtttgggtttatttttactttccagaagtcccgccaaaccatcagcggttttgccattgtattcctttacggctcgctcgctgcctcccttttttattgtcattgagatttaaaatagaacatgattatcattggttttttttttactttttagaagttctgaatctttaaaaattggacttgtagttttattttttataatttttagaagtctcatcaaacgatgccactatgcccctctgcagcccgtccgctgcctactctttattgtcattgtgattctaaaaatcgaacataactatcgttgcaattcattttttattttctagaagtcccgtcaaccgtcggaggctctgcaactatactcttatacaccccgctcgctgcttctcctttttattgtcattgagattttaaaaatcgaaaatgattatcaatgtggttttttttctttatactttctagaagtcccggcaaccgctttacttgtttactttacggcctgcctgatatccctccttttaatcgtcattaggattctatttgttgttttattaacaatttttatatgctgtattaactgccaccaactctactactttataggtatgttacttaatttatctcgtcatgtgttttagatggtcttttctttcaatagtctttatttttatcataaattttagttatttataaattttattcctaattgaaatccttttttctaatttcagaatttatttttttctaaaaaaattagttaataccatattgtgttcttttaatgtttttattttttattctgaatttcagttgtttcaaaattgtattcctacttgaactctgttttagtttttctaatttgggatattattatatttttattctaaattttaattaatctcgtagtggattcttatatggattcttctttcaatattgctatttctaattccgaatttaagctaattttaaattgatttcctacttgaacacttctttattttcttttgctaatttcagatttatttttatttttattccgaattttaattaatctcgtattgggtttttagatggactcttcttttaatatttcttatttttaattccgaatttcagctatttttaaattgtatttctacttggactctcgtttccttttctaatttggattttattttatttttatttcaaattttgattaatctcgcattgggttcttatatggaaacttcttccaatatttcttatttttaattccgaatttcagctatttttaaattgtatttcaacttggactctcctttccttttctaattttggattttattttatttttatttctaattttgattaatctcgtaataggttcttatatgggaacttctttcaatattgcttatttttaattccgaatttcagctatttttagattgtatttctacttggactctcgtttccttttctaatttggattttattttatttttatttcaatttttgattaatctcgcattgggttcttatatggaaacttcttccaatatttcttatttttaattccgaatttcagctatttttaaattgtatttcaacttggactctcctttccttttctaattttggattttattttatttttatttctaattttgattaatctcgtattaggttcttatatgggaacttctttcaatattgcttatttttaattccgaatttcagctatttttagattgtatttctacttggactctccttttcttttttttttctttttctccgattaatgtgggaatttctagcccccacagcgaacgtggtgactcatttcaaagctgttttaataatataatagattagctcatatgcatgttaatattattctgatcttaaaccaaagggaaagaagaggagagagatagatgagctcatttggttgttccattttaccattaatatagattctccatgatgatccacaggatctaacatttcaggcatttgtaaaaatgatttagacagtaatgatcagataacactctccaatgattcatcttaatctagtcttttttccgcacaaaggggggaaagattaatagcattcgagttttacattaaaaatgattgaattaatttccatcaaacattttttacgcttccatcgtagtgacaatttttaatccgttttattagacagtaacaatataacttcaaaagtgtgagtggccttataaggttgcgttctatgttgttgtttggcttacctactccaagcacgagaaacgttacagattattaattaagtattaaccgttacaaacttaaaaaataaatttatttagtttttctaaataactttaatatagaattttttttttaaaaaaagaaaaacgtaccatttagctgttcgataaatatactcatgataaataaggcagtggccccttttagccacgtaaaagagcgcaacttaagatagatccttcacgcataacctcatctaattaaatggtaattgtggaaagataaaacaatataagcccttaggacaagtagaatagtttagccttctacacagagatagtatcctcttctatagttgagacaataaatgctctttccactaatgctatatccttatctagcaaagttttctcttttcttgctttaagattaacaccgatttctctctcttatccacattagtagatagatataggttgcaatttggcgagccagctgtcaattgttgctatacactcagcaaattagtttagttggcagtttcataagctatctaatagttgttgttgtacaacccataggagatagggtcttattgtttaccatataaagaataagccattgttagaatataaaatttgaaacttaattatctttttttcagattgacttttaagtcacaaaagaaacacctataaaagttttactcccaaattttttccgctaataagcccttacagcttataatcaactcttggtcaaccgatcgatgggaggtaacaaataacaacagaacttctaatgaatttctctcaaatccaaaacgaaaaacaaacaagaaacactaaacctctcttttctcatcctaatttcccctctctgtttttttctcttcttttcattcacaagaggaggaaggggaagggcatcttgagatcgacgtgcctgcttgcatctcccttgtggatgcggtcacgtccatgtcgatcaccccctgtgtgctggggtttgtgtgtgatgtttgtttgtggcgccctcgtctgctgccttttgtgccccctcccccctcccttcccttccactcttttaaatacaccaccacctcctccctcttcctcctcaggcacagagactcctcgcctctgctccgctgctgcttccctgttcacccgccattagcgcgaccgagctcgctcgctcccggtgcaagttgcaccgcctaccggcggcggccatggtgagtgccgagtagtcgtcgtgtggcgcgggttcttctctgtctctgtccctggagcggttcttgtgttgacggtgatgaatgggttttgtttttccatggcggcgttgcaggaggacggtgcggcggcgcgggaggcggagaggtgggaggggtacgtcgactggaggaaccggccggcggtgcgcggccggcacggcggcatgctcgccgcctccttcgttcttggtaagtacacacgcacctcctcttccctttctttcttgctttcttgctttctttctttctagattcttctggaacccacagggacgatggataagcccagaattaattaagatcgatcatatcattgcactgttgcagctagctagctatcaccagcagcagcagcatgcaagcacgaaagaaagaaagctcgaataggatactcagccatggaccatctcctcctccaccttcttcttcttcctcctcccgttccctgcacctctcctctctctcttttctggagactgaaaggcacagcaccgtggtcagatcgatcggccatcatcaccaccctttacgcctcctcctccttttcctgatcagaccgcacccttttcccgccggatttggccgctttcgctcgcgaaacaagttgccttttctcccctttttttcgccctcctccccactggtcgccgttgggctccatttctctctatctctctctcccctgtttcttcctttccctttcacaccagtacaccactgtgctcttctcttccaacgaggttaatctcccatctctcctctcccccctgttcttgcaagttgggttgggttccccaacttgacccccccctcttgcaattgcgcatcgtcgtcgttatcatcagtggggagaagcttttgtacgatccaaacattggcgtccttccttgagtgtcctctgtaccttccctccatcaaatgcattgcatccacctgagaaaaagacggtgtccctgctctcgatcgacggcgacctcttcttgcaatcttgcgctgctgctgctgatggtggtggtggttgactggtgggcaccatggcggcttcggtttcgatatctctcccgttgatccgatcccgaatgttcagttggaaaatgactgccttttgcttccttgcatgtgtgaaggacttttttttttcctttttttttttgccctgacggttgtgagtgtgagagagagaaccagccatggattttggggagaaaaatttgccattataatttgaccctgtccaaaattgtcgctacgcgagcattgaattcgggcacgaatcgcaaggccgaaacggtcagggagaacaaagaaaattggccggcatgcactgggaaccgcacacattatgctggggcggttatatcagttaccaccgcacatgcatgctagtacttccaatttttcaaacgcctccgattaaaatacaactttacatctccatctgaagtttttcagtggcacacggtagctcaatttcatagcttaatttcaatggaaaatcctaccaatggagaacagtataacttaatttaatatatactgattaggatagagattttgtttttttttcaagatcgaatttggattgagaatattggctttgttgtgtgtgcagtggtggaggtgctcgagaacctggcgttcctggcgaacgcgagcaacctggtgacctacctgatgaatttcatgcactactcgccgtcgcagtcggcgacgacggtgaccaacttcatgggcaccgccttcctcctcgccctccttggcggcttcctctccgacgccttcttcaccacctacgccatctacctcatcagcgcctttgtggaattcctggtaagtaacagcacatctaaatttgttcgtagttgtagtactactaccatttttgtgtgtttttagttgagagtaattgatccaacttaagttagtctgcaagttagttactcacttaatttcctttataattgtttgccgtcataagcctaggaaaaaaggaaaccatatgccagcttacgcaatcgtagatataccgataataataagatgataagatgtttccggatagacacatatcacatatgtaggagtgtatattttagtgagatatatatgcatgcatggtgctcatcgtatctccatgctgacgtggaaggaatataccgggatgatcatgtccagctaggctgccacgtcatcgttgacttcctttctatcttctggacccgttggctattaccatcataacatgttttgttgaccggtctctagaatttagctgcatgtcgtaaagtgacctgtcagtaatcagagccgctcccatgatggcatcctgaccgtccaattagaacagaccccacaagattcgtggacaaggtcaaaaaatgacacctgtcaaagattagccaaacaggatgctaatctcgaggcaggatcgaacggctctagttcccgctagatgaccaccactatttgaccaaagattttgtgatcccggccctacactgaaacctctttttctccacgggttccatctgacaattgcctggaattaattggctaaacggagctcgcaattccctgtgatttgggttacatgagatcacatacatattcacatctagagattaattaggccaatgattaaattgtaaccatcactttattcgctagaagcaagcagagatagcctgggtcaaagggaaccctgtactgaactactgatcacggcccctatgtatcgtgactgcactagctaggtgctaggatatctatctaagtaggagtatctatcacaaaggcatgcttttatgcatgggcttgggacaatcgatcgatcgattcatggtcctcaagtttggcctggctaggctagcttggttggattgcaactgtgatggtccactgatggatcatagatggctactgctcgcttttagcgatggggagaaaacaacaacaagcttttagcttttagactttctttgaaatactttatctttctatttctacgagatatttggataaatatgtgtttgcaaccaattgcgcgttgaagtgttctgctttgttcatactgccttcattttttagatatataaatattattgatttctgaacataacgtttggtagctcattttttagaaaaaataattatgtaaatattatttttttcacttgttaaaagtattttagcgtaacttatatttattttcatatttgcactaaatttttacataaaacaaatggttaaacatcacttagaaatcagcaacattatacattcaaatttagagtggttagtatgagttttttttatgtgtgcgctgtatttttagcccaaaaatgtcgtgtatttttatgattgtgtgggtacgtagagcactagagctagtcgtaggatgagtacgtacgtaggatggaagtggatgtatacggcgtataagggtatagagacgtgtgcggtgcggttgcggtggatcacgtgggcgcagtaaccgtatatatctgtcgagtgccataccggcgaggtgaacatgattgttcttgaccaaaaaaatacagttactgtgcacatcaacagtcgtgtactgtagggctcatatcgtcgggctcagagacatatatggaaggaacggacgataacccaaattcagatcaatcagctagttacttgacatgactacgtcgccaccgtcgtcgacaggcgcatgggcagcgtacgttctggtatggtatagcgcccatcctatcataggtagcctacatcttaggctgtgtttagttcatgaaaaaagttaaaaatttgagaaaagttgggagttaaaaaaaaagttgaaagtttatgtgtgtagaaaagttttgaatatgatatgatataatggaaagttgaaaatttggggtagttgaggatggactagacacgaccttagctataccaaatgctacatctcatacggtcacaccacgagtgggacagggccgtattacggtcgccgtcgccgccgcctgagtagtgtcagtgtgtgagtgtgagtacccttcgggatggggcaataataatccattcatatatccaccgccaattccatcggcgcgcgcggccaaaaccgtcgcggagcccggcgccctggccgccccgtcacgcgctcgcccgggtcaccaccactcctctcgcgcagtcgctcgcacgaaatgtacgtgtttacgacgcgcgcacccctggatatatcctgaccggtcgggatcgatcttttttgatctggtacacggtgacctttctgggtcgccccttcatgaacgatcggttgatggatcgatcgataagtcgtcgattggttaatttattatgagttggtccatcaccagaaaaagcgaaaaacgggctatgatgattaagagagacggctgcaaatttacgatggattagtgatcgtcgaatacagtaccatgtaggacacggaattacggataggcacggatcttatcaacgtgcaggaacaagagccactgtggaacattctcgaggcatttctctcaccacctcccgcgatccgatccgatccgagaccgaccaccatctcttatcttatccccacccccctagccccagatcgaatcacacaactcatcactgtgatccagccagttctcccattccaccaacacacacgtacgacgtacggtgtccactagcgtgcgtacgtgcaaaccgaacaccgccacacaccacatcacaccacacactcgtcgtcaacgcgcgcgacgagagagtcgcacaaaaccaatcttggccaccgcccgcgcggcgcgcggccttcctcgcgtacgtcgagagagacgtacggaccgacgcgtgttgtcgcagcctcgcagggtgggtgtgggtgggggtggggcaaccgcgcgcgcgcgcggcgcggccacggccggctaaagccgcgagtgcgcagccctggaggagaaggcgaccgtgcgtgcgtgcgtgcgcgcgcgccgcgtcaattcgcgttgccctactcctgcctcctcggcgtaacgaaacctgcggctgctagctagcgcgccgctggggcggtgcaagtggatcaagtggggagtttatttggtttcgggatttgcctgcagggtttctttcattctttggctgtgcctgtgcttagcttgcttttgctattccctcccggagaatattaatcatcgttttggtggtactcgtatttttttttcttcttacccacttgtttgacttgtgagcacctgagttattcgcgcgtaaaattttataggccggggaagcaagctattcagtccagccataattctggaaagattatcgtgtttccaaataaaatagtcattattcatagtctcaatttatctaagacttaaacgaatagataacttagatgattgtctgaaacacaaacgatcattttaatattcattagttacacttacatgcacatatatacagtggcgaagccaccgtaggggccagggagggccaacacccccctaacccctatgtgacctcccctcccatctcttctcccaaggataattagcccttataatctaccattaattacatcattagttgcagatgagactaactatataggataactgcctagctatatatgacttatgaaatgacttagttaactgatttatcattttaaaaatgattacaagactccaattaaaatcatggaacaaactgtttaaattggcaaattatgatctatgggttctcattctctcttctagctaatcgctataacatgtatgatgtcgagttagtgatcatacatcaacgctacaatatcactgttcaccgaaccttaagtaagttaccacgtctcgtaaatggcaccccccatctctaaattctggcttcgccactgcatatatatatatatatatatatatatatatatatatatatatatatatatatatatctcttttggtattcgttacatacagaatgagttatttttttctgatactgatgataaaagtaataagtttaacacttttttgatagagagtatagtataggtacgccaccaaacaagttgcaatatggtgtggaaatcggaaacgaatggataggatagaccgtaggagcatttgttgttttccttcgtttccctttcggagtgttgcacattgcgccacgtggatcctgatagaatagccactgaatacacaaatacacaatggtactcaataatgttactcctatgtacgcaccgatcgtaccaagtacaggagcaccaccaccacttgtaaacatcttttctgcacacccgatttgatgggctaattaagatatgacaagtacagtagtactgctagttggctgtccgttctactaagttaggccatgtttagttcacaccaaactttttccaaactctcaactttctatcacatcacatcacatccaaaactttcctactcacgtaaactcccaactttttttttcaaactaccagttttccctaaacttctctccaatttaagaaactaaacacagcctccagactgatctctagactgatagtacttatcattttggataatggtgagatcaaatattaaaatctttaactatgaataattttttaaatatttatcttagaaaattggagactagatatatagattagtcttaaaaactactttaataaaatcatatatttgttgatgctttttatatattataatagaaaataatgatcaaagttactttttatgatcatgtttttatctaaaacgataagtattactccctctaattttttttgtttgacgttggttagcttaaaattgaactaaccaacgtcgtacatttgtgcaaggaggtagtattaatctgcagggagtacttccaagtcgcttgctgaccttggtgatctcacctgagcgccacaaaaacgatcgccgtacgtttgacttaccagcttcaaaaagctgcctcgagtttttttagcccaactgtatttacgtttgccggtcagcgctgacaaaagttactacgaacccatcgacgggcccctgtcggtctcgtcctcctcctccgctttaaccggctcacggaccacggcgaaggccaaagcgacgtcgcgcacgggcgcgcggccgcggcggcacatgcagcacgccgaccacttgcctccccccacgaaacttttctcgctgtcacctgatatctctttccccccaaccaaaccactagacattggcgtcacagttctgatcgggttggtatgctctgttgcaacatggcagtgcaaatttgcaacggaaaattgcagcagaaaattgatgctagtagtgtacgtagttgcatgtatttgggcctggacagtacatgggcctggaagcttttctcgtctgcagattttaggattttatatgggcctgcatatgattctctctcttttttttttttttgaacttttgttgatgtcaagcatggcgcgaatgtgttgcaggggctggtggtcctgacgatccaggcgaggacgccgtcgctgatgccgccggggtgcgccaaggttgccggcgcggcgtgcgagccagtgtcggggccgaagaaggcaatgctgttcgcggggctgtacgtgacggcgctgggcatcggcggcatcaagggctccctcccgtcgcacggcgccgagcagttcgacgagcacgcgccgcgggggcggaaggggcgctccaccttcttcaactacttcgtcttctgcctctccgtcggcgcgctcatcgccgtcacgttcgccgtctgggtggaggacaacaaggggtggcagtgggggttcggcatctccaccatcgccatcctgctctccatcccggtgttcgtcgccggctcgaggctgtaccgcaacaaggtgcccacggggagcccgctcaccaccatcgccaaggtcgtcctcgccgccgcgctcgctcgccgcggcggcgcgcagagcgccagcaacggcgctgtcatcgaccgcgcgcccagccccacggggagcacggacatgaaggagtactgcaagcccggcgacatctgcggcgtcgccgacggcgccgccgaggtggctaccgagccgtcgcaggagctggtgttcctgaaccgggcggtgcagcggcagccgcggtgcggggcgctgtcgtgcacggtgcaggaggtggaggacgtcaagatcgtgctcatggtgctcccgatcttcttctccaccatcatgctcaacagctgcctggcgcagctgtccaccttctccgtggagcaggcggcgacgatggacacccgcgtcggggggctcaaggtgccgccggcgtcgctgccggtgttcccggtcaccttcatcatcctcctcgccccggtctacgaccacatcatcatcccgttcgcgcgacgcgccacgggcacggagatggggatcacccacctgcagcgcatcggcacggggctcgtcctctccatcgtcgccatggccgtcgccgccgtggtggaggtgaagcgcaagaacgtggcgtccaacgccggaatgctcgacgcggcggcgccgctgcccatcaccttcttctggatcgcgttccagtacctgttcctggggtccgccgacctgttcacgctggcggggctgctcgagttcttcttcagcgaggcgccggcgaggatgcggtcgctggcgacgtcgctgtcgtgggcgtcgctggcgctggggtactacctgagctcggtgctggtgacggtggtgaacagcgcgacggggcgcggcgggcggcgggcgtggctgcagggggagaacctgaaccactaccacctggagaggttctactgggtgatgtgtgtgctcagcacgctcaactacctcttcttcttgttctgggccatccggtacaagtacagaaacgccggggtcatcaagggatgatgatcaatctgtaatgcagggttaactgtttaattatctggcaaggtaaaaaaaggagggaggttaatttggtggtcttgaggatgctcattgctgtgtggaattggttggctggctgtggccgatgaatgaaaagaagcagcgattaagcaagttgttcataaatagatcggtgttcaatgaaggaaaagaaaaatagtgaagataatgcatactaagttcagtttatctttcactgttttatattgttacgacccattaatagttgctaacattaaactgaccttggtctatacacgatcacctagtgatcgagctgatgtgaactagcatggtggcctacgcatattacgcggctagcatgattatatttttctctcatataatagcatatatattttctcaattttatcattaaaatatattaaaatgataacataattttaattttataccaacttaaccaaactaccaatgtgtaatatttatattgtatggtatatatgtgatagttattaattatttatcaaattttagatatttctaaattgtattattatatggactttagatctgtctttcaatattccttatttttttaggaaaaatttgctacagaaaacgcaaaaatcgtgtaattaattagctaagggacaccgcggaaatgtgatattgccccaggacactgtacaaaaattgtgaaatttgccataggacatcggacccattattttatcatttcccagttgaaaattgtgataattttttcgtaatgcccagattgtccctgtgtcaccatctataccgactaggtgcggtcgaaacggagtcgatcactttcgtcgccacacaccaccgaggagaaaatccctaacccctaaccctaaccttaggttgcggtggcggcggcggagcaggaggatgtttgggtgacagcggtgacaaagacctactcggcttcggtggcgcgggagtgggaggcgtccgctgtgggcttgcggtgcactgtgaggactgaggggttgaacactcgcgcggtaaggggaggggacaaaatgaaaacataacgtaatcctttcatgtaaggggaaggaccagaaattaatagaagattcgtgaaggatcacgaagatattttgcaaatcgacagacccaacggtctgtaatgtccggagtgacaatctaatggtgtatattcagttgatgacgtggcaaagtaattttgcgagaagggttttacctttcagttatttagattgggccgacttacggcctagcagcaaaggaacagtttgggccaaacccaaactaattattcggagtacataatatatatgcaataagtttgattttagatcgctcatcaaaacgtcgagattaaaagacgttctcaaatcgcagtacagaatatagtgtattcctcaacattttaaaccagtgtaagtgagatcactaggtggtttggactatggttttagctgacgtgacgctacgtggctggtttgatttagtcatcgttccacgtgatgttaacgtggcactaaaagcaaagattaaaaataaaaaagttgaaacaaaatatgtaggaccttattgtcagggttacggataaggtacaccctctatccttggatatacgatgagtactgatatggtatacctacgcgtatacgggtatacggatagttcctatatgcgttaaggaaatctatcacgtgatagaaacagaatccacggatggaaggagtcctactcggacgagactgggtctttacaatatcgtgaggggtccgatatctccgagtcctacttagagatcaactgacccgcagtataaaagggagcccctgggcaggacctaaggcatagaatctcaccgccaacacatccaccacagcctacgaaatcggagcctacaggagccaagtcgccgggtgatctagtcgaaccaactcgactacggtctcgtcggtatcatcgagttctactattccttttgtaatatgtggtttccatcatataatcccataccaactggattagggctattacataccaagtggcctgaatcagtataactctcgtcttttgtttacttgatgtcgtactacgtagaccctcgtaccaacgtaccccaacaccctctatatccggtctacgggtatcccctgtcgacacttatataccagtaaaataaaaagataaaaaatatagtggaacccactagcaagtgggtcaaagttcctccacctcaccctctctcctccttgcccttctccgtctacgtcactcctctctccccctttcctcctatctccctttttctctcctgcttttccactaaagggagagtgaggaggaagtgggatcgactaacacacgggtcctcacgtattttattttatcttcacatatgaatctcacgtattttattttaattttgaatattttgaatcttgcttctagtgccacatcaatatcacgtagaatgaggaccatgacaaaccaactatgtaggtgctatgtcaatcgaaaccgtcgctcaaactgtgccttgtttacacttattttcggagttgatggacatgttatatatgatattgtgatctaacgactagattcaaattagacgttaaaatgagatacctaaagtggactaattcaaactagggtctctgctcatctgctggcaacgaaccatgataatgggccgaatcaagggtccttttgcaagctcgcaactcgagtcagttgctcaggcccaactaattgctggcattacagaaatgaataagtctattttgcctctcacaactcttgttatagattgaaccacatcccttaaccataactagaaagccagcgtgcctgctggcacgccaataaattgatagccccgtgtgtattacctgtgttttactgttaacttgtttatttctacctagcaattggtttcaattttctataaatataagatatgaacatggcaatggtatttctcttatttgtatttatctagatatttttcaacatggtaggaaaattcttggtgttacttgtttatgtaccgtcttgattttcaattaaatttgtcctctctgttccgaaataagtgcagttttgtactgtgcatgtccaacatttaaccgtttgtcttatttaatttttttatgattagtatttttattgttattagatgataaaacataaataatactttatgtatgactaattttttaaataagacggacggtcaaatattttacatggatacccatgattttgcgtggagaccaattccgtgagtaaggacgtgtgccaaggattaagttgcacaaaattcatgttataagattaggctatgttcttttctccaacaaatactggataaacttttagataaaagtggcacgcttttcaaactgctaagtggtgcgttttgtgcaaaaactttatatatgaaagttgttgtaaaacataagactaatccattttttaagtttgtaataattaaaactcaattaatcacacgttattactacctcattttgcgtgaaacacttaatctttatcttcgtattcatcttcagaatatttaaacaccacctaaatatggaatcttttcgatttgtctagaatcgtccagggctgttaattttgcagggcccatatatagggtttttttttttaacgagcgtcacaccatcacaccatctcaattcgcaagcgccaggcaggagagctttccggcgaaacctgttgagccacgtggcatgagcccctgcaagagttgtgcacggatttcgatattagagataccaatataatgcctcctacatcttaaaaaccagagcagatcgagtctctaagctgtgatagcggtttcgtcctacgagacgcttatggggccacatgtcagtcagaaaaataataaaaaaataacagcccacatgtcaatcattcaaatctcatctttttcttttttctcgcccatttctcccatctctctctttcctgttctctctcgctggccggcggcggcgggagttccgattcctgtgcaagcccacggccggagagctcctcccagtaaccaccttctgccgcaagagttggacaccctccaccacacgctcgatcgcgtcgagtcgcgacgcaggtacgtgtgcatatccgccattgccgaccaatcagttacctgctgcatactcccttcgtctcaaaaaaagaccaaccctggtttccgtgtccaacgtttgatcgtccgttttatttaaaaaaattatgaaaaaaattaaaaagacaagtcacgcataaaatattaatcatgttttatcatctaacaacaatgaaaatacaaattataaaaaaatttcatataagacggatagttaaagttggacacggaaacccagggtttatcttttttcaggacggagggagtatatacgtgcacgcgcatgctgacaatgtgcggtttgccagcttttgcacgtggatgtctggatgagttgagggggaagctgaacgaccggcaaacgctagagcgcggcagctgcgacggcgccatcgatgattcgagggggacgacaagagcaatgtcatgatcgggataccatgcagtatagttttgataaaagtaatatcatatcgtatgctatgagatttttttttaagtttaattaatatttatattaattatatatagacattctatataaaaatatagtaatgatatatgtcatgcaaatagagacatttatcaagagaaaccacgttggttttgatatatttaactgtttttatataaatttgagtgtatttatttacattattttcaaaccatgatattttaaataatattttatagtataatagggattgtagaatcgggataccatctaagatttcgtaggatcgtgtagtaatgaatagtaggatcgagatactatgagaattaagatactagatgggatcggtatcgtttcggcttaataggatcgtaatatcgtatcatagtaggatacgaatcgggatactgacaactactacttaaaaaaaggggcataggtgccggttgggaaccgcctacaagtgccgatttcccaaccgacacctattggtcggcactgataatagaaaccagaacctatgacaattattaaaccggcaccttttgctttgctcgagaaaaaaaaaagagagagccggctcgaatggagccgacctcactgagcaccaccgtcgccatgtgcccaaatcaaattgaaatccccaaatcatccacagatcgtcaccaaaatcgattgacatcacaaataatcattcacaaatcgtcaccaaaacatgaggggagcattttagttagtacgcaccccaggtgcggtttagcgctaccatatatatatctggatctcccggtccagatcgatccctcgattgcgccgctcttctccaccccttctcaatcactctcacgcgccgcctcccctccccaaccctaatcgctccctttcatgcgacgccactgccgccgccgccgccctcgactgccgccgctccgccgtcgtcgcatcagtcgtctcgccgccaccgatccccgtcgccggcttgccctcaacccgatccccatcgccgtcgtcgcatccgacgtcgtccaggatccctcgactgccgccgctctgtcgtcgtcgcatcagtcgtctcgcctcacgatcgtctccgcctcacgttctccttcccccaattgctccccctctcgacctcgcacaatcgacgcctagatcgctccgccattcccctgccgccgccaccttctcctctcctctgccgccacaagcgccgcccctactaccctggtcaaaacctagtcgccggcgccacctcctcctctcttccggctgcggtcgatgccccaccgccaactcgtcgtcgcgccgaatcgccaatctccctccccggccaaccctaatcgccgccgccactccctcctctctcccctatctccctatcgtcgccgtcaccctcgcggcaccaccgattcaccgccgctatgttgctgtcgcgctgttcgagccgaccatcgtgcctcctcgcagtgccctccacccgttgcgctgccatcgccatcgctcgatcctcccctgggactagagcatgcacgacggtggaggcctccgtggacgcggagaggcttggcgggcctcggcgagagcaggcggtagcggaacccaccggcgacctcatccacgacgccctcacctccctaggtcctttctccaagcaggtacaatacggccacctatctctctcttccctggggtctctcatagcctccaacgtctcacaatggatggtgctgagtggatgatccatgaacaagagatcatttgttttgcaacttccaatttctctgtataaggataccagtgcattttgtgttccctaattccatcgccgtaagggaagattcttctgaaaccagtaaaattaatgcagtaaacaactatatagtactagctttagcgttttgtgctcgcggcatacagaatttatggctttagtgtaaaataatgaaaacgaatttttagttggagcaatgtaccatgatcatgtttgtcccccgtaaggcatgtatgcttgccctgtttgggtcataagagaaagtgaattgaaaaatctaagtagtttgccatgttggtcaaatatacctatgtaactgaattgttatggttttctttcaggtgaaaaattaagttcttagcataatatttttttttttgaaacctaaggcggaactttgttccacttttatatttagaagaagagaattgacccagtttataaggaaaaccgggcccgaaaaccatacaattgcatggtttattacaggaaaaccggctgaaaaccaccgctacacaactaacaactacggtggatcccaaccaggaaccatgcaagtattagatcataaatcgttaccactcgacacgctgcgcagcggaagaagacgctgagaagtcgaaggaactctcgcgaagtagcgtgcgtcgatgtagaggaagtagtcgatcgcaccggctcgaccttctcctcctcgtgcattctcctcgccgtactctcacgccgatcagcaccacaaaccagcgacgcctctaccggtatccacacgtacagggacggaatgccacgcgcagatgtgctagcacccgcgcgcggctagggttttgctcggggagggaagtgacggctagggtttctcacgtgatgcgatgcctccgccggtcacacccctcacgaatatataggatccatcactcgggcctccaaggcccgtaggactcctattcggatccctatccgaatcaagctcatattggatctccatccaatccccttatttcggcccattaagcgtgcgatgctgtaggttcatgtatactcagctctaagccgaaaactccttttcggtccacgcgtcaacagcggcccctagcagaacgtattgacccaccgggcatacataaagatcatatcggctgaatctctagtgtatacttgtatgaactcctttgcctcacgatatcgatttagctcaaggctagatatgtgccatcctctaatagctcaatcattcactcgaacatattgatagattatataacttgtgattgactcctcaatcacctttggcatggccatgcacttccataatctacaatatcgaggggcccagagatatctctccataggagaggcaaatcccatcttgattattcatatcccactacatgtttcatagcatatccgaaaactacttttataactacccaattacggagtagagtttagcagtccctaagtaagctactacacatgttgggaatcatgataatcacaagtctgaggattcaacaccaatactaaatgagatcactgatgacacaacacatatggctcttgcagtgtctcatgttgggtctatccaacaacatgttcactaacatatgtctacattattaatttggtatctctataccatgatacatgagacatgatcatcaattaatacatgtgctgattatctaaacatattgttcaacatatgatatttgatcagggatcctttagaaatagcaacacataacataaagagtctcatgaaaaaatcacatattcattaaccaataatgagtttatctatttcaagaaacaaagtcggataaatatgtaaacatagtgtgtgattcaatcatctctatgattgcctttagggcatatcactaacacacgttatatctgatattgtgatctaagaatgtgattcaaactgacgtcgagatgagagacataaggtgaacttattcaaactaggttctgttcatctgctggcaacgaaccatgataatgggccgaatcaatggtacttttgcaagctcgcaactcgagtcatctgctcaagcccaacaaattgctggcatttcagaaaagctaggccattcatatttttttctcgattaatatacaaaagacgtgcaaacatcactacccaccaaacagctgcatgtacctttgcctaaccataggctaaaaatataaaggccagtaaattgctggtattacaccagaaatcaaaccctagtatagtggtcatgaccaaccactctctgtttttcaatagcaatattctgttgaagacaatagctttaatttgtttttcatgctcatgggctttatagtattcttagaaaataaagtttgtctttgcctttgaaaagtatagccctgtttgttatacacctgcagcggctatgataaaaaatagttatatttttcatataatagtagccactctaataatataccacatttgtaataattgatgcagttaatttttagtcacacgtttaaccattcgtcttattaaaaaatatataattgttaataattttattgtgagttattttatcaccacaggtacgtactttcaagaatgacctctaagataaaaattttaaacaagttgaatgattaaatatgtatttaacaattaaccgacgtcctctatttaaaaacaaacagatggtacttattttattgatttgctgtggtaactttcacgcaaacgcaccaaagttagtgatgtttacatatattttctttgctgccatcgagaataatggccactcgacgcaatcatggaaacctcctttaccatcttttaaagcaaacacgattagagcagatacaataataggctataagccagctataaaaatattttaaaaagataaagtaagagggggaagagcagcggactacatatctgtagccagctgcagcacgaactccaaaatataatgtatgtatgacagatgtgactagatattaatagtatagtaagcaactattatatgaattggctattacattggttatagataatctggagctagtagtgggctacactattaaacttgctcatcatcgtatgtacgttgaggtcctgagggtgattacattagagcaagtttaatagtttagccagctgctatctctaagttatctatagctaatctaatagcctattcatataatagttaactatagaaatatactacaccattaatattcagtcccacctcttatacacagataatattttagagtccgtgttacaactggcgataaatctgtagtccgctttcttttctctcttctcttttcttctcgatacgtgattatactagcttgctattgtactttctctttatgcgttggcagttggcagtgctgtctcttgagtgatccatactccctcagttacttaatgtagggcgcacctgttgacaacacaaaaaccaataaaatcgttctaagagcacccgcaatggtaaagtaatgtgctctctataaaacatgtacatctcagcaatagactagattaatagtaaaccacctcaatagtatatctacatggatatctatagctctcgtatgcattgccttgtttttctctatagactatctctaagttagtagatagctttgctctatctctttatttaatatcttctaagtaggaaaatatgctgacatgtatatcttgtagagagcctatagataactattgtgggtgcccttaacagcagttgcaccgataatttctcttcttcccatgtgtgatgtttcggtagtttcgccagcaataaccaccatgcagcatccacccgacacctgcactttccaagcgaatgaccagcatgcacatcatcaagagttggtttattctgcatgcaccagtacatgactcatcaatgcttgcatgcacaaacggtagccgagatgttgccgccttgtattagggaatttggtgaaaaagcagttacgccttatgttgtcgaatagacaactgcgtcacatcgaaagtcttggttctctcaacagtggttagaaataaggttagaaataaagaataattgtattacttagtgaaattttttttggatcccttattacatggccctagggggccttttatagctctattacatgttcccctattagggtttaggttttacaggggaatttacatagttacccttataatagtgacattattgagggcacaccgtgtcctttacatgtaagggcctctattgggcttaaatgactaggcccatctatttgctgaagtccccccgagggcatggcggcctgttgggcctcctggcggcgtagttcggcacttttggtgaaacccgtgccttgacgccgaggccttcacctcaccatctccgtccttgcggccctctaacgaggtcgacctcgctgacgaagctggcgtactctaagtcttcggctttcgccttgtggccttcgcccatgtggtttctctttcatccttcgccgcttactgccggtccgagcctgttacccaggtccttggtttcggcaggtccggccaaaggccttccgtggtatacctccaacaagcccctcacgggcaagggtgactagggagcctcggccgagactgtgcacattgaaaggtgtaccacgaggcgccccctttggccgatgttcctgtcgaaccctatgctgcacacctgtagaatatatatataattcgctcncatgttcatacaaaaaattcttgggggggatttccttgctatgttcgccagcaagtggtgaaaaggttggcttattctttaaactactatgaatagtaatgggcnccgtgggccttcccatccttgcattctgccttttactgttctgccccggtccggtccgatgggaatttaccatttcgtctagccccgaacacgtgtcatgatatggttggatggaagctgaaccgtcgcgatgaggttatataaccccaccccgggttaccgcttctctcccccccttccatttttaccacaggcctgcttatggctttatgctctcactttgcgcttcacctcttcgacaccatgttgacagaaaacacgaggcctgggagatctgcttaactccagtgcaggtccaaaactcgccttcggatacgtgagcgtgccagttgatttgatcctacaatcaacaagaaatagagacaaaagaaccgtggttaaatctataaatgatatccgatcggccaggtgccgatgacatatcatttacgtttgagccgatgtcatatatagatcgatcggcaatggaaaatagataataaagaactaaatctattcgatcggctgtagatattaacaatacataattcttatatcgacatatacttaagttaagtgattgggatagatcggccatcatgccgagacagtataaatcacttgtactgaaagatatgttaataacagaactatatacgtttacagcatagccgatcaaataaatctagcatgcatcggctaatactccgatgcaattctatgttaagatattataacaagcagaatataccaaacaaaagcttaatgtatgtaaatgcaataatatcttgacatgaaaggcagatttaacatatcagtgcgacatataaagcgaatatagttaaatcaaataagatcggctgaaaccccgatactatcctaattaacaaccagaaagcaggctagagattgctattctaagcatgacttaatggatcaaactcaactgatgcagcattaagtatgaaaagaagaacaatatctagacaatcaagccactggaagattcatagaatggtagatatcttatataatccaaatcaacatcgagatctaacctaatcggctgtcttttgcatgcaaatgttagccgataatagattagatagagatattgttgaagattatgtaagatatgtgataactcggcgaattatataaatgagattagagtatcatgaagatgtaagcactaatccctaagaacataattcgtcataacgagctttacctcttgttgaagatcgaaaccgatgcagctcaacccggaagcaagaactcgtcgaaataaaacaaaaacgaaaggtggcgatgcgccggaattgtattgaatgtgtgtatttcgttacatagggttcggggtctacttatacccgaggattacaagatatgcccgtaccggccacgaccattatctctaacaaactctaaaatatcacgagtctttgcggcagactcttgcccacacttatctataaggaatttacataaataatctaattaatagatacaattgccttctcaggactctatccagacatggcaatcatcttgaagcacatcaacctgagcccgacgtcgcgcataagtcgtattatcagaatcggctataccagcctacttagcctagctcaaccttagccgatcctagccgtagccgatccagactctagccgatccttgctctgttctagaacttgatcttcgtctccaactcttctccgattaagtcccttttcctgatacgaatactgaccaaatttggttgttaacacatgccccccaagtccgggatattcgataatgttccggatttgctataagccgactccgagtaagtttcgcattttaccgtttccgaccgttaccgccgtgctttaaatatttaaccgtcacccccgagaaacctcacaccgtaacttccgtttccaccgcttaagcaaatccaatcccctttcttctccggcgacttctccgacgcaaaggcgactccccggcgattcccctctcgacgagatctctgccctcagctatgtcttcttccgccagcccttctggtgcgccaacaactgagtacgctgaggtaagttccaatcggctaaatccctccttcttcagcaatacattgattttctttcgtctcataccgcttctcccttttccattgcttctggatttatagcacctttctcatcaagtcgcaatccaagtctttcgcatcgaaaccactatttcctcggccaatcggcagcctcgaccccaccgatttcattactggtgaaaccaaccggattcccttcaggctagccaatcccaacctaggtcattggaagaacacctttaagtcctggccatctttggagaaactttcgcctgacaggagctggtccacttggtatcagcgtgtatcggctagcaagaaagttcactaggacgagatcggaatcggccaagcacttgccttaactatagccaactctgccaaagatgaactattaatagctgccgccacttacttttggtcaaacaccatcaatgctttcctattcaaccaagggccaatgactccaaccctaatcgatatcaccatgatcaccggattaaatgtgacttcatcggccaaccccatgagcaaaaacacccggaataaatttgatttcaagaccaaaaacataggtggttggtctggctatgtagcatcatacatgggtcaaggatctgtcaccccccgagagcatgtagcctttccgctcatgtggctggaaaaatttcttttctgtggatccagttgtggccccacaaccaactggcaatttgtagccgaagccctggaatcaaagaaagaattccccctaggaaaaattcttctcggctacctgtaccaaatgctaaacaatgcatcagctaaaattgctgtcggctcaacagttggagcaggtggaccctgctggttactgcagacctggttaaacctaatggttatgaaggttgtcaatcggcctcctgtgacaaaagctgaattccactgccagagccaattacaggtgatgatggagaagaacgcacacatcgcaggtgcacatcatacggggaatatgcatccacacctaccgacgctggagcaaagctatcggctgagctgctcaaggactggttctgtagcttctacgaaggtttcaagaaagatgctcggatctggttcccatatgaagactcaacagaccttgaatcccatcagatttcaggttcgaagacataaatcacgagaaattccagaaatccagagaaatccttatagctgcaatcagcccttgcatccaccccgtcggcatccatcaaggaagaaacaccaggtgtcttatgaattttatcatccaatgagctcagccaggcaacttggattaggccaactcccaatcggcttattctttgccgacaagattcaatgtcgaggccaaatcacatccactctaatgatggatcggctactcaatctaccaggacctcctctgggcagtattgagaacattgagttagccggtttcagaagcaaaaactt

SEQ ID NO: 41283 - DNA, 1586 bp, Oryza sativa
ttttcagctttcacctcctccttcttcctcggcccaacaatcatcgagtgatcagaccccttcggccgtgggaagtcaccacattgaggaagaagaacaaccagccgctcctgctatcccagtaagtttcccctagcgagcatccaaatcgactacaattgtttggtttctaaccattttcatattatcaccacaggtcctagccgatcttttctcttttgatatcagagattatcttgatgaaggagaagaagataccacaagcaaagcattggcccctttatccgaatgatgtcaagaagactctaaaaagtatcttagatcggctagaagcatcatcgctagacagcttggtagttgactgtggcccaatcagagctcggttgcatgaaatccaagctttaatcccggatgagttagccgatgtccttactccagctgtttaccttgaacaacatcaattcaagctggagaaagccaagttaagactagccgagcggcgggaacgcaaagacattgagtccactatccaggccaaccgacaacttgtgcatgaagaaaaatccaagctcgatcaattatctgaaggtccaatcaagtccaatattgatcggcttgaagcacgcaagatcgacctcctagcacaacttgaggaatgcaacgctgagctggatatggagcgcaagaaactagccgatctccccaagtcaatcgaagagcagaaagccagactgaaatcggctattaagcatgtcgctgaactaaccaagtccttaaaagttattcctggaaccgacgctcaagatgctcaagccatagaagaagtagagcaaattaggcaaaaagctatgtcggctatccagcaatacttatcacagtaatcccaatgtaataggacttagaaatcttttgtaatcggcaaaacagcttgatacttcatcacttaacatccttctatgccgattaatataaatttaaaattcgcgcaaaaaattttgccctctgtatttgctgcattttaacagacatatatgcccccctagttttacaatgtcaatggcattgataaaactataaaacaactaagggcgatataacaatatcggccattgcaaatcggcaaaccgtcggccgattacattataaaacaactaagggcgatataacaatatcggccattgcaaatcggcaaaccgtcggccgattacattagaaaacaactaagggcgatataataatatcggccatctcaaggcgatgcacatacatcggctatcatgtatcgacactaggaaccgatcatgaattaatccatacactcggataatacttcttcaagtatttaccattaagcgctcgtccataaacttcaccatcaagcccttgcaacatatatgcccccttagaaacaactttatgaccacttgtcgaatttactatcacgagtatcaatcggcaatatcaacttccatacaagctcgccctctgaaaaatccttaggcacaactttcttattataatgccgagcgacgcgttgcttgtccttagtaaccttcgcaagggctcgcaaacatgactgaaccaaa

SEQ ID NO: 41284 - DNA, 6260 bp, Oryza sativa
aatcaactttgttcaagggaattgcttctacccatttggtgaaataatcggttgccatcaatataaatttatgtcccttgcttgatggtgggtttatcatgccgatcatgtcaattccccaacctctgaacggccatggtttaattataggattcataggcgacgctggtgctcgttgaattgctccaaacttctgacaatcctgacaacccttataataccggaaacaatcctccaacatcgtcggccaaaaatatcctgcacgtcgaatcaaccacttcatcttgtgagccgattgatgagtaccacagatcccctcatgaacttcaccgattgcaaccttagcctgatcggcactcaaacacttaagtaataccccatcaattgtccgataatagagctcatcatccagcaatgtatacttcaatgccttatatcgtaattttctagaagccgattgggaaggattgctcaaatactgatgcacatcatacctccaatcattggctgatattgctgcaatctcaaccttcacatccttgatcatcggcttataccccgatgccccttgagtcaaatcgttagcgtcaagattttgatctcgagatacatgcttcaaagtaaccagccgaaactctttcattaactctaagcacttctcattataaaccagcaatgtatcattcttgcattcatattcgcccaccaactggctgattactagcaaagaatcccccatgatttcaatagtatcggcttcaacttccttgagtaactgcaacctcttgagcactgcctcatattcagcttgattattagttgcatatggtttaatagtataagcaaactcaaaacatgccccctaggggaaattataaccaagccgatgccacaaccatgggtgcagaccgatccatcaaagaataaagtctatggcactatttcaaccgagccgatcgaattatcacgatgttcaacaatgaaatcggctatagcttgtcccttaattgccttcggtgattcgtaccgaagatcaaactcggttaaagaaaatatccattttccaactcgcccctttaatatcggagccgatagcatgtatttgattacatcggctttgcatataacagtgcactcattagataatagataatgcctcaaccttgtacacgaaaaataaaggcacaagcataactctctacaggagaataccgagtctcagcatccaagagccgtcgactaagataaaacacaactcgctccttcccttcaagctcttgaaccagaaccgagccgattgacttctcaccagccgataaatacaatcggaacggtattcccctctgtggaggaatcaaaacaggaggagagctaagataatccttgatattatccaaagctttttgctgctctaccccccaagtaaattgctgatcggctctcaacctcaataaaggcatgaaaggttccaactttccggataaattggaaataaaccttctaacaaaatttatgttgccaatcatctcctttaactcggttttattttccgggggtttaatcctctggattgcggttaatgctccgctgagttacctcgatccctctttcgtgaacaagaaatcccaaaaactggccagccgatacaccaaaagcacattttgtcggattcatcttcaaaccatatttcctggttctctcgaagacttatattaaatcggctatatgatcagcaatttccttagatttaactaccacatcgtcaatataaacttcaaccaacgagccgatcaaatcgtgatatatatagttcatggccctttgatatgttgccccagcactctttaggcccaaagtcataacaacccattcaaataagccgattgcaccaggacatcgaaaggccgctttatatatatcttcctcagccataaagatctgattataacctgcattcccatccataaaactcaaaatcttgttccctgatgcagcatcgaccggctgatcggctgctggcattggatattcgtccttcggggttgctttattcaaatctcaaaaatcattcccattggcttgggttcttgagtcatcggatccatcattcccatagcctttgttaccagtattatccatctgtcacaaggtagaggttgagaggggaagcatacaaggaaagaatagaccagaactagggacaagaccttaaaggaactaattcttcttgctgatgtgctgtttgtttcacttattctgcaagttgattaagcaaacaacctagcatggttacatcacaacccaccgatgcaaaccacgcgctacacacacaagcaaggaacacacgactaacaacactaccctagagggtggcttaggttctgcgacgggttctccaagatcttcactcctgcttcttctcagctggcttcactgcttcctccacttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccacttggcttatcctacagtcaagatggctctgataccagcttgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccgaagatgcataattaatgcaaggggggtacaaggagataataatataggggttaagttttgcagtaaacggcatttaaaagtcacttagttgcccaaagctattttgtaaagacgatcctagctatacaatattattaaccaaggccgtgaaccctcacgaacctgccttaacccaaggcctacgatgattcagaccgaactggcaacccgaccctgggtcccagctcgtcccaagccaacccaggccaaccattccacagtttagttgttgagcaaattttaagaattataacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccaagcttaatccttatagtacccgaggtacgactaacaaaacccaaccacgcacctcgagcccagcctaaaccattttgggggttttgaaaagagggggaggtgtgtgtccaattccaacataagccaaccattccaaagtgtccaaatgatatgagaatatcccaaagtctagagttgtaaaaccgcctaatgttacctaattaaattgcgaagcatctacctaaatttaaactagggataccacgagtagagtgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcagagagaacggccttccgaaccttcggcgacgaccacgaaccacgcttctggaacctccggaacgacgaagactacgcgaagcacacaagcaaagctacaagcctaaaaagaagcaataacaatacataaaaagaaagcacacggttctttaggttatacaaacattaggagacttgaacgggtcgattcagagctcgtatgaccaagatatgatcatccgaagtttaatgctgttatatggagatttgcgaattattataattaagctttgcaattataaaacatgtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccaacaaacggagtccactagacaccacacgggctgcacacgtggaaaccacgcggctaccgagcgggcacactaacacggtcaccacacgcacaagcgaacgactaccgacaccggtacacgggtaccggggtcgacgaccgcacaacgggtacggggcgacaccgaaaggacgagggcggggaagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacggggcttgacgacgcggagccgaggacgaagacgaggacggggctgcagcggcgcgcttgacgaacgcggacgacggacgagaacggctcgacggagggacgaacgccacgacgaccgggaacgacgagaggacgacgacgacgacgacgaccgggaccggcgaggaggcgacgaggacagccggcagtcagctgcacggagatggggacgacgtggaacacgccgctacgatgccgacgacggaggcggcgccgcgagacgacgagccgggcgaccgatgggacgtcgatcggcgaggacgaacggtgacaaggaaacgacgatggcagccagcagcggctgcgcggaggaggggacagcgtggaacacgccgctgcgatgttggtgaaggtggtggtgcagcggggtggcgagccgacgaggaggaaggagaggccggcgcggagacgacggcgttccggcgaaattcgggcgacgccgtggcctggccgggagagaggacggcactgcgacgtcaacggaggagacggcgacgtcggtcggcgtaccggcgacgaacagcagccggccggagacggggaagtggtggcgacgccactggacgccggcgaggacgcgtctccggtgctttccccgcgaaacggagggctgaccgagggagagggggcagccgcgacgccgggagaggtggcggcgcagccggagggtgcacgggtgaggcgggaggtgcggctggaggtggccggctcggagaaaagaggagggcgacggcgggaaggcagctccgggggtcacctcgcgaaacggagggcaagccggggtggaggaggtggcggcgacgctggaggaggcgacggcgcggccggacgacgctccggcgaggcgggagaggcggctggaggccggccggcaacgtgggagagagagggcgacggtggggaggtggctagagactacgggagaccgcgggagggggctaaagcgatagaacggagcgagggggttgcattttatagcggagggaagcgagccgagcacgggagagggcggaacggcgacgggaaggatggccggcggccatggttggtggccgggaaaagtgcggccgttcccgatgattgggggcgccattcaagggggaattaagggggaaagagagaggagggaaaggggattaattccccctaatcaatttgggaatcccatgcttgattcgcgcggatttgagggagtaatgg

SEQ ID NO: 41285 - DNA, 2335 bp, Oryza sativa
gggaaagggagctgggccgagaggggaggaggcccaagaggagggagagaaggagagggagagaaagagagggaggagagagagacttcgggctgggcttggcccaaaggaggaagaggagaattatttttaggtttttctttttaataaactttgttaattgtttttgttgcttaataaatatttccggcgctctgaaaattcaagtaaaatttgagggctccttttagaccaaggagaatttaacaaaaattctccgggccacatttgaatttttcttgtacgtattttagtgtttgccaaattcttttcgaatttttaattaattctattattccttttagaaaatgaattttaattcgggatgaatttatcaggacgtgacatttaacaggttcaagcatatcagctttacatctcctcggaggttgctgatgtggcctaactcctggtttaataggtagccgatgttcgacgatcgatcggctgagtccgggcatctcatagtattcccaagcgaagcaatctctaaactcttttaagagctctatcaacttggttctgaactccgaagacaagcctttgctaatgaatgtcggccttggtcgatcgcccggacctatatcaatttctttcaaatcatcggccgacataaaactttgaccctgcttatcatcgagatcatctactgtgtccttagcacaggtatctgaaccctccacaacgccctcaaagtaatagcttgggttctccatcttcaattggctgtatgtcagaatcggacacttttagaaaatctccatcccagacttttccagataaacaatcaaggccatccatttcctagagagctaaatcggcattggcaacattgactgaccggtcggctggcacaacctctatcttgtcacattgccactgaatcaagcactgatgcatagtcgaaggaatacaacaattggcatgaatccaatccctcccgagcaataaactatatgaacccttcccatcaatgacaaaaaacgtggtaggaatagtcttgttgccgactgtcaactccatatttaacgcacctttggtttctgatgggttaccgccaaaatctttgagcaccatattcgtcttgatgagatctacggcattcctacccagcttcctgaacgtagcataaggcatcaaattcaccgctaccccaccatcgaccatcattttagacatcggcttcccattgacgtaaccatttacatacaatggcttgagatgccgattctccgttccctcaggcttctcgaacaccgcctgctccgatgatatgaccaacttagccgattcatcctctacttcatcgacatcggcctggctgattccaaactcggctggcagcgtaaaaaccatattgactggtgctgtaacgacactctttccttttgccaatctctttgcctcatcggctgtagtatcatcggctgcaggaacttgggtcttaacgcgccacacctgccttggtcttggtttcctcagtcaatggttgatttcctcttcaacctcctggaaacgctccctactcctcaatctctggaccctccttttctggttcttcgtaaaaataccagaaggacaccattgattcttcctggtcaactcgtcctcttgattacgatcgtgactcattggacccaatctttgatgaacagggagtcttgtctgtctcagccgatcacccctatcatgtggtcggcttaagctcttaatgacgtcgctacatccaggacaattttcgatagatggcaacctcatcccttcattccagcagaatctgaagaattcacaatcccaatgaggatcaaaaccgttgtcattctcctcgtagcatctctcctgctgcttgttatacctcctttgatatttatcaatgattctggccgaatgtacttggaagctcttcaaacgaggtccatcggctgcttgacttgccgtatacaccatattgacaggaaaaggattcccatcgaccttcatcggcttcttggagtcatcaaatttaatctttcccccttcgatggccacctggatttgctgcctgaagaccttacaatcattggtagaatgggatccagaattatgccacttgcaatacctcttcttgcctaattcctcagccgacgggatcgtatgaccggcaggaagctgaatctgcttttctcggattagcaaatcaaagatcttgtcagccttagttatatcaaaatcatatttttgctcctttccagggttttttacccattgacacggtataaccttcttgctcctcacccactcggctgcagcgatctca

SEQ ID NO: 41286 - DNA, 2384 bp, Oryza sativa
gttggatcgctgttaagtcagacagtttcatctcgtgaaccccgctgtagaagtagctatgaaatggtttttttaaatcagcccaactattgactgacccatatggcaaagatgagaaccatgtaaaagctgatccaaacaaagacaatcggaacatcctaactctcaaggcgtccacagctgacgcttctccacactgagccagatatcggctgatatgctcgtaggttgatacgccctcttgtcccgaaaacttagagaaatccgggattttaaaccgattaggaagaggaaccctctcaaaccactctagataaggctgccgatacaagcttccggtctctttaggcttgagcccgaattgttccctcattacatcggcaatcacatcggcccacggtcgttgctgagctgatccttgcggttgctgctgcatggattcgaactgaccaaactggggagcgaactgctgctgagccgatcctcctggctgatattgggcttgtatggatgaaggctggtacctatagcttaagttgcccccttggtagtcgtgcagatccggctgaatattgcgtaccaagtgctcagggaccatctgaggtatcacagtgccatctggttgtacgtgatgaaccaaatgttctggggtggcttgattcccaaactgctgcgcaggttgccccccaggtgctgcgaacccagccgatgcattagccgaccccaggtgttgaatcgactgctgccgtaccggagtctgctgaatcggctaaagtcgttgcctcggcggtgtttgttgatttggttgaaaatgctgctgcggcaatgacgcttgctgaaccggctgcagaacttgttgttgaactggttgtaccatcggctgaactggtggcacaacttgttgctgaaccgactgcactatcggctggactggcggtgcctgctgaatcggctgtacagcttgttgctggatcggttgcaccactggctgaactagcagtgcctgttgtgctggttgcaccacttgttgttgggttgattgtaccgccggttgaattggtggtgcttgctggatcggctgctgttgcaccaaattaacaacgggtggtggcaggaacatagcagcaacctgatcctgagttggctgatttgtaatctgttcggcaggctgtggatactccctcaccagtaatcttggattcatcggctgagccgccacagtagccgatgcagcaggtacagatgttgatgctgacgccgttggttgggctgttggcgcgacagatggagccgcctgcacaactggctgagcatcagtgattaaggtccagtaacttggaaaaactcctcatggcaagtaaaccgggcctgtagcctgaaactcagctatcgagccatcggctattgccttcatcatgtttgatagcgtgtcgactaacaccccggactggttaatcaaagcatgatgtaccgcgtagtcaacccgatcttgaaagttgtggaaagacacttgaagatcttgactgaaatccctcctggtagttcttggggaatacggcttggagttccatgcacctctggaaggttatcgccttgattccctgcaaaaccaccggtagctcctttggcgctcggctgagccgagccatctggatctcgcttaatttccccatctttagatgaaccggttccagggatgtcggcgactagcttcaacttgtacttctgaacgagtgatcccttgcgggtttgcatgtatgagctcagatactgatcccgtgcttgttgcatcattgcttcgaagtcctgcttctgctctgcttgaacttctcggggtcaaccggcaggacattgtcgtcaacgatgtcggtcagccctggctttggcggtttgcctttgccggagcctgggcttggcggtgctgttttcttggccatgagggggatatgacgtctgacttctaatcaggtcccaccgggcgtgccaaaagcgtgttgatagaaaacacgaggcctgggagatctgcttaactccagtgcaggtccaaaactcgccttcggatacgtgagcgtgccagttgatttgatcctacaatcaacaagaaacagagacaaaagaaccgtggttaaatctataaatgatagccgatcggccaggtgccgatgacatatcatttacgtttgagccgatgtcatatatagatcgatcggcaatggaaaatagataataaagaactaaatctattcgatcggctgtagatattaacaatacataattcttatatcgacatatacttaagttaagtgattgggatagatcggccatcatgccgagacagtacaaatcacttggactaaaagatatgtttataacagaactatata

SEQ ID NO: 41287 - DNA, 4030 bp, Oryza sativa
  unsure (1)..(4030): unsure at all n locations
tgaagatgtaagcactaatccctaagaacataattcgtcataacgagctttacctcttgttgaagatcgaaaccgatgcagctcaacccggaagcaagaactcgtcgaaataaaacaaaaacgaaaggtggcgatgcgccggaattgtattgaatgtgtgtatttcgttacatagggttcggggtctacttatacccgaggattacaagatatgcccgtaccggccacgaccattatctctaacaaactctaaaatatcacgagtctttgcggcagactcttgcccacacttatctataaggaatttacataaataatctaattaatagatacaattgccttctcaggactctatccagacatggcaatcatcttgaagcacatcaaactgagcccgacgtcgcgcacaagtcgtattatcagaatcggctataccagcctacttagcctagctcaaccttagccgatcctagccgtagctgatccagactctagccgatccttgctctgttccagaactcgatcttcgtctccaactcttctccgattaagtcccttttcctgatacaaatacttaccaaatttggttgttaacacaccagtgcgacttcgtgcttgctctttcgacttccttggttcacttcgccttttccactttgcttttggcatagacccgatggcccatcgtaagcccaccaaggccggatcgaccggcgaagaccccggtaaccttggcgtagggtggtcgtgctttcttggcaagtcccttgtcaaggaggccgacttggccgatttcatctcctctggcattctagccgagggccaggcggattgtgggggtgaagccgttgtcccctcgcctggcaacaggtgaacggtcgttttcgtcgccttccttgccgctggactcacgttccttgcgacgatttcttggcatcgatgctggcgatgtacaaggttaggcttccccagcttagcccgtccgccttccccaaattggtcgtctttgcatggatgtgccgaacatgcagtttcgaacctaccgccgagctgttcgccatcttgttcacggcgtgcgctacaactaaagatgtgaatacgccggtcgggccaagaaaaacggttttcagctgcgtcaacttcatgcttcggccggaacgctcggatgcctggccggtacttgcgtctatggcgaaatgggaacgaaactggatgcagaaatggttctacatcaacaatccctaccccgccgaggacattaaggcgaactggcttcgtttccggcgtcttgcagtttccatcgtcgcgaagccgaacgtggagatcgacggtacccttgagtcccggctcatcctccttcgcaaagttgtgcggcagttaagtacccgcgatctttgtgaggaattctgccttcttcgaatttcctcccttgctcgcgactggggggtttctatcaacgaaggcgaataagtgcttgggcttcctcgccttgttctccccgccgggaccgaacgtgagtttcgtttccacttctctcccccttttctgagttgccttttggtctgattcgccctctttttggtgcttttagttcgcatgttggaggacgctgaagcggaggcgtcgaagatggtttggggcctaactacggctgaattcgcccacctgctttcacgccagcttgacggccgggtgaaccgagttcatgccggcgaattgcccgatcggtctatcccctccacgggggcgatgacgacgttggaacgtcgaagaagcgcaattgagccgttgcgaagggcggccaagtgcgaacccgccgtgctgcataggacgcggctgaagttgatgccgacgaggaggaagacgacgatagggaggccgagtccgaagaggacgacgggtcgcatggctatacgcccagtccagcacaaccgaagtctggggcgggttcccatgtttcgtccattcatccacaaaacgttgttggcgcgaagaccctcctggcgatttctagctctacggcgaagccagggtcgatcgcccggaagaagaagaagaagggtggggtggtgcaggtcgctcccggcttttcagttagcgaggggtctgatgggacacccactttgccagcccagcggtacgctccccgggggggggacgcttttcgccacctcctgccagtgacgctgaagcgccgacgggaggaagtgcttcggcaccggcgattggggcgaacatctcgaggggcgaacgggttgaggcggtcccttcgccgactcatcagcgggatgggaaggcccccccgttcgtgatgtctgtgtcggacgtgatgctcaccgccccgcactttgttcccgcggatttcgctacgcggccggagatcaccccattcgtggatggggtgtgccaagtcattgcaccatccgacggtcttgggcttttcaccgaactaaatgagttcggcgagagttgcgcggccgcggagagcttgttcgtgcgggtgtgaactttatctttcgcctgcaaaatttctcctcttttcatttctgccacatcataacagatttggtttctcttatctagggccttgcggcgcacttaagtgcgaaaaagtccgccttggagaggctggatgggtaccggcttcgaccgctgaaaatcgaggaggatcttcgccacaaggaggacgaaagacacgtcgtgcggacaacttaaaaaagtcgaatgcagagaataagtctctcacgggcgaaaacaagtctctccatgccgacctggaggcggcgaacaagcgggacgctgaacgagatcgtcaacttgctatggccgaagagaagatcaagtcccttgaggctcgtcttgtctcggccgaagctgctactgcaactcaggcgccggtgacggagtccgccaaacaagccggctacaccctcaggctagctctcaacaacctcggcgcgcacggggaaggcgctccgagtgacgacgggacggcattcgacttctccgagttgacgcaggaagcggccggcttggtcgtcgaagtggccagtgcctacggagactgctgtgcacatgtttcggcgggcttcgttcttagcctcctgcacgcgcacggctgtgaccatatcggggatttccctgacctcgtgaaagaggattggcccgacaactcgcagtgctccggggcggccttgagggccttccgaatgggtttatgagaggatggtggccaggattgcgcgaagactcagctttgcgagaatcttgaaaggatcacgaaggacgaggaagccgctgctgccaacaccggagaggaccgcgggtcgtcggagccagccaccgaacacgagggtgaaggcaacggaggccaagaccaccctgaggtgtgaggcccttcgtcctcgtgtgactttttctctttgcccttttaggctttttggtagtctttctatgtatataggcgccttgcatgttcgaccttgagccgttttcgtcttgtagccactatgaccttaattttattaatgagaaagttaatgtttcgccaactttatgattttgctggaaagtgggattgatttcgtccgcatttttccttttgcacttgttcctttgtgctttactaggaggttcgtggccgaaaaatatgcgttcggccccccgctgataattggcgaaacaagaacgagaagttcgtggcggtgaaaggcttgccaaagaccaagtgtccttttcagcccgttttaccgtgaaatgttaataaacagcaacagctacaaggttgtaaaggttgccgaatggatgcgcacacacccaggtagaactttagaagactatgatcgtcatcgtgtggcgcaccgcgaaggtagtgtgaatttttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41288 - DNA, 5916 bp, Oryza sativa
attttgaaattaataaatacgagtattgagctgtacctgtctcaatgtctcaatctattattccttaatttaataatttttaaatttgatattaattatcacaaagttgtactccctccatccacaaaagttatatctatttcacatttgagtttttccaaataagttgttcctatctgtagtctttatgtatttaaaacttaaatgaagagataaattaaatgttttattagaacccaaggagtcatctaaatactcattggttgcatgcttgcattcactctttgattttataacatctaagatgatttaatttctccttggttttggtgtcagaagtaatatgtgtaacttttatagatgtagggagtaactgccttggacgtcaacaaattaaagaggcagaaactgtagcgtgtctcaggggtcaagatcgatggatcatcaagacgggaaaaatgtacaacccaaacgtgacagatcgatgcagatatctccttatccttttctttttcctttgtcttctttttttttcttcttctctttcagaagaagaagaagaagataatttgcatcgagatatttagcagcagctagctttacatcgaccctgacctgacgattctgctgctgagacggccagtcaaattattcctctcccatctctagctttttaaccacacaaattaaaagctggcgagacacaaagacatgacacacttaaagcaaagtaacagtactgaatcagatgtgtacgttaagaatagttatagactcgacaggagatctgctcatctccaaattaatccggcagctagtactagctgcgtactccctccgtactccgtactcataaaggtaatcgtttggaacaatgtttaaattaaatcttaggaatataaatcatgaataactctcaagttgttgggtttaaaatgtaaaaaatatatgaatagatgtgtcttaaaaaaatactatcatacacttttcaatatttttatagaaacaagaagtcaaagttgtgtttcagagaccgagtcagctgtccaaaattgacttcctttacgagtagggggagtagttaactaagctgtgttccctcctccgacacgtaaaatgaagctcgtattactgcatgattaattaagtattaactattttttaaaaaaataaattaatataattttttaaaacaatatttatatagaaagtttttttataaatcacaccatttagtaatttgaaaagcgtgcgcgcgaaaaacgagaaaggtgagttggaaaaatgggggaagaacacagccctagtgagttgaccgttgatttcccgtcaacagctactctccctccattaaaaggaaaaagaatttctatgtatttcgtaaataaatctggtcaaaagaatatccgacacctagaaattcatatattttaacggagagagtagaacataccactcacacgtactacctgcattttaaagtatagaacatattttattttattaagacaagactttaaataacaaatatttcactaatatatcgttcatatcacataatgatgtatattagtgaagtaattatttataaccttgttcgaattaccaaaaaaatatatttgaagatacaaccacttttgaagacaaacgctggtacgagaccctctatccgatttagcggcacatttggccaagtgccggctttaaatttatcgatattatcggatacgttaattttttttataaaccatatcataatagagtacctgttgatcaaaatgttatataagaaaataaaaatatgcaatatatattttaaaatggatggagtacgtacctaccggcatcctgttccgtgtacacgtacggtccgatcctcttgtgatctggtcggtcggtccacgcacggaatgattgggtcggtcacgtaagcaggatgagcttttgtgcggattccggctcgtacgtacggccgagagttatcgagatcgccagatcggtttatatagatatggcgtcgataaaaaggtaagtatacttaagtgccttttcgttgtatattgctaatcaaaccataattaattcgtattttgctggggtgggggggggggattttctagcgagtagccgatcgagtagtacctaacttggatgacacgcgtgatgcgtgatcgatgccatgcaaaagcgatgcaaagccatgcaggattgcagtgcacaactggcgtgatcagatgaactgcggcgtttggagctgtggcggcaggccggcatctgtggtgatattgattgaatatagtgacattaaaaatagttttgcaacactgtgacacagatatttctaaaagaaattgcaccgaaagagatttatcacatcttaattgcaaagggaactggaataatagtcttgtcctcgctggtggagaagtggtttttacttccgattgataacttttgtagtcctggtttttcaaccgggactacaaattgatctttagtcccgggtaaaataaccgggagtaaaaatcaaattttagtcacggttggtgttactaaccgggaataaagatagagccgggctaggtccggttgctcctttatttttttttcttcattggttttaatatattgatttcactccatccctgtccccgaatcgtcaaatcccaaatcaatcatccctgaatcgtaaaatctcaaatcgatcatctccaaatacatcacaaaatcttaaaaaaaattacatcacaagttttgcaaaattcatcaaaaatacatcacatattcacatcacatacatatcaaatacatctcagatccaaaccacaaattctcaaaaaataacatatctagccgctgctgcgccgccgccggcggcaggcgagcagagcggacgccggtgcgccgcccgccgccgcgcaggccgccgccgagtaggccgcctccttccgcgagctgcccggccctccgccgccgcgtgcagagaagtggggtgtggggaggagggggaatgggaggagaaggagaaggaagagatagaggagttaaaggagaaatagatctttagttccaggactaaagaaaatataggggtctaacactgcctgccctcttttgaaccgggactaaaaatgttctttagtcccagttgatgttaccaaccgagactaaagatcaaaaagtacccctaagcttttaaaccggaactaaagatatttttagtcctggtttttaatacaaccgggactattatgaaatttggccaaccgatcaaagatggtttctctagccgtgcctgtttttgttgagactggataggacatccataagatagcttaactactaaattagggtaaaggaaaattttaaatgtgcataaattgtgcacactactgtttattaatgtttcctgagagtattcctataatactttagtactaattataattacttcacatatataataagcaaaacaaacactaatattcattaaaaaggctaattttctaaccaaagctaatttgactataaggagaatatttccctaaatgtgacaagccgctatcatgcatgctacgttattcttgttcgtcccaccaaccaaatatatggacaaaacctagtcatgagacgttcctttcctattcccttggtcgcactaaccaaagactagctataattgtgcaagtagtgattcgtgtacgtacacataagaacctcatggtgcttgattttgtctgttaacgtaacggtgtggtacgttaaatttttttttgccaagatttaattagtttatctaattaatgtatcgattactcttaaatttaaccatttcatcgacacctaacgatccatttttttaaaatttgtgtgaaacaaatattgttctaatttaaaacaaaattgtacgtactttcgtgaacccacagtccatatacgcaataatatcaaatatatattgaaaaaacatatctaagaaatttcagccgactaccaaaaatgctatttttcataggaatgttggaccaggaatcagccactgcaagttggattaatggcagccaacaagaagccaatcactaacgtagctgtttccaaaggatcaaggctccattttgtgctcggaatattaaacatatagctaggtaactggtaagcgcgcactgccaagtaaaaaatgtcgataaaaactgcaagcattctccacgtggaattaaccgtcaaaattgctagaaattaattaccaaaagttaagctggaaattgaccgtgcatttgtttgcttttatcaccgcgttagtccatgttgtcctcttcaggcgttctaatttgattgtttttttcaggagttctttaattaattatttccagttgcatgcattttttaataaaggaatatattattccggcctctacataagacatgcactcaaccattcattattacaaggatttccaatttcaaaataaataacactaacaaaatagcacgtttataaaatttgagcttgaatgagaatgcttaagcacaaaacctactagtaaacatccacccatgcttgcacatatttacagttgcatgtatatataaaattacaaattaaatttgcaatgttgcatgacacgtttttccaaggaccgttatttctccacatcattgcgataagaacaagcaaaaaactttcgcactaagtgttcatatgcatgatagtgggttagctgcaaagaatgatccgtttaaattctctttgatttcaaggttgatctggtcgctgccgtgacaatttgctgcatgactccatgaggattgaggatggtcgcaccgtcctttgatgttgcttttctctgtaccgggtatcgattccgtatagaccatcttgtcaattaaaattcggtggcaccacaaaaaactaccaacagcgataccttctgcatttgtcgtagtccaacttgtaaagtgtgttattggtcgtgattcgaatactgacagaacttggttcctccaaagcacatgaaagctctgaggaatttcccaatgcaagtttatatctcttccaatcagcggcggattgatagctcccgggcaggttgggcgcgcggccgcccgacctccgccgctgctatctccatcgccgttagccattgacgtgtataaaaatcagtcggtcaccgaaaaatcactattactcgtccgggtttcacggtggtgctggttccgccactgcttccaaacgtatacagcttgatcgattgtttcgaacatatccgctctacaatttatatgaacttctgtacgtatggataggccgttccaagtggtggaaaaaaaagaacaaacaattagttaaacacaagtacctttatgacagtctctattgagtacatagtattactagtaggtactttcaatattattacaagtatattatatcttaattgtttaatcatgaattctactactagtataaaaaaattattctactaccgtacaattagtatatatgtaaaacgtctatttgaaaaagtgaaagcaaataattagtatacatgtataaaagtattcggtgatcagaacattggatttgcccttcttttcctatacttacgagagtagaatgatacggggcgccatttggctcgagataaagttttgtttcgccagggcatccacaatgtggcgtaaaagtagtccataagcaatagaatattctattcagccacctattctcattgtgcaactagtccatataaaaaaaatagcaaaagacacccatatgcatatagactaccaatatggaataaattatattatctatctctactcctctctcttcttctaatgatatcttgtatctatatacattgtgaacattgtcatagggataaactatttatgtgggttccatctatatggatt

SEQ ID NO: 41289 - DNA, 9381 bp, Oryza sativa
atcgagttgtttcgttacttaaagtactttaatcatgatttatatctcacatattttcatagaatttttgaataagacgaatagttaaatatatgttaaaagtcaacggtattctctattaaaaaacagagggaatatatgactaaattttaatacttagtaaccttagctagctagttgacaaattaatcattctacatctccgtacgtgcatatatatatatatataacggaaatatcgcctagctagttccccctagtgtaggcaatcttgtctaagatccacatatctaactaaactcaattagattttagaacactggagaaacatggatcttgttcccactgtccatacataggaggaatataatctctctccttcttttcgggaagcctgtaaatggaacgcataggagcatgcggttctattcccacatatactactcttttattaaggattgacatccacatacagagatgtggcttactcctgcagataaataattagaccatgtggaggcctcctcctgcctagactttctttttgcctatccatcatattcatatactccttccgtttcaaaatgtttgataccgttgactttctagcacatgtttaaccgttcgtcttattcaaaaacttttgtgaaatatgtaaaattatatgcctacataaaaatatatttaacaatgaatcaaatgatagaaaaataattaataattacttaatttttttaataaaacgaatggtcaaacatgttttaaaaaatcaacggcgtcaatcattttaaaacggagggagtatattgaaccaaccttactaccaccttgcctcacctaggtcattcttttaaccaattatgtatatagtgtaatatatatagtccttttagtttagtttattaccacttaatcagttttggatatgaatgttctgtgacttatcgatcgcgattatatgcatttggataaaagttttagttagtgtaactggcaataattcaactaatttctcgactaaaacaaatgatccctaaagggaaaaaaaatactctgttgggtcaccattttcacgggagaaaaattcaatacaaatggaagaattgtggactatactactatttgaagtgaaaaaaaatgtgattagtatgaatattggctgattttggctacggtaactgagctgcataaaaaactcctatcttttaattgtccgatgaattatatataataaaaaatagacttaaccgggatattttataataatctttactggtagtagaaatcagtctaaaccgtttattgtttctaatccaatgtaccgtttctgtttttactaccatatcaactaccgatattacaatagatttttctattgttacaagtcataaataaattattggaacttgtactgtgataatgctaatagtacgttctactacttgtagagatcaacttccggttgttataacagattatttaatcttgtatggaatctaatctctgtcgtttataagagaatcttgtgttctgattcttatttggtcactatccatggggtcaccgtcttttcttgtttgttcaagtggaatatctcttatgaattattgtaagaatatattgctaatgccttttcttccactgatcgattcactttattttttgacatccttttaactgtcttgtggtcgaaaacttctacagactgcaggcaatttgaacttgaggtcgcttgtcgatcgtccataatttatagccgcattttaaccatgttaattagccaccagcaattgtcggggaattcttcaacacatcatttggatcactaatcttttatataactttgttttaacccattattaattgcaagcagcttgctagccacaacaatatgacacagtaggatagtacttcctaatttggtagcaggacagagcaaggatgaactagtgatagttttttgtcctacatctgaactgcgaattccctttggaataaacaaacgtaaaggctgttcttgggagaggcaggccaaccaagctacgattgttagtggcatccaatgtacacacaacaagatctctcctcgaattgctttcgtgagcattagaagtgtggagaagcattgctttttatgctattggctgcaagaacttaacgaagaagtttcagaaatcatgttgagatgttttctttctttatcttgaaagcaatggcgaggctttatcaaagatctcaatcggttgtggtgacaaaaactagtacagatgacagttgtttgtttctgtgcttaaaaaaaaattgtaccaaacatatgatttgttatgcgatgtgttcgaattatgtaactgaagaaagaagttgactgatgtatagtttaagtgacgagcttccatcatgtcgcaaaataaaatatgagaccttgtaaaaaaagtacaggtacgatgagatgatcctcctctcaaacttggttgtatatgtttcaatctgatcatgactttaaactatctgttaattttttattagtaattttataatgatcgatcatgttcaggacggctccagaaatttaggtcgcctgaactaactgcagcacatgatagtgattagtgtgtaacctacttcagagctgcatcatgtcaaggaaacataagaaaatcaaaggacaagactaatacctagagcatccaagagcacatcaagtggttgactttagatttaatgaacttattaatacgcttactttgtctatcaatgaagttagcagccacaataataaagacctggtcccagatcaggagtacgatgcatcagaagaaaatttgctctgctttgctggttcattctgattccaccagctgtttgctatgatgaaacctctctagtattttctgaaacttcacatgtcagaccgtttactttggagtaacataagaattaagaaacgcagagtatgaaattgaaagcgagattaaagaaaaggaagaaacaatataatacttttagtggtccaatcgtcggttaattaagttattatccatgttcagccatgttatgggcgaaattcagacgtttttaattaaccccataaaagttgatagattctgcaagagcgatatgacattacacgtatctttcacacgcaggcagggctgcgcacacgtgtgatcgctctctagcctattttgctgaattgaagaaagatagtactccctccgttacgaaatgtttgacgccgttgactttttaacacatgtttgaccgttcgtcttattcaaaaattttaagtaattattaattcttttcctatcatttgattcattgttaaatatatttttatgtaggcatataattttacatatttcacaaaaatttttgaataagacgaacggtcaaatgtgtgctaaaaagtcaacggtgtcaaatattttgaaacggagggagtacatagtcatgcttcgtcggcagggtagctcgatcgatgtctgcaggctgcaatgtcgtcagctagctcagcggctatatatgcgtctccttccttatctgatctacacaagatagcccaagattggaacgaaatgtcactcgatccatgcttatctttttcctgcatgcatggatgcgtatgcatctctgcctgccaagccaatgccacctctcacgcagacaacccgatgcatggccggccggctgctgctgatatatagctggagctagcgcgtcatcgctgctgatacagatatacttgctccgtgtcaaaatgttgctatctaatatatgatcggatattttctagtacaacaaatttaaactgaaacctattttgatttgttatactataaagtatctaatcattagctaggttagtagtaatatttcgggacgaatatagtacaatggatcagtgacgaaagcagcggtttcggatgcagataccttggccatcgcgacgagcaatcaatcgatcgatcgatcaaggcggatttttctgacggattgatggtgttgcggcggttgggtccatcactccgaggcgcgggggtcgtacgtcagggcggctggcttggctgcggagattgggccgggtagccggccggccgaccaatttactgactctctccgccgtcgtctagccatttactgcagctgctgctgctgctgctgctgcggctgtcacggcgttgtgactgaacgccgaggcaaaaccgtcccggagctgacgaaatttgttcggtgatgagatgccagtggttcttgtctgcaaacgtcgtgacaatttacatcattgccggaggtctgcgagtcatttgatggaagagaagaaaaagatgtctcggctatgtttgaagcaaaggtttgagaaccgtttttcctcgacatgcaaaatggagggttgagttagcacatagttaattaagtattaacttaaaaaacttaaaaaataaattaatacgattctttaaagtaattttcctataatattttttttatttaaaaaaacaacagtttagtagtttgtggagaaagagtagtaaaagttaagggtggatcactgcctggtcttttaactgaccaagtggccatgtttggagagaaacattggagatgtataccttagtgaaattgtgaggttaattctatttggatttgaataattgggaatcatcacagtccgtatgcaaacaattaatccaaagttttctgtagggaaaaaaattcataaactgcaatattcattcagtgaactgaggccaaaatcagttggacatgatgtgtgttgccaaagaacaagattatatttctgatgatgggcccttaaacttcaatttaaagcaaaatgaagcctgcttcacagattgacccaatttgctttgggccttaaaaagaaaggcctaacggtaacttttaggtccaatcagatccagcccatagcctaaccagcccattgaacccgtctcttctacccttcgccgacatcgccggagccgcgcggcgcgcggcggccggcggcgagctcggatccccacctccacccctcccgactcccacgccttcctcctccactgcgacctacggtgtaggcgcattccgcctacgtggcctcgcctccgcctccggttcctccgccacgacgtgtccgcgtcccgtccactcgcccgatgaggaaatttcccttctgtactgtttcgcacgactcttccgccgacgaattcccccgcttccccatttcgtctcgcggtgagtttttggtagtttagtttgatacaccacttcgtttgataccctcggcgaccgcgcggcggccagcgggcgcatccatggcggcggcgggatccataggcgtgtacagggcggtgttcgcggcgctgggcgctctcatgctgggcaccctggtgtacacctgcgtcaccgacggctcgccgtttcgcctcgagctgctcaccccgtgagtgcgttgatacaccacttcgttttccttccccctccatggaagaggattgggtgctagttactgccgcgaattttggtagtgctggctaatttcagatgtgctagttactgattgttagtcagctattgctttttttactaaagtagaccatttcaagcttttggatttttgttttaaatttaggcgtaatgattagcaaatgttgggagtcactagtactattttaagtattattccaatgttattgtctgtgacctgcacaatggtgctgcagaaagacaggaagtataggtagttctcgatggatgcaactttggataattaagtgcaccaattatgctctagacctctaggtttgtagtttgtgcccaaggctttgagagagtttgtatgttcttaacgaatgaactatgtgttgcatcagagtagggaggtcagaactattgtccaaaagcgccttaacttgaagttgtaatttttctctgtgtaggtggttggtggcaacactgattgatttttatgtcaatgtgactgcgatttcggtaattcatttatctctgtgctgtactttgcgccctcttcaccaactagttattttgttacgaaggaagtgtttacaagcagtatgattagaaggaattattttttggagcgtgaagtgaaagcggcagcagtcaattgtttgcatgcattgtacaaaagtgcaatatgttctaccattttttaaatctgttatttacgaataaattcaatgttgccaaaacatatttcataggagatataatgcttggagttagaccttttttttttctgtgtgtactcaattgataaaatgtttgctaaatttgcgaatctggtgaaattttgatttccaccaaacatagttcctgatctgtatgagggaatggtatctaactggttgaagctttaactaaattgcatgacgattgatctcagatatgaaatgatagtagagaagttttgttgtattatctctcttaacatgtattttttttttgtgtgtgtgtgtgtgaagtttggagcttttgctgatatttctgctccaactccaatctgtgtaccactgaaaaactaacagagaattcttttgtgtgtcttatcctaattagctcctttcccctgattaagacaaacaatttctagattccaccttaaatatatacacaaactaaaggatatttggatctgcaagggttgaccactcaaatgctttgctctacatgatataaataatgtaaaagaaaatcattatttatttgtccgcttcatgtatggagatacaattttaaatattatttcatcttgatgtgagctagagatgttcttgcatgttgcagacttgggttatctacaaggaagtaaattggattagttctttcttttgggtagttctgttgtactgttttggcaggtactcatttccttcttgataatatttgtggcttgtcaaactttcataattctgtttgaatggagatattcattttacctaatgtgatcatccttttttcctgttatcttttcagtattgctacatgtgcttatgttgttgtgaagctttttgaaataaaaacttccggaccttcacaagatccacttgatcttttattcctcaggtacagattcaaatttttcctagcgtatgcaggatgaaaagattttagtttgatgcttttgacagcataatttggcaaatcaagtaaaaaaaagttttttttttacatgctgatattgaaaacagaaatggatttggcaattttgttctttttctgggctgggggcactgatggtctggtggacatggactataagaagcttatattggttcatggttacgctatgttctctttcaactttggggggacctgtgaaatgtgttatcctgtagatttcaacacctacaacaagaaacttttgctttcacagtttttgcatcttttgggtctagatccctcatatgttgagtaatatacctaacactccaaattccatagttccatagtgcatgctctcaccaatgtggtgaccttgtgtcacattctggatgtctaaggaatattgttgttcatatatcaattgttattcttatcttctgtgttttgaggtgtttctcaacttcttttcaggcaaggagatctatccgaaagaaagtcctcttttgtcataattgggagaattattttcagcattttgggggcaatgatggctgcagtcgtaatttatactgtcatcactgatggactacctttcaggaaggacttgttgaccccgtaagtgaaccatatttgctcagattatttaagaaaccttattttctttaagtacattctaagtccagttgaatgcagcaagcaaaatggataaatcccagtgattgaatgaaagatcacagaggcatagattgataatacagctaaaggaaattttgaaaataatatatttaataagcaagacaaatgtgtatttacaagtgctataagcaccctatgctgaatttacattcaagagttaaactagtaactgtcttgttaggagcacttagcacttaccatagttgtgtacaggcaaggagaacattttacttgtgttctggacttatcttctaaaaatttgactgcaaatagtcataaaaaattctgaaataacttagcagtatagatcattatctataaaaacaatgtgtaaaaattcaactgcaaatgtggcttgtattgggagaaacaaaaaaacaaatatcagtgaatagtagctttccctttttctttttgccattccactttccgttgaatttttcctttctatttcttcatgtccacatcaaatttagatttgaaattttctatcatgatagttgatagatttattttgtatcaccactaccaaattatttgagaaattttcatgactattttcaccataagagtaggaagcacaggaagtccatgcagagttaaaaaaagaattttggaggccagccctaagtaatgctctggaagtacattttcgattagtatagtgttgtatatgttttcacatgatttgttaaatttatcagtacatgcttcaaacatgctaactctgtagatgttgtctggcactttttattttcttttttccttattatacttgtgttatcaattagaaaaatatcaaatttaatattttcctttgcattcaggtggatggcggcaaccttaattgacttctatataaatgtcttcgcaatatcggtaaattacattctttggtttttagaaattgttccaagtaattttgtgcgacacactagtttgcctgcatgaatgcatctgcatcttggaaattgttgttcatatttttgtgcaaacggtgggaaacgatttttatttgctaaaactacttttgcatgactctattgttatttggaacagttgtcttaagctcagctctaatcatgccatggcacccacagttttctgctaatagttttttggtatttgttatgaaaatatattccattaaaatctacaacacattaatccttatgtccagtatattttatcatttttttctttcctctttgaaaatatgtgaagataatcttattttttaaaaataaaaactataagcgctaattagcaatgctagctcaacctcccacctactgaaaaggtgtttccatgaagtaattaatacgtcctgcaactataaaatggcagggcactgctggctggtagagtggtagcagcctacgcactgcatgtagtggctatatcttctatcaggaaattaaaaagaaaaccgtcatagtggctatatcttctatcagtaaatttttggtgatatgtctgcaggtatgggttgctcacaaggagtcaaactggatatctactgccatctggatatgcttgtaaatatgctttggaagg

SEQ ID NO: 41290 - DNA, 1132 bp, Oryza sativa
  unsure (1)..(1132): unsure at all n locations
atcgggctcgcaagactcttttgatttgatacatctctatcttgagtgtgtgaaggagcctcaacgcagagcagggaagacttccaagcattataccccctagctctgccaaagtatgaagaatatgtaagccatcttttgccagttcttttgcagacagaattccaatatgcagggattcagatcattctcatattgttctttctgttggagttagaaaaatctaagggttggcaggctatcttatagaatagctgttaattgtggacccctggaaccaattcttggccactctgtcaattttttcacgaggggtaaataaggtccacttgttgatctccacattcagtagcaaagctttgagatgcccattgttgatgtatcctctaggttgaatagcttcacggcaaggttaccagaagcaaaccatgcttgccgtatgcgttgntgggccaatccatagtttcaactgatgcattcattcatgcgtgacaaagctcagcgtgatgtgctcgtgaaaagattttaggttgtttaaaatgcaaaaataacaaatatacctagttgaaagtaattaactagtgctccaaaatacaaaaataacgaatatatcagtagaaaccacatctcgccatcgtcttctcctgcttaaggcgcctgcgcgtgtcctgtcctcttaatcaagacgagaaagcgaaagcaaaaccaaattcgtaatcttagactacaaccagcctcaccagctgagctcaccatgaaatcacaccattgcttcctttcatctgtatctatccagcagccatgatgtcggatcgagtttggcctagacgatgcaagctaaagaacctcctctgggtagctcgagcgcacaccgccgctctcttccgctgccaagcccacaccaacaacatatctcgatcccattctccgttctcctgacttctcatcgcaacaactcgctggagcctatcatgaaagaagggaacgagaagatcgaattgatggctgggaagtgggaaccaatggatgagaaggataagaaaaacaatttggtagtagaacccaccaacggtcagtgattgaggaatgaaaaaagtattactccttcccaccgaaagtatgattctagatt

SEQ ID NO: 41291 - DNA, 8333 bp, Oryza sativa
atcccccaggtgaaatggaaaataaatccttatattttttaataaattttaaacatttgtgatgcttatatttgcagttagagagtctacctttatgtttttttgaagggattagggagagggcaataaaattaaatgggagggttgtgttttatttttgtttctgatagaaagtatatgaagaaattaaatagaaaatggttgtagttggttgagatgatggaatagaagtaggataagttttatatattaaaagtagctatatttttagatgaagggagtaatataattggcactatggtggatggatttctgtagttgtgggtcaatgaggcgagctgctgctgctctccatctatactaaactatctgtatatgcaccgatcgatgcacaggacctattcatctggaactctccctatgtgtgattggtatacacacaaatggatccaacggtccaattttgttcctactctcatcctaaggctattattattcacatgacgtggcttattagtttatgagaaagctggttgctttcacatatgtagatactagacaatcatactttaatggatctttgtaataatgtgccataggtcattgagcaaaagctgaaattttattttattatctaaaaaatcaatcacatattattcaaatttctcttaatcttatactctatcctccctctgctaaaatgagagagtacttgatcatattaaataaaagatattactactcataaaataattctttgttatcgcccaagagttctcccataaatttcctatattttcaaatcctgcaatcttattttaatcccaaaattttctactaatgtatctttttttttcaatcctataatccaaatatgtttttttccctcttctatctccatttattattaacatgtgtatgaatcgcaatataatcatttagtagtaatttatgattaaagtgagacgttgtaatcaacaataacagttattcgagaatggagtagtatttagctgctgtgaagagcccttgtgtgagagagttgtttttaaaagatcaaccttaaatatctcatagcattcaactacgattttttccctatccattttcgttttacgtgttttcttaattcaaaatacggccgcccctgttaattcgttcgatttttgagagatgacaaaatttattcacgcaagcattaatttggatgtaaatagattttacccgttgcaacaaacggatatttttctagtttagtccaaagtaaacagtttagataaaagatgatcaaaagtaaaactttaataataaaagatccaaagtacattcacactatatatttgcaacactaggcaacccacacgtcacggcctcagggcaagttttatgaaataggtggatcttgcatctaatcttgaccacatcatcaactaataaatgtagaggtaacatgtacaatactcacatctacactaattctaatatactagccccaatgtttgtttgtccaatctactcttcccctctttccttttgtcttgaattttgtgtagcggttatctcttgcatgagaggtggctgcttatctctctcatctcttctctcctccacttcactattttaacttatgtgacatctaggagattgtgcttggatgcccatagtacgtgccctcagggcagtcccaacccataacactagacatggtttctataaactccacgtcatcaagaaactagtactagacactattcttccaatgcaaacaccactattccatactccaatttaatgctacttatctcacatgatgtcttggatgttatgtaggaaccatgtctcatacaagacatggtttccttctctttcctcatttattcacttgccacatcattttttgtcttaagtggcaacttatttaatgctatggataccatcctagttattgggttgggaatgccctcacaaactcacagtaaataccggccttcattaatttttttcacaccggctagtctattcgaaccatcaagcgcaagcacattatctaacaaaaagctgcaaggagtagattggtatcttcatccgtgcaatttcattgttagtttgttggcttgtggcccatcacttttcaccatgaaacagccggtgcatggcatagttaactattattctctctaaaaaaataaaaaaaaaacttcttaaaacgaatctggagattatatacaattactcagctcgagaaaagctcaaagcttgaacgttctgagcccaaaataaagcttgagatctggtgaggctcgactcgagcttggctcattgacagctcaaatataggcaactatcaatctaattcgcaatactagtatcttcaaccctcaattattaaaactagtgcaaaataaccccttggtggttttaaggatgttcttttgctgacgtggcttgttaacttaatctaacctttgagtcatcatgttggacccacatgtcatcctccctctccttcccttctcactactttcctctccctcctctctttccccttctccacagaagcaagaaagtgggaggacgaggagagcgggagcggtgacggcggtggcgggaggacgaggagagcgcacgctgcccgcgagtgctaggagcacgttggagaggtcctcaaccagccgccggatactgacaaactagagaggtccttgaccggccgctggcaaccaaatctggaggtcaccacctcccatcgcccttcacccgccgtcctcaccactgcagcagccgtaggcgccgtcgcacgtcgctgccgccagcgctagggcagaaggggccgagaaccatcacccttcacccattgtctgcaccgcctcagtagccgcaagtgacgcccccgccgtcgggccctcgccgttggacgccgccgctccacgtcatcatcgttagccactgtgtgccgagaagaaaggaggagagagagagggagagagggggagaggttagtagaggaaggggatgacaagtaggaccaacttatttttttaatttatttgatgactagggtgtcacgtggataccacattagcgaaaaccgcttttaaaacaaccaaggtagttgttttaaacggttttaatagttggggaagtcattatatctggtcttgtggtttaggatatgaattagattcgatctttatttaagggagtcaaattggacttttttttacgtaggcgcatatgttatacttgtatgttaatggaccggtataagtccacctgccgtccctcaactttacatgagtttgattgacctttttaatttcaaataccataaatctttacctttagactgtataaaactgtgcaatatgtcccattttcactgtttttacttacgtgccaggtgtctgggccggtgggcccacttatcagcatcatcatgtgagttccgtgcttcggtgcttgtgcccgttggtgtgccagagcccgagtcggtggcacagggggtcacgggttgaacggcaacctgccgccgccgtcggtgaacgtggctcatctgagccagatgttcgatcggcgccaagcagggggtcacccaggcggagatggtggcgctgtcgggctcgcacaccatcggccggtgtgtcgccctccagctccttcagcaaccggctctagtagtcgtccggccccaacgccgggcaggaccccagctacgtggcagcgctggcgacgcagtggcgcagtgcccgcagcaggaggaggccgggagctggtgcccatggactggacgccgtcacgcccaataccttcgacaccaactaccatgccgccatcgtcgccaactggggattgccaatagtcccgactcgttccagaccgacttcgcggccgacaacgtcaagatgggctccatcggcgtgctcaccggcaacgccgccggcggcaccatcaggaccaactgcagggtggccagctgatcgatcgatctcattccataagcaatgtatagtataagcatgtgtgggttgggatcgtattgatatcaaattgagcttccggtccaaactattgggatccaagttgaggagaacgtgtagactatgcatattattggaccggaaaggtacgcagttaacgtgcggtccatgatagttagggcggcatggaaattgttcacgtgaggtccatttttttgggccgaggccggtagtaggagggcctggcgctcgattcctctgcttctgcttctgcgtggagagggaggaccaattcctcgcgccgccgccgccgccgtgacggacacatcttcgacggcccccgcgctccaccaggggggtagtttccgccaggtctgcttcactgtctcctctgcggcgtcgtttgttccatcgggcgattcgcgtcgtccgcgggctctgctctctcccggcctccccggaatcgctctctgcccccgtcatgcggtcgcagctcgagagtgatggggggggggggggggggggtctccctgctgctagcctgctagtgaagtgcctgctgtgatactactgatcatgcctaccggtaggtaccagaattggcagatttctcaatacttttttccttcaccagtttaaattgtgtggttaatactagatgacgaagtagtaccctatataataattcattgattcattccacacgacagaaaagtaaacgagacagatagaagagctcaatactgaattttaattatttgttacaaactggcatagttatcagacattattacacacataaatattcactagtaagactgaagaggagaaaatgacatatcacaagctcaaacaagaaaaatgtactagtagcatgtgcgacataaaagaaataatcctttggcttaaccatgcagtgctgaaaattcttctttgattgcagcgacttccttgtaaacgctttgcattgtcggccgatctttaggtgccactgcagagcacaagaggccaagcttaaccagcttcgtgacacagttcagcattccatccatcaaacaattatcatggtctagatcattgtttgcatcattgtcttcgttctcataatctggcatgatgctcggatctagaatttgaccaatcttcagaggaaatgcctccttggcaaattggtgaaggttcaagccatcattaaacatctcatctgttggacgcttccctgtcaacatttctaagatgataaccccatagctgtaaacatcaccctctgttgatattttactcccgaagccatattctgcaacgcagtttataattaatatgacaaaaaaaatgaactcataaaacttgaaagaaaggagtttataagagcaaatcagaataaaacacagtcagaagaaacatgcaaattattttacagaaaagacatatactatcttttttgtgcattaagaaattctcacctggtgcaatgtatccaatagaccctcttggccccagtaagcttgtagacctatcacttgtcgaagaaatattgctgtgaaggaacttagctaatccaaagtcgctaacacgtgcacccatggcattatccagaaggacattgcttggcttcagatcacaatggacaataggtggcatgcaacggttatggagataatccaaagcagcagccatgtccaatgctatttctattcttgtagataacctcactggattcctcggacgattcttgtaggatgttggatgcagccaacattctaggttgccattaaccatgtattcaagaacaagagctttgaactcatgtcctgtcggatcaaatgttgagcatgcggtgatcacccttacgagattgcgatggcgggtgttcctcaaggcctcacactctgctatgaagctttttggtgctccaagttgatcaagtttgaaaactttgatagcaactgcatgtgcttcggcgtcaaatttaccaacatatactgatccatatttccccgaaccaattaagttggttggagaaaagttgttcgttactttgactaaatcagcatatgtgagtttctccaatttcttatatgatgggtctgttggatttttagctttttttctcttcagaaaaaacactgctaaacatgacaaaaataccaaacagaaaacgctgagccctactacctttgcaatataggaagtgtggttgtttttagaagcagatatctgacaaagtggcaatttcagtagtggtgagatggcacacaactccttgttcccttggagaaaaaccttgcttgcattttggaagatcccattggatggtatgggtccctctaggttgttgaatgacaaattaagaagcaccatagagctcagagtctcaaaaaactctggaatttgaccagataagttgttccgagaaagatccatctgaatgatgcctctcagtgcagaaaaagatttaggaatttgcccattaagaacattcccctccatgttgagatactcaagacggacacaatcacctagagctgagggaatttctcctgacaatttgttgtttgaaatattgagggggccaagattaatcaaactaccaacttccactggtataggtccagagagtctgttgtgtgagaggtccagaccttcagaaagtgtggaaatagtaaataattcctttggtattgttccttccaaggagttacaagaaagatttagtatatctagtttttggcattgtcctaaggccttggggatgagtccactgaaagagttatcttgcaggtaaagctcagttaactgatttagtttaccaattgaaagtgggattttcccataaaaactgttttgtgctaagcttagaatgagtaagtttgaaagatttccaagtgagtcaggaaggttgcctgtcagcaaattatggtcaatttgaagcagtacgaggtttctgagttgttctatctcctgtggtatggtgccagagatgaaattggatgtcaaaactaatattttcatgctttgtggaagatcaccagtggaacttggcaggcttccttgaaggttatttgcatctaaatataattcggccagctgtgtatgtgctaatgctgggaggaaagtccaatctccagcttcaagctggttcttacctagatcgagaatggtcaagttgggtaaggacccaaaataaggaataatacctttgaatgcattttctctgagattaatcaattgaagatttgttgctttggccaatgatttgggaatttgaccatggaatttgtttccttgcagaatgaacatttcgatgcttttaagagtatacccaatattttgtggtaattctcctatcagattattttctgccatgccaaggaatgtgagtgttgacatattgtagagagggagtggaactgttcctgtcaagttgttcccagtgaattccagttcttctaagtacggaattctacttaaactcgatggaatacttccttgcaattcattccatgcaagcagaagtgagtaaagtgaagtggagttgcctagagaagatggtatgctacctgagagattattgtaggacagataaagaaattgaattgatgagaggtctgacaaaggtggaatggacccaaaaaagttgttttctgccaaatttatggcctgtagtgaggagctattgaatagagcgggtggtatctctccaccgatgtgattcttccttaagtcaagccactgaagtgatgaacaatttgctagcacagggggtatacctccagtaagactattgtttgcgagaacgacataggtgagtgacgagacgcttccaagtgaatgaggaatgttacctgacaagttgttgctatgggcaaacaaaaccgaaagtttgtcgagcgcggtgaacccatcaggaatgccaccgtgaagcatgttttcatggaggacgattcttttgagatttgaacagttgctcagaccaaggggtatctccccttggaggaagttgttcccaagattaagtatttcaaggctagagcaagaagatagagagtttggtatcacaccagtaagattgtttgaagaaaggtttatgtaaactagacggcgtaggtggcctacttcaattgggatctcaccattcaacctattattcgataggtgaattcgtgtgaggaaagtgagattgccaatacaggggggtaaatggccattgaggtctaaggactctaggtgcagtgctgtgacacgagattcatgtctctttccgcaggtgataccgggccaagtgcaaaattggagagactcgttccatgaggctagggatcttgcattgttagagagaagagacctgagccaaag

SEQ ID NO: 41292 - DNA, 11651 bp, Oryza sativa
  unsure (1)..(11651): unsure at all n locations
gatgcatatctacagtcaaagattcaaaagaaaaagaaggagtgggttcgtagtccatctttgctgtcgtgcagactattcaaacaatggacagtcctctatatacggcaaagcattgtaccgagtacaaattttgtgcctgaactcagtttatccattttcctgagagtgctccccagttctacttgatagccattaatgcctttcatgttaaaacattctataacgttttatttggtttgaggaaagaggaacgactctcttttaaaaccgtttgaccctcatcctgtgcactcatacactccagcaatcaggtccttcgcatctcaatccgatggctaggatctggtagggtgggtaattttataaaaacccacccgcctcctatcttctacctttgcataaatcccctaaccagttcatcctcccattactctgtcagagcacaacgctgcgacaaatccaaagattccttctaaaccaccattccatatttccatatagcagagaggaattaaagatttctttttatttttttagagaaggataactttttctctgtctctacaatccaaccggatacccgtggattcgggtatccacggatacccggcccgatgggcacggcatggcgcgtgggcaccttttcttttttccgtgggcacgcccgagctgttaccgagtctctttaagttatttgctcctatgaagatttgaactcatatccatggagtgctactctggttactgcaaccactgaactacatgcccttttgcagagaggaattaaagatttaggttttggatagaacgaataggagaaagaagaattttaggaatctaagagtggatatctagcacttgattccttatatctatggcctaagtcatcgcttcgtatcagccttcttgtgggtgggtgctgccatcgccctcatcgagcagcttcacgtccccgtcattcgtgggagagacaaagtgatttgggggtagctacagccaaagaacaggaaacccatgccagggggatttttttttaacaaatatggcagattttattcatttaggatagttacatcgtttgctaacaaatcaagaataaagctagggggctcatcgtcccgagtacagttttgttttacctgcatcgctctctttgctaacttatacgccacttgattcgcttacaaaggtacaaggtgggaagtgggtggtttattttttctttttgtaaaattaccctaccaagatcctagctatccgattgagattggaaggaccttattttactactggatgagtacacgtgatgtgctgagtgcacctgatacattgccataatggaatagaagcatcagacatctggatctacttatctatcctacaaatagttggccttctatattagtgtacgccagaacttgtattgaagttcttaaaataaattgagtaaattttacaaacctacatatacttccatagatttaaggtgttctacaataaatttagtgatgccgtatctgtaattttgttatacgcatccttaaatttatagtcttgcaataagttggtcaaagtacatgtcgttttgtgaaatttatttaaataaataacatgtgataaagtttaaaaagacaataacgttatattatttgtttctgttttttttttcatttgtgtgcttatttcagttttggagacacgtgtaggcatttgattttaactaagtattttttaattgattgcataaagaacaaaaggtgtattagagaaaagtgtctaaaattgtcttccttgtttaatgcattgtctagagttcgaagaatctctctaggatgaaaacttaaaagtgtctaaaagtgacttatggtctagtctttgctgattggatcatggcaagttgataacaacggggtgtacatatgcattgttcaccttttggaggcgttattttacgagtctttatcatagttgaggcgtcgctcgctttggtggagcatgagaatgaagtttgtttgtggctgtagcttgttgtggcatgatatttgttttttcttaaataatgctaggctgtgtggttcttcttcttcttcttcttcttcttctttttttgtgagtggaggttgtgtgcatcttaggtaatggcaggagtcgtattagagtggttgtatccttaaaacagaacttaattatgtcacaccatatctattttttttcggggaaagggagatatattacgaagctatagagtcagcaccgacaaggtgtgagatgaaattacaagaatcatcaggccaaaaggccgttaaggactcacacctccctctattagctaagatatggctaatgcgattctgatcacgatagattttcgacaccaccacctccctatttccagccatgaggcatttaacctccttgactagaaatgtaagctcagacctgatctctattaacagttcatggtctctagtgatattctaaatatagctgctgggtcatattgaatcgccgtacggatatacgactatagttatagataggttatcttgttaattagattctcatgaacaacgtgcttccaagaacaatgttttgtttatgcaaactactgcaaatctaaataagtgaaaggtggaaactttcttgcaagattacatgtccatgtcatctttaaaatacggaccatttgatttttcctccagacattgctagccattagatccttagattggcgaaatatcttcgttccccttcaagaaacttcttttgtaaagaggtcctcccacgtccctaaccaaaaaaataaattgtttctcctcgttgtctccactcccaaatcgtgaaaacgtgcactcttcgctgccgtcagctcctcctccatgccaccaccacctcctcctcctcctcctcctacctaccccatctgccgttgctcctccactccatcctcatgcgcggtcgccaggcaacacctccaatccctccacctcccaggtgaccacgcagcggagcttggctgtgtgtcccctcaacatccacaaactcagaggcgatggattttgattggccggcgacgaagaaggggattcgacaacgagccgcttcttcgtccctacgagttcacatgcctccgcatactaatgatcccacaccgcttctgccatcggcgtcgtcctccccaattttcctccggggcaactggtgtgtaatactgaaacacaactgaatgcaaattcttgaagatctggaaatttgatatggaggaaagagttgaagccccggaagtaaaagatggatctttaatcccggttattttaaccgattcgtagggggttcccaattgggagtacaaagcctttctccagcagtgtttctgagccactacagaaattctatttgtattaactttagtgaaaattttgaaactgacattaagtaaataaataggcctatattgttgaattttcaaagcctgtttgcgcttgggcagtaaaataaaaataccaaagttaagagagtaattaaagaggtaaattaccactataaaaattattaaataaatcaactaaattgggcctaataacattccagaaaacctaataaaactcataagtgaatacatcccgacccagagctttattatattccgtttaaaaaatagcatcttgaatttccttctactaaattttctaattgagaaacctagagaatattacttatttggctttgatctaacgtgtggcatctggctggggtgcttttacgaaacaccaaccccataatttgtcgagccaaacgagcttcttgccagtctgcttatactcggctcgtttcactcacgagctgtattgtaggcttgggctcgctcgttccatacatgccgagctaagcctatgcaaagactgagtgaaacgagcgagcccacattacttggttaatatgttcaggaatgttttctactctattttgaatttcgtctcagttgtctagttagggcgggttaattagtcaggtactagatcctggtccaaatgttcatccctctctcaaccatgaacaaacaatttcgagttcgaacaaggcagcagccacgtacaagcattgctgaagaaaccatctttagtcccggttggtaacccttttagtcttgggttttcaaccgggagatgaaattcgggaccccggttaaaataatcgggactaaagatggacctttagtcccggttgataacatgaaccgggactaaaaatgtggtcccggttgttattaccaaccggaactaaagatttgtttttctattcctttcatccggttggtctttttccttttttattgttcttttgctctatgcatatcacccaaatcgtcatggatcggatcgaaggaataaaatcaacaacaaagcccaaatcatagatcgaatgaataaaatcaacaacaaagcatccatattctttacacttattcacatatacaacatcttcagaacaacaagcattcatcacagagaatagagaaaagaaaaaaaagttcacatctacaacatcttcagcattcatcaaagagcacagataagagaagaaaaaaaaatgttcgtccgccagccgccgcctcccgaccggcgtcggccgcccccgacgtagccggccgccgccttcccgaccagcgccagccacccctgacgcagctggctgccgccctctcgcgtccgccgcctgcgctgcccgccgttgctcgcctgtgtcggaggggaggaggaggagagaggggaggagcagagaaatgtggagaagatgagaggtgaggatgagatggagaagataagatgtggagaaaaaactgagaggggaggaggagatgtggagatcgaggactttatcgcgcgggaggacgaggcggtagggcatgtgacgcgagggattttttttcccggttgttgtaatcaaccgggactaaaaatagatctttagtcccaccaacgggactaaaaataacattggtctgacaacgtctgccatttattgaaccgggactaataatgatctttagtcccggttggtgccaaaaacttttaaaccgggatttttagtcttagtttgttagactattgtaaaatttttaatcgggactattgtaaaatttgatcgaccgataaagatggtttctccataagcgaagtttggcttcatggcgcgtgcaaaccacctttagctatgccgtgtatccaaaaggtactaatttgtatagtttcatacgcagaaattgagttttttttttctaaaacagagtagtcgtagccaccggttttctcctttagttacctcgctcattgtctgagattaagcggaccaattaaaggtactggaagttgtactggaattgacaatgtgttgtgaattgacaagacagcctgagattaagcagaccatgccatgtgcaaaatatcaatgtcgggcaaatgataggccattaggaaggtctaaatgcaaaatagtactccctccattccaaaaaacaagggattttaacattttatttgtactatttgaccattcgtattatttaaaaaattttagaattattatttattttatttgtgacttactttattatccaaaatactttaagcataacttttcgttttttatatttgcataaattttttgaataacacgaatagttaaacagtgcaaacaaaatgttaaaatcccttatagtagagggcgaaggcagtattacctccatcataaaatataatatttttttgaatgaaatatatctaactactataaatttgaatgattctttgtctagatttatatagtataatatgttccacctatctaaaaattgttctactttaggataaaaaaagtatggatgttagaatttatggctatggtgagaaaggaaaatttccgaggtgtgtgtgtgcgcgtgttggggcttgggagagggaaatatatatattatatgcacacaaattttccgtgcatactccatatacatcaactagcaaatgttattaaaaattctagaaaaaaatggacacatagttccaataatattacacttacctgtgaaatcttatcttcaaaatcattatattttagcccgtaacaaaaaagacaaaattctgatacatttttatccttaaaactgtcagatttttcattttttgttatggctaaaatataatgattttgaatatgacactttgtaaatatgtgtaatactgttatgagtaaatgttcaatttttgtggaatttttgtgatattttgtagttagtgtgtacgccgtacggtagaccagaagcttgtttgtataggagagagataacatacatgacaattcggacataattattacaacgatggtcgtagattcccggaaagaaaagaacaaacaagtatgacttaatgtttgtcttttccaatcatacatgttttaccgcgtccggaattgtgccagattacaaaagatttatatttaatgaaatgcttggatgagcgacgcgccatggatatgctttggtatatcttgagttcttgggtcagtcgtccctcgctcttcgacgtgcttaggagggcaagttttcatttagagctcgtgtacaattcttctttttttttttttgaagaaaagggttgtggacaattctaggtatagcgataatatagtagtgtaattgcgcagataatattgtagagaaagtgcttttttttccagaatataataatttttaggattgaacatgaatgttaatttaataagtaggtagaatttaatgggagaaaactgttattggttgggaagtaaaggcaagtagaaaatttaatggtggatgattataattgattagcaagaatatattgatggattaaattttaggacaaatttgaagtctagaagttattatattttggaacggagagattacatcctatatgactaagtaggtgaaatagcaaaagaaatcttgccatggatttaagcattaacaaagttcttaacgtaagactccaagaacaaactaataatacttaaagtttgattttgaagaataatttaggtagatttcttttacttttctggttagaatttattaaaaaagatcaggcaacaaaggtgaaaagaaagcacttaagtcaaatttatagtgtgttaaaatctgctctagattaatttttttttaagaattacacagtacaacgcagacactcacccctataaacgcacacacgcaaaccctaccccaaaccctaaccctatgagcatatttaaagacttgggtggcaaatccttgagaaagtcaccacagacgcctcgctgtcgaggggtacgtcgcctaccactgaaagcacgaagccgttaaatcctgaaaaatttgctcccgtgaggagtcgaacccaagacctaaggttctactcaccactaggctagaggccctttcgcaaatctgctctagattatgactcaatgagaaacatagttggttcgtagttctactaatgaaattttgtcttactttttttaaaaaaaatacataaaacttcaaacaaatttaaatgcaaaacaaatagctagttaagtaacttattcgaatgaatatgttaccgtgctcagcctgtccagtcttgatgaacccatcccagccctcccaggccccagccgttgataccttatctatcacgggaggtttgtgaccgcacgagctgtttctctccgtatctatttttctttattttcttttaacctttttgattgttattttcgaagataaactctctcctaaaccgatttccaagtcattcttttagccttaacactactacacaaaagctaatatgtgctggttgggagccggcactaggtgctggttttcccaacggacaccaccgagaccgcactaatcactgaaagtcataaaccggcacatttaaggctgcaggaacgaaaaaaaagccggcttgatgcatcgagcaatttcacttcaagaacatcaagaacatgagatgaacacacaagatgaacacaataacacacatgaacactcctgagtccccctcccgccgggccatcgccttccctcccgccatcgcccaccgctgccatccccgcctcccctcctgccaggtcatcgctcccagccagatctggcagaggggaggcgccgccgctacctctgctgtcgggccgccgtcttccctccaaccatcgcccgccaccgccatccccgcctcccctcttgccaggtcatcgctcccagccagatctggcagaggggaggcgccgccgctacctatgctgtcgggccgccgccttccctccaaccatcgcccgccaccgccgccgcccctgcctcccctcctgttgggctgccgctcccggtcagatctcgtgaaggggaggcaccgcgccgcagccgccaccgcctcccctctcgtcaccgcccgcagccgccacccccacctcccctcctaccgggctgccgctgtcttccctccgacgacgcgagactgtgagagaggcgaggtgagagctgagggaaaagagataaggagagagagagagcgtggtggggatggatggataagaatgggtgggtggtgacttggtggataagaatgagaagcggtgactcggctcacagctcggtttttaaaggtgtcgattttaaaaaaaaaacgatatctttaatttattatactatcagttctttaaaaaaccgacacctataattaatttaaggtgtcggtttttatttaaaaactgacacctgtagtattagtatcgtttttttttttacagaaccgacacctataataaggtgtcggtttttcctgttttgggccatggaggtggggaaatgtattataggtgccggttttagctgttccggcacctatagtggtgatacctgttttgtctttttttagtggtgtaagcttgcatggttacaaataagatattaattatgacatgtataaatatagagtctgatatataagccccttgttccttgtataatgatcagagtcaatataggctagctttgttccttgtgtcgtggttgctaaccaacctttatcacgtactgccagctccttgctcatacttcctccaggtcaggctaaggaccacatcaaataaatactaaaaattacttaaactatctcatttaaaaatattacccggaatttatacatgggtcagtgactaatctagcttaatttgggaataaaaacaaaacaaaggtctatttaatttagattactgagcgaatcattggcatgattatcaattcaactatctaaatctgatttgtatttttctattcgtcacctcactttcggattattttcgttcgttttccgatcgagatttcgtccggattaatttttatccgtctacgtatcgagggttcgtctgatcgctttcatcattcaatcatatccgcttccccgcgctgatacaggcctgcacatgcgtgttactggcccgtgtccgtgtgataaggaaaacggaccgggcccatgtaagattttttctaactgtaaaaaatatcacgtgtcttccctactgttgtacgaagaaaagtgacattaccgtattaattagcataagtgaactaatccaatcgcaatatcgattgtggatcccctcaaatgatccaagtgtggttctaagtacagtatagcaaattacaaattcatccctagatagaatttagtaaaaaaaaacctgaaaatacacatgatattgctaaatgaatacagtgtttatgatattgctaaacagacgcatgatattttacctgtttgattaaaaatctatatctatatctatacctatataataaaaaaaaatatgtaaggtttccggcatattttttcgtccgtctctttttttttcctttttttttttgctattttcacctttttttctttcttttttctgttgtccactttttttttcaccgccttttttctgtccgccttttttttctccgttttccgttattttttttcttttttttgaccacctatacatttgtcgacaaattttcttataaaaatttgacacatgtaattatagntacaatcgtaagtgtaattacacttgtaactttgtatataattcaccctgtaacttgcatgtaactacagtgtaacttgtatataagtttcaagtaattttgaatcgttagatctattacaaaatttgttctggtgaggaagaaaaaattcacatcatacacatatgtgaaagaatttgttctcacaacctccattttaccgaaataaatgttatggagatatttttgaaagttacatacatgttatattataagttacagtgtaattacactacgattgtactataattacatctgtcaaatttttggtggaaaatttgtcgacaaatatatagcaaattcgtctttttttgtccgtctcttttttcgccccccccccccttttcttttcttttttccctttttttctttttgtccgttccttttttttttttttttgccaggccgaaccctagcgccgctgccataacgatcacctcccatgcgttctcttctacaattgattgtaaaagttgattacccactactctctcattattttcccatgatttttcctttcaattctgctctaatttaccggatctaatacacatttaaaaatcaccgtatctgagttttatgtattcgctcatattttggtaaaaacggaaagagtagatcgagtgtatcaaaagccctcaaccaactttgggagtatgggctaggtcaaagagaggcaagcaaaacagaggaagataacgggttgggctaagactgaaaaggaaggaataaatgaggttttggccgcaaaacagaggaagataacgggttgggctaagactgaaaaggaaggaataaatgaggttttggcccaaaaccaaagagtatctctactattataaaaattgaaaatgtttttgtcggtactttcgtagatcatctgtatttgagtcggtttctaagttcgttcgcttttggaaatatagatccatgtttgagtcttattttaagtctgatcacttttagaaatacagaaagagtcatataataaatctctttaaaaaaaactcgcacgctaactagggatgcttttggaaatacagaaggagtcgtataagaaatactttaaaaaaactcgcatgctaatttaagatgagagttagactcctaatagtagcttataattttctaaaagaaatatccaagcaaatttctacagtaattttcaccctaactgaaccgtataacaacaacaataataataataataagtctaaaatagccttcacccattgcaacgcacgggtattttttctagttattgaaaagatacatagtgcttccatcgtccgtcgctaatcgatcaaaagtgatatgttgtccaaatatattcaactaataaaagtcgtaatggtttatttcattcatcatcccgatccaacgaccttgattattcggtggtcatgctcatagtttgtatttccgaattgtgacaaaaattacccatatgccacgaacaaaaccccaacacaccctaaagctcgatctaatcgttccctcacatcgc

SEQ ID NO: 41293 - DNA, 1744 bp, Oryza sativa
ccccatgtttagtcaagctagcacctgagctggccaggatttgggcggccacccaacctccatcattagaaccaccactgttgaatgactttggtgtaagtggcccatcaccggaaaaacctactctctccgtttcacaatgtaagactttctaacattgctcacatatatatagatattaatgaatataaacacatgcatatgtctagattcattaacatttaaatgaatgtgagcaatgctagaaagtcttacattttgaaacggagggagtattagatggtgactttggaaccgtcacttcctaccatcgcggttctcttcttccatgtctgctcctctcctctcctctcactctttctggttagggtttagcatgttgttttttttccctctactgtctttcaacgacctcaactgtccttccacttcatcttctcacccaactatttataaaccgtactttctctttcttttcttaacttctttaacatgatgagatctctgtgaatggagctaaggtgccaaaacagtcccaacaataaataggggtaaatatgtacaataaatattatcctactagacccttttcccgttgcaacgcacgggcaattcttctagtatataattagatataataaaaataaatttaacaaataacatacaatctaaacaatgatgtagaaacggaatagaataatcttttaaaaaatatatattttaaaaaaaacatggaggaaataatccgttccaatacttcggcgaataagaaaaaaaaaaaagaacagggcaggtcccgctaagaacgtttgataggtactccacgaccgtaggagtgcagagcgcagaagaattcaaacatgtccacatttgacatcttgtctggtgttattggaagatgaaaccatttttaagtggcgagtgttgcttcccggcacggacggtaaaacagacaggttgtatcgtttgttcgtgagctcacaaagcagctagctggcctgctgaacaaagcatgtcgcccactctgagcagcttccgtcttcttctgattcgacttgttttgctggctctcctgataggcagcggcgtccccatgccctcggctcagcaaggcagcgcacgagtccgtgagtatcatctgtatatatttgcaacagatttagctttggcaatcactagagtctagagctacggcgcgcagtactgtttttgttcccccgcccttggattgctgctaatattttctttttgacgcatcgttgcagataatccgcatggtccaccgcagacccatggtactggttttagctacgacattattcgtgctaatggtgcaataggctaacccacgaaactcacctataagccaaataagtagcgaacctatttattttgatctatatggattagcggcttactcacttatacccttgattcgtgctggataaatatgtagatcgtgttgttaccgctctatattatactcctactccctccgttgaaattgtaatgcctggtttttattgattatttcggaaaatcgctccttggctatataatagcaatgcctccaactctgttttaccacaaagttaagtgtaattacaaatttagtatataattgagcagtatgtacatttagtttgccacttatctcatcgtatcccttctattttcgtttccactttcttttccttctgaacttacatatctattactccctccgtcccataatataagggat

SEQ ID NO: 41294 - DNA, 4860 bp, Oryza sativa
tatattaaaaatcaattaaactttctcaaattaaatgctctcagaccatcacgtggtgctctaataagttagagaaaaataatagaaattatgagaccaaaaagtaaaacatccatccattaatttttattaaaattggtaggtccacgaaaaaaagggcgcggcaaaaaaaagtgataaaaaaagctccctgataaaaaagaaggatgaaaaaaaccggtttcgattctaaacatcgcctgcaaaaagaaaatcgaaaaaaaaaaagaaaacgccgtccctgatatagagccataaggcctgaggcccgaaggcccggcccacggcacggctttttggcccggcccaagcacggcacggaccgacttgggtcgggcccgtgccggcccggcctgaccgccgggctgtgcctgggcctctccaccggcacgctgggttggcccggcacgatgggccggtaggccaggcccggcacacaaagtatagagactaaaaatagacatataaatgttactgtccaaataatagggaccttaaatagacttatttcagctattcatataccacagcccaaagataagggacgtaaaatagactttttagctatatatatgtcacagcccaataggagggagggaaattagacttattctgaggaaatgcacaatggcccatcgtgccttcggaccggcccggcacggcccgagacgtgttgggccgtgcctgggccgtgagtacgacacggcccggtgcgtcggtcgggccgtgccggcccaacatgcctcggcccaggcacggccgggcctaggccgtaccgtgccgggcagtccacatggccatctatagtccctgagaaaacggccaaaaaaaaacaaaaaagacgccggaaaaaaaaaagaggcaaaactccgttcaaagaaaatggctaaaaaaacgcgtctattaaaaagcccacaaatagggcgaaaaaccaaaaaaaaaaagccaaaacaccgtgagaaagaaaagacagctaaaaacgcaaaaagggaaaaaacgccatcccatgaaagcccccaaaagggaaaaaaactgtccgactactatatgttttatagattactagcaaaagtgcccgtgcgttgcaacgggaattgtaaagactaaaaaattgaggaaaagttgagaaatatttacattatgtaattcattgaaatacaaatttcgatattttttaagtaggtaggtgtataattaaattagtttacaagtaaagtaagtgcgagaaataaaatggtatagttaaaattaattttattaaattctccgtgattaattatgctagttggaattttattggaatttgcgtagcttaattgctaattttcataatactaacatccttgcaatatttatttgaatagaaatcttccactctctcgttggggcattttcagcccatttttatacagcccgcagccaagctggcccgctttcctcccttctcctctcctccgcctcaaccgcacacttgtccggcccaaaaataagtctaatgaactccccctacttcatctctcactgccgcgtgggccctaaccgaaagtctaagttaaatttttttgttcgaccggtcgacctgctgcggcccatgaagcgcacgcgacccaatagtgattcggcctaacgcgggatcgatctgagccattcgtttagagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagccggccgttcgctctcgggcgacggccgtcaacgaaatttgcaggtggcccccttgccgccctccgctagggcgattttatactgtgcggggggccgcctgcaaatgggcggcgagggggggcatggaattttgcaggcggaccccttgccgccctccgctagggcgattttctactgtggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataacttgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgacctgcctgtactggtgtgacctctggctgctcctgagtgtgcgcctctggagctcctccaagctgagaggagcctagtacgtcctggtggtctgcaccgtgcaagtcgtcgtcatagaactggctagtaggaccagtcctaccggcgtgagacgaagaggccccagtaccgaagatcccggctgcatatcctgctggacaaggaccatcagttttgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacacattcgtgcaaaagctgaaacaaaaatgaactaatatctgggctgaattgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacctggactgcggtgatatcggcactgatatcccgtgcggcatcagcctatgcaagatggaaataaaaaattcagtagttgtcctatattatgcaagataaatgaaataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtagagcccaaagtgcgcctgctagctgtccccgtcgagtcaacctgtgaagagaggtaaattatatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtgaccttacttgacattgtgcctgatgaaaacattaactgcgttaacctcgcatttctgtactacgccctaagttacattctctacaatattgtcctctaaatttctaaaagtacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaagtgagcgaaccagcagggcttcgccgctccccttttgctgccctcccctctctctcttttgttttttttggatttttagtgaatataatgaaatttcacagaggagggactgggttttatagggggggcaaaaatcgccctcccccagggcggcaagggggccgcctgcaaaattccatgccccctcgccgcccatttgcaggcggccccccgcacagtgcaaaatcgccctagcagagggcggcaagggggccgcctgcaaaattccatgc

SEQ ID NO: 41295 - DNA, 6915 bp, Oryza sativa
tctccccaccggcaaccgcgcaccttccccacttccgccgtcttccccgcgcccctcccccaccgccgcctctccgcgcccctcccccaccgccgccttcccgcgcccctcttcacctccgctgccttcccgcgctcctcccccaccgctacctctctgcgcccatccccgccgccgccgccttcccgcgcccatcccccaccggcgtcgtctccgcgccccttcccaaccagcgccgcctccgcgcccctccctcaccggcgttgcctctccacgcccctccccaccggcggcgccgctcctcctctccatctcctctcattatctattgattccgatttgtatttgtatttgaatttggattgagattttgtttttgtttggagccgcagcccggatggcgtggggacggccggccggacctcgccgctgccggatctagcggcggcgggggcaggagggggcggcggcccggatgcggcggaggcgggagaggcagctgcccggacggcgtgggggcggcggcggcccggcgtccctgcgtcgacggcggcgacggcggcaccctccccttccggcgtcggcgtttttgtgcttgtgatgttcctgtgttgtcgttgttgttgatgaaatatgatcttgtgatgttcttcttgtagtagtgttttctcttggaatttgtgatgattccgatctgtatttgaattgagattgagattttgtttttaggttggattggatgcgggatttggagaggaggagcgcgtgaggttagagaggagagggacgaaaaaccggtgtgacgaccggaaaaatactaatatttatattagttgtagatatattattatctttatacctattataaaaattaaagatgattttatactcaccttaattttcgtccatcaatcgagttaaacacatataaaacctggatcggactggaaaaaatcatctactggcgatccgtattctcaatcggatgaaaaatgtcttctctagtattataaaaattaaatatgtttttgccgatacttttgtacgtcatcgagttggtttgtaatttcattagcttttagaaatacataaggagtcatgtgagaaatctcttaaaaaaacacttacatattaaagtgagatgatcaaactcctaatcaactcctaatcgcagctcatgatgattttctcatgtgattgaaatcctaagactttacccgttgcaatgcatttttctagttgtatactaaaagtcaattaaactttttcaaattaaacgctctcagaccgtcacgtggtgctctgataaattaagggaataatagaaattatgagaagaaaagtaaaacatccgtccaatgatttttatttaaattgataggtctaatattataaaccgttaatttagattaatcttcaaacggaccgcacaaaacaactacggtctcacctctcctccttccgcgtaggtacgtacatgagcgtacgtacaagaccgaacaagacatccgtttcttctgcttccctcctctcaggaatactcaaatacaaataagtatatagtagtgtgtcttatttctggctaactactttgtaaaggtgaggaaagttaatgcaaaatataaatacactgtgatcatgtgataggtaattatgtatacattcatgtagattatatcgtcatatagctcattccaaatatacgtaactaaattagctatgtaatacttaatatttaaaaataaagtttacaccattatatatttaaccattaactaaattaattatctagttgtgaattaacttacccacaagaggagtacacaggaataagcctctccccattccatttcttaactcgactctcttgagttctacctagtttctaccatactgtatgttatcattttgaatcaagtaaagttgcgttttgttttaatttgggttagctttgttccttgtcgtcgcagtgaccggccaaccttatatcgagcaccttgctcgtgctttctccaggccaggccgtgagagatgggaaccacatcaaaaaatactaaaattacttaagctatctcatttaaaaatgtacccaaaatttatatacgggtcagtgactagggtagattagtctgggaataaaaacaaaacaaaccaaggcccagtctgatttaaattgttgagtggattatagttatagattttctagtgataaattaaatatctattatatactaaaagtcaattaaactttctacgaacgttctcaaaccgccaggtggcatcctaccaacgttcctaactcgctacatcgcattctaataaataacaaaaattcctaagaaattctaaaaaaaaaccaaaacatctgtccatccgttttcattaaaatagttggtcccattatttcaagccaacagatttatctaaaaaatctttccacctccacctccctcctcccacacgtaacatctcttccctttgtacgtagtcacgtaccatgtacaaagaaggttatatatgtacgtgcagcccatatatgtgtcctccttttctctctacaccctattttatagctagaaatttaactaagcatggcgagttaaatggtaatttaatttagaattaaactgataacttaagatcaataaaatccaaaatatttcaagggttaattggatccataccattgcaaatttgcctattccgaaaaatgtcattacaattcgtctattcttaatcgtgccattgaaattttccaaaattaaaaccgtgccactgccatcacgttttccatccatcccctgcattttccgtcttcttccttcattccctcctcaccgccgcacatggtgccgtcgccttcgatcctcaccgacgcaggaggcagcccagagcttggtagcggtgtcaaggtggcggaggacggtggcggcgatggcgccgtccatggagaagaggacaaagccatcaccgccggggaggccgagggtgcgggaggcaggccaaagggaggagcgcggtggcggaggaggatggtcgccgctgtggaggaggtcgcccctgaggccagcggttggatccatgcggcggtggaggagggggaggaggaggagacaggggatttggggatcgggaagaggagggagaggagagtgcgaagctgcattgcgacgccgccagcatggttgggtcgctagtaagctctctctcctcctccgagcttgcctcactacgggagatggcccgcttgacgcctccgtcgtcgccgtacctcttgctgctgccaccgttccaccgatggctacgtggttctcgtcctccacggcgaggtgcgctggaggcatgacgacagagagatggagagagaagatataagatgcagagagaagatggaagagagaaggaagaagatggaaaaagaaggatggaaacgtgacggcaacggcccggttctaattttataaaattttagtggcatggctacaaatagacgaattgtaatgacatttttctgaataggcaaatttgtaatggcatggatccaattaacccttgttaataaatagtcttaacaatcggcacaaataaaataaacttgataacatatattgttccatcatatattacccccacgaacatgcatagatgaattagatcaataataaaaaaacaaaaatatcaaaactcatatcctatccaatcctatatcctataatactatataattgatccccacttagtgtagttattaggaattttcctgagctgtggttaagccacgtcacttcttttattttcagtcattcgatcaaacctcgtgaatggtccaatcgtactccatcacacacacatgcacgtccttttgcctccctccgccaccgatcgaatatgccgccgccgccgggtgcgcttgcttcctctcccacatcgcgcgctgcttccacctaccacccccgcgcgcgccaagacgtgggccctctcctccatcgcccgtggcagtgcgggccctccctccggccgccgcgctcgctcctcctcccatccccagcgcgagccagccgcgagcctgccatcctcgcctcgccgcgctcggttccccatccctcgcgcactctaccgccaaccgcgccgcttctccaaaaccccaccccaccccaacccgcccccccccctcacccacacacacacggcggcaccccaggttgccccacccccagcgcacagtcctgccgcttcgcctccaccccccggtgattctttctccacgcccaccaacgagcagcgcgcgcgccacagaagcgagccgtcaccatcatcagcacatcaatggaatggggatcgccgctgccatagcagggcaagggacggagaaagccagcccagcaggttcccattttctgtctatacatcttcctctgataaccgtcacaattaagttattatttgttaacccaaagttaatatgatgaattcatttatcatgtttattttccttcttatgtactgaggaaacttcataatcagtcccctaattttattttatggacaaatcagtcaataattcatgaatcccattttttcatatgggaattagcattaggccagtcaataggcggaactttttccccctaatttgtatgtatcttaggttactcatgtttgttgcttttagatgtgccgattatctggatacatctataaattacggattggtgactgggcaataagctagcttcgtttcatcataggcctattaactgtatcgaagtattttccagctttgttcttcccattgctccatttatatatttagaacctaacttttggtttatataagttgtatcctgagcttttggttgatataatcatcatgcttgaataagctcctatctctgtaaggacctgaacccatcgcttcgaaagtgggtacatctatgctgcatgctgttgttatgttatctggaatttttgcatggatctttctttcaaacacatatcggtatataatatcccgcggcaacacacggggtatcatctagttactataaagttataacccactaacttttaaagcttagcatgcaaagatgccacatcattatccactaacaagttgacacatcatcatccactagcaatcaatacatttaatattatgcaaacttgttatattatctataatttaaaatttcttacattttagagcttttaaaatgaaagcatgttaaattattatcccacataattcacataatatttcaatatatatcttcattatgttttataatatcttatgtacatacataagttcatcctcacttagttaatgttatctctctcttctctatttgagccatatcacgtcaattgattttagtgcttatgtaagtttatattgttcagctatcttacatattatttttatttattgttatcatactgaactcccacagcaatgtgtggggtttcacctagttacctcatatgttcgtgaataattacttctcgagatcaactctacttattttcagggagaaaattatatttgtactgctaaaatttaatggaccaattaacgccatagacaagtgtcaactctattccataaatggattcaaaactttaaaaaaattatcacttccatcttatctaattatcattccacgaagggcgccaagcatggataacatagtatgctctgctactgtacgaatttgggggggggggagggggcatgcatatgactaagtaaaggtgaccgtagtgagaggctactatttgcaaataaagttcaactaaccttctttctgatgctattctttagctgataatgaattaggcgttaaaattgtgctgcacgctgattttgaggagcacaactatgtagattaaggacacatatttcaaggcataagagaagaaagcctaggtggctacactcggcttcaactattagaggggcatttatatataattttaatggttttatcccatgaattggtaggagcaatacttcaaaatatttatacatatatttaaaaacaagtgagacatgaacaatttagtattaagtagagatgatcttttcttgtattactgacatattaagtttgttttcttgtatggatgtaattccatcataactgataatacaacgataataaataatggtgacaagcaagtttacatatatccggaacaacgttatttctgtttgaatatgaaagatactattgtcatttggtatataaaaatttatggtctagatatttatttttttattaattataagctgatatactgtccttataattaattaatatggtgagataggatttctttagcatcatttttgtaaataataaataagtggttctaattataaggtgaagcatgattttttaacaatcttttataaataagttgcccgcgcatctgcgcgggctttctttctaattcgtaaaaaaaataacaaagaacttatttttagtggtgtaagtaattgattcaataatccggtaaataaggtaaaaaaatagggcatgccccgctaagtatactactggataaatgaaatttgctgggtcacgcaaaaatcacattagtcctggtttgagtaagaaccgtgactaaaaatatctttagtcccggtttgaaaacccacgggtactttttttatcgttaccaaccggaactaaatatcatttgtagttccagttaaaaacatgttagaccctattttaccaaccgggactaacgatgcatctttaatcctggttatttataccaaccgggatcaaaataaaaaaaatcgtgaaaatccctaccccgagtcacgggcgctgccttgtccttatcccctcctcttctcctcctcctaccctcccattttctctcctgcacctactccccccc

SEQ ID NO: 41296 - DNA, 1393 bp, Oryza sativa
cgacggcaaatgcggcgccgggaatggtggcggtggccaccaaccctagaatggcgcccggcatggcgatggtggtgactccatcgaatcgacggaggaggtggcgaaggcgatgaatgcggtctcggcgatggaggccgagaacggcatcgaggatgaaatcaaggtagacgtacttacgcgatttccttagtttcttctgtttctttcgcttttcttgaaatcaaaagcgatgtttccttctttcacttcgtgatctccttcgcgagagcgaaagtgctaataacgtgttgaatgtggatagaattgattgaacgagagagattgagagagagaatttaacacaagaatgtatcgcgaaagtgctgataacgtgttgaatgtggatagaattgattgaacgagagagattgagagagaatttaacacaagaatgtagggaatgaatgagcggatcctttattgataacagtgttacaatatacagggggagagaggcgacaactggaggcgcgaccgttgctagaatcgccgtgaggcgagaacatgtgtggggcacgaccaaccgttgtgtccctgagttggttgttactctatccatatatatagatgagatcacccaaatatttcataacagtttgacttttgttccgttgattatttcggaaaattactccttggctatataattgcaagggctcaactctgttttaccacaaagttaactgcaattataaatttagaagataattgagcagtatgtacatttaatttgccacttatctcatcgtatccctttgattttactttggtctgccttttctgaacttccatattgtggatcaattaatatacccacatgccacatggtacccataagaggaatacacaggaataaagcctctccccattacctccctcgactctattgtgctcgacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttatagggaaccggtttttttacatgggaaacttcaatggtgcggaaggattatagagatataagccacgaccaccaaatgcagcttcgcagctgaatcagcgaattgaagtgggaaaatctccttctctgaaatttacaatattagcaagagcactaatctataggaccattacataatttgtagaactaatgaactgttttcactaaattacataaaaattcagggactaatataaaattgctgctaaaataaaattaaaaactaaaataaaggggtaaatgggtggt

SEQ ID NO: 41297 - DNA, 2856 bp, Oryza sativa
ccaattctttcgacacatttaaagaatgcggagtatggtagagattttgtgaataaatcagcaagattatcacatgacttagtttgcaagatgtttatctctccatgttgctaaagctcatgaggataaaataatttgggagcaatatgcttagtgatgttgctcttaatataaccagtttccatctgaacaacacaagcggcattattttcatagataatggtaggtgattccaatgaaccaataccacaagaagttatatgtggttaaccattctgcgaagccatacacattcacgtgatgcctcatataatgcaattatttcagaataatttgtggaagtggctactagagtctgtttagaagacttccatgaaatagtagttccaccttgtaaaaatacgaattctgtttgtgatctggcgttgtggggatcagatagatagccagcatcagtatacccaattaaagttgaatcctggttctttttaaagaaaagtccaagatctcttgtgccattaagatatcgaaagacattcttaactccagtccaatggcgtttggtaagagcagcgctgtatcttaccaatagatttaccgagaaagcaatatctggcctcgtactatttgcaaggtacataagtgcaccaatagcactaagatatggaaaatctggtccaagcacatcctcaccataggggttttggaaggatatgacttgtccatattaaatttctacaaaattttttaggtatatgcaccttggtgcacaaggattccagaagataaatgctcaagttgtagaccttaagcaaaatttggtttgacccaatccttcatctcaaattccgtctttaaatgatgacgtgcttcattaatatcttgtgtattgccaataatgttgagatcatcgacatataccgagataatacaaaatcctgtggggtttttttgataatgacgcacgggcaatcatcatttttagtgtatccctttagtgaaaggaattcacttaatcggttgtaccacatcctgaccgattgttttaagccataaagtcacttctgcaacttaacacaatacatgttacgatttaccttctgattcgggatgtcgatgccgtcaggaaccttcatgtaaatatcagaatcaagtgacccataaagatatgcagtcactacgtccatcaactgcataaatagacgattttgtactgccagtgatattcaatatcggaaagttataccactcataactggagagtaagtttcgttgaaatcaacgccaggtttttgcgtaaaaccttgtgctacaagccttgctttatgtctcaccaccacgttgttttcattccattttcggacgaaaacccatttgtatcccacaggaaagataccacgaggagtaggcattacagccgagaatacatctcttttgtaaagtgaggctaatactgcgtcaattgcgtccttccatttgttccagtcagagcacttttggcactcttttatagacctaggttctggatcaacttggaggcaatcagcaatttgttcagaaaaattaatgtcgacaattgtagctcttctatcaaaagattctccagtttcagagtagttgatggcaatttcatcaacccttatagactcatcgtgatctcccgaaacaatgtgtctatggtcttccgaattcctagtcttagcattgtgcaccaccgagctaggttgcagactatcatgatctgcttgatattagtatcaatttggtgtgtaccaactaaaggttggtttgcatttaccgtctttctttgcttattagcaattgtttctcgctgagtggccatacttcctctctttttagtgagtagaagttagtggttttatttggtacctccactctttttggcgcattctgagcaggaatgaaagatttagtcacacctttataattagtaaatgcatctggcaggttatttgcaagtctttgcaaatgtataattttctgaacttgtagttcaattttagtaatacgtgggtctgaggctggaataccctaggcatcccaatcaatttcctggcattctttcgggtacttgaagtctccccctaatgccgggaaatgttcctcatcaaagatagagtcagcgaaccgggcagtaaatagatcacctgttaagggttctaaatactttatgatcgacggagatttgaatcccacatagatccccactttcctgtgtgggccatagcagtacgatttgatggtgagatcggtatgtatacagcacatccgaacttacgcaaatgggaaatacttggaggatttccacatactaactgcattggggaagtttcatgatatgcagttggttgtagttggacaaggtcagcagcgtgcagaactgcatgaccccaacatgacgaaggtaatttgcaattcatcaataatggtcgagcaataagcttaattcttttgatcaacgattcagccaaaccattttgtgtgtggacatatggaacagagtgctggacctgaattcccaatgccatacaataatcatcgaaagcatgagatgtaaattcggcagcgttgtccatacggattgattgaatcctatgttcagggtaatttgccttcaaccttataatttgagacattagtttggcaaagacatggtttcgtgtcgatagaagacacacatgagtccatctagtagatgcatcaatcaaaaccataaagtacctgaacggtccagatcttggcacaataaggccacagatatctccttgaacgcgttcaagaatttaagtggttcggctctaattttgagataagatggtctcaaaatcagtttct

SEQ ID NO: 41298 - DNA, 2655 bp, Oryza sativa
atgatgaccaatagagttgccaataatttttctcatcatcccgatactggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattgggagtgtaataattgctcgtcctgagccaactatcacagtatcgcacccagcgatagtcaaaactttgccttctctctttttgagagtttgaaagtatttgatctccctaagtatagagtttgtggtactactgtccacaagacataattcctctccaatcggagtgatatccttagacatctatagtaaaagaagaattacttagtgaagaattctttatccacaatatatacatacatacaataatgaaaacataaaatacatagtatgacgtttacatatgttaaaagtacatactctaatgactagcaagtcatacaaccttataatataagggagtttgtacttatctacttattacaaccaatattgtttggcaaacttataggatatcaatataatgtctcaaacacactgagattaaagcagctttatctctaagtgggatgcactgagattacagtaaatctccaagtgggttcgttgagcagtactcgatgagcatgtcatccattgtagaaagtgcagtggtatcttctgggagaagagcgaggttgttctctggttcaataggagcctggtaaaaactttcaacctcaggtctttcttttgtaagattgaagtgagcttcaaatcttagttcctcagaagactttttctcctttagggatttctgatacaggagaaaagatgttgttgggatgcggcaatctttagcaacatgatagtcagatccacacctgttgcaatgcctgttgctattgccactaggttgtggtgccttacccttcccttttcctttccaatcaaccattggatttgcgctgttgttgcatttgcgttttccagtcagattcttagggttattcgaggaatttcccttgaatcctttgagtgcgatactgttggttcagtatcatgtcctctggaaacatagttgatagagttttctctatcttctctgcttccgttggctctttttcgcaaaacttcaacttggagcaaatgttaagaacaacatgattgtattctgccacagtttttaaaatcctgtaggcgtaaatgaatccactcataattagcctcaggccaaatgagttccttttgctgatcataagctttccataggttgagagggctcgtctccaacatgtattcatgtttaagatctttatagatgtagagccttagaagtaaaagggcaatatatagttttctgttctcaactggtagatcccaatcattgggttcctaatttgtatgtgaaatcccactagaagaaaaatttattttgatattggaagcccaaattgggtagttactcccatcgagggcgagttcgtcgaactctatagttgccatgtccctataatcatgataaacattattaatttacagaggtaaattaataaaaagatgatattgtggttgtaatctcaatgcgaaatgtaagacttcatattttgtaatgtttcgaaaaaatgcaggtaatagacctgacaatttgagttagaattcaaaattaggtggcacaatgtggataatctccaagtaattaaacagtgtagtagatctcttaatagtgggcaagttatacttgctgcctaaaacacggtctctaggcaaatatattctggtgaatataccgcagccaatgtttaggactccactaccttgtgctcaaccaaaattccaataatctcattttcaaaacatattctcggaaaaaaacacatgtcggtaatcatcgtgagatgtagacctctgtgagatcggcgagatactcgctgcctaggttacgaccagtgcggccaatttgtagggctccatcgggtaatcatctcaaaatgtagatcacttgttgatgggcgagatactcgctgcctaagttatggtcacgatgaccaaagtataggactccatcgacatgtgattaatttccaagtcaaagtgtgaagtggaacatgcattaaatcatccattaattatgtagtacataattaagagaatttgctaaattaaagtataaaatttataaaattttgtaaattaataaagcaagaaagtagagcatgtcttgaaataatatgcaaaaggcattttattaagacaactaataaatttagtgaaacatggtatttgaaaaaacacctatgttaattaacacataacatcagtagtctataggaccattacataatttgtagaactgatgaactgtttccactaaattaaataaaaatacagggactaatatgaaattgctgctaaaataaaattaaaaactaaaataaaggggtaaaa

SEQ ID NO: 41299 - DNA, 4949 bp, Oryza sativa
cgccgcctccataatccaccgccaattccattttcgccgccaccatctccccctattacaccaccgccggcgcctccatttctgccgcccccaccgccacagcagccgaagtccccgtcgtccgccggcgagactaagccgacggccccctctcctcatcggagtaagaggccagtcgggttcggacgctgtccccccccccccccactccgttcgggagcgtgcagctcggggagccacatgaacggtgcggaaagtagcggggaggccgagcggcgaacgggaaacggtgccggcggcgactccatctccagtgggagggagcactgctcgccggggggcgtcaccgctgtccatccatggagcctggacctggacgcaacggggcaccggtgcactcgtggcgggcgcttgtggtggtggagtcggaggtgtggcagcgacggcaaatgcggcgccggggatggtggcggtggccaccaaccctagaatggcgcccagcatggcgatggtggtgactccatcgaatcgacggaggaggtggcgaaggcgatgaatgcggtctcggcgatggaggccgagaacggcatcgaggatgaaatcaaggtagacgtacttacgcgatttccttagtttcttctgtttctttcgcttttcttgaaatcaaaagcaatgtttccttctttcacttcgtgatctccttcacgagagcgaaagtgctgataacgtgttgaacgtggatagaattgattgaacgagagagattgagagagacaatttaacacaagaatgtatcgcgaaagtgctgataacgtgttgaatgtggatagaattgattgaacgagagagattgagagagaatttaacacaagaatgtagagaatgaatgagtggatcctttattgataacagtgttgcaatatacagggggagagaggcggcaaccggaggcgcgtccgttgctagaatcgccgtgaggcgagaagaggtgtggggcacgaccaaccgttgtgtccctgagttggttgttactctatccatatatatggatgagatcacccaaatatttcataacagtttgacttttgttctgttgattatttcggaaaattactccttggctatataattgcaagggctcaactctgttttaccacaaagttaactgcaattataaatttagcagataattgagcagtatgtacatttaatttgccacttatctcatcgtatcccttcgattttactttggtctgccttttctgaacttccatactgtggatcaattaatatacccacatgccacatggtacccacaagaggaatacacagaaataaagcctctccccattacctccctcgactctattgtgctctacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttctagggaaccggtttttttacatgggaaacttcaatggtggggaaggattatagagatataagccacgaccaccaaatgcagcttcgcagctgaatcagcgaatcgaagtgagaaaatccccttctctgaaatttacaatcttagcaagagcactaacctcttgaaaaaaaattttagtcggtctctctcatcccattcctacatttttcctacgatccaatcaaacaaccgttcctatgttttttcctatattttgtaatcctctgttttatacttgcattcttatcaaaatcctgtgtgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatatgcccctagaggcacccggaccccccttatatatgggaaggagtccgtgttacaaaagataatccatatccctaacggaatatgcagatacagataaaatacagtcgtaaccgactaagtctcaaggtatttccttgatgtacaagttgagaaacaaacccgagacacaaataagatattctatctatatttggtatcctgtactcagcccaaataccattgccgtgtagatatgggataaccataatctccacagtagcccccgagacctttgcagtcaaccatcgtagccttctcaaagataataatccgagtgctttcaaacctttcatgccaagactgtaaagggcgaaaagataaagaatacggtgcatcgaatagatgcacctaattaggtgtagcccccaactatgtgattagttaacaaactaaacatatagttgagaacaaaataatagcacaatcgtgcatcgcatgacaaaagcatacgcggcgcctaaagaggcattctagccgactgctttttagccataataaaaggaatccgagtggttagcactctaaaaggttcacgaatgaactcacttgacaggcatccgaataaaaaactctaaagattacccaccaaatattataaaaattatggtaatgaataagtctaatagcctaggctatgactatttaccataatgaaaacaggcatataacataccaaggaaatgactatgataaaaacaagtcattctaagttaaccctgacagctttcgtagcctaaaaaagcttacaaaaacggcataacacctttctgtcgggcaccttttaatttgcattgcaataattccaaagaattatatgaccgcgtaaaaaggattttatcagcattgggcaacactattgtgcgcataaattgccaaagcaaaaaaaatgcctaagtccctaaggagcacaatgggccacgctgtttaaagtactgggctgaggtactgttcaggcttaggcccatttgcacctccgatacccttaacaataaatcccaagatccaatcgacgcttcgtcttccccgccggaactctcgccattttccccactccctgctacagtacagagctgcgccggcaaactagggttcaccattccactcaaatccaccttcgaaaagttcatcaaaatccttcctgtgatccaccgcctcaatccctcacttctcccaagccatccctcgaatcaaatcagcgcattcggataaaatcaatggcggaagagaaagaaagctttgaaggccaatgggcgccatccgacgtgacagaggagaacctgaaggagatggtggcgcacggcgttctccctgctaaggagatcatcgggtggcgaccagcgtgcggtgaggcttttccgacccccgatacacacgaggttgtagtcttctcccatttcttctatggcggcttcgctcttccgacctcaaaatttttccgcgggatattaagcttctatggaatcagcttgcatcacctaaatccaaattccatagtccacatcgccaatttcgtccatgtttgtgaagccttcttggggattaagccccacttcgctctgtttcgccgaatcttctttctcaagccccaaccgaacaagagtaagccatgtgtagtcggaggggccggatttcagctgagggggactctgagccaaaagtacttctctatgcccttcaagacttcaaacaaagggtggcacgcaaactggttttatattcagaatcctgagcctgctcttcctgagtattcttgtcttcctccggtgtaccaagatacctggaactctcttccgattggggatgaagcagcccaagccttggaattgatggatcgcatgctaaaactcaaagaacaaggcttacaaggagagcagattactcggcacttcatcaaatgccgattggcaccaattaaagaaagatcccgtacagcttttgagtttgacggcaagcatgatcctaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgtatctgaaatcctcaacccgttaccaaaacataatcttgtcttcatgttgagttatctaaccgtggaggcatctcattcaggaatatgtattgatgaagtctgaccccccaatcactcagcgccggtctcctcgccagcacaccgttcagggaggtggagggccgacaatcagatcagacccacaacctcaaacctccaatccgactgggcagacaggttctcgcaagagaaaactggtgcttaacgacgacgaaggcgacgacggcaacaaatctgggaacaaaggcttgaccaataaactcccaaagcataccactcccaggaaaaactggctagccgtccaatgccaaagattagaacatcttccaggtataaacctctcggtatcatttcacttcggcatgcttctctcatgaaaataatactgaatattgaaagaatattttgcaggaaaccatccgacatagatccaactggaaaagatcctgatccggctgtgacagagccaaattcatccaaggattctgagccaactgccgaaagccagccgactggcgcccatacttcaggtgataaggccgatccgagtgaccaacctccgactggaaactagtcggcagcaactgaaactacaacaactcaagagcccccgactggaaaccagtcggatgtaggtccagatcaagaaactcccgaagttgaagcgcagacgacaacttctcgaggaccagaggctggtaacgactcgatgattgggtctccgaataaagaacaa

SEQ ID NO: 41300 - DNA, 2686 bp, Oryza sativa
  unsure (1)..(2686): unsure at all n locations
gcgatgaagaagaaattctccgcataaaggcggctgatgactctcgtcctcctatcttactcaaatggtgggacgagaactcacaagctgccggcatcgtcataaatcgtcaaaaagaagatgaggaagtgtgccagctgaagaaagcacttggagaagccactcgcattgtgaatgtaaatcttccgggcgactgcctttgatgactttgttttctctttagcagaactaaaccatgaaccatcatgcagagaatccatcttcgtaatgaggccaagaccgcaactttagaaaagctggttcctcatttgggaactcttgaagcagttagggaccagctacacgaggccaaggagcttgccaagaagacagagaaggaattgagggaccaaattgctcagctccaggattcaaacttcgagctgagaggttcatcaaaaggtaatcttctagatctgtcccattaatttacgctgtcataactgtatcctcaaccatttggatttcaaacagcgcaagccaccaggatggcccaaatggagaaacaaattgaagccttgaaaagagacaaggtagaactggctgcacaaagggactcggccttgaaggagattgaaggtactgccagctaacaatctgaacttctctcttttaaatgcagcaaattcttatcataaatatgttttgtagaccgcaaaatcaaatctcaagctcaatttgacgtcctggttggcaagatcaagaggcttgaaggagcaagagatgaagtcgctagtgtcgctacgccactcgtccaagctatgttcctcaataacagtggtccgagtgcactcgacgcaaccgaaatcttcgacaagctgagagttgctccggatgtatatttcaagaatatcaagaaagctggaagcatgggagctagcatggcattggcgatgaccaaatccttgtacccaaggattgaaattgacgccattgatggctttgctgacgggacaagcgaagaagctgctcttgatcttatcagcaatgctcaaaacgcggctgacaaaattgcaagtgacgttgtagatagattccgcaataccgacctgcagccgagtagtaacaactctgatgatgaaaaaactgaatctgactaagtatgaatgtaacaaatggaggctcaacttgtacaatactagtgtatttatgctgtgtttgataattctagccaagtctttgatttcttaaaagcttttatcaagctttgttgagcctaaaacccaaagaagctattaaaaactttcagtcctcgcagactaagtagaaaaatcaagcaaggcaatgatagaccaagtaagcaaattgaattgataaaaaatcacactccattattatgataatagcccccgactgacaacttcaagaagaacacttgatgttgacagtcaagatagggaagtacaatgataagcttaagcgtagaaacgacgaagatgttcaatgttccaagagttgtcgacgagtgtgccgtcttcgcgcttgagtcgataggaacctggtcgggtgacttcagagatgataaatggcccttcccatagaggagataacttgtgccgatctcgtgtagtttgaattttcctcaaaaccaggtcgccgactagaaaggcacgggatcgaacattgcgattatgataacgccgcaacccttgtaagtatcgagccgactgaatcaaagctgcttcgcggacttcttccaatcggtgcaagtcatccactcggtcctcttcatagcgttcttcgcggaaattacgaaagcgcaaagactcgaattcgacttcactcggcaacattgcttctgcctcatagacaaggaaaaaaggtgactggcctgtggcccgactgggtgtagtacgcaaagaccaaagtactgatggcagctgttccacccatttgccggcataaggttttagccggtcaaaaacacgcgctttaatcccttgaagtatcatgccattggctcgctccacctgtccattgctcatgggatgcgccactgaggcatagcaaatcttaattccaaagtcttcacaaaagtctttaaaaactccgccagtgaattgtctgccattatcagtgatgatccgattgggcactccaaatctatgcacaatgttgatgaagaagtctcgagctttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgggctggtagatgaatttgtctggcgaaaaattggcaaccttcgcacgtgcgcacaattttgtcggcatcggacactgcagtaggccaaaagaaaccctgccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41301 - DNA, 1561 bp, Oryza sativa
ctgcaccccatatatacagtggcgaagccaccgtaggggccagggagggccaacacccccctaacccctatgtgacctcccctcccatctcttctcccaaggataattagcccttataatctagccattaattacatcattagttgcagatgagactaactatataggataactgcctagctatatatgacttatgaaatgacttagttaactgatttatcattttaaaaatgattacaagactccaattaaaatcatggaacaaactgtttaaattggcaaattatgatctatgggttctcattctctcttctagctaatcgctataacatgtatgatgtcgagttagtgatcatacatcaacgctacaatatcactgttcaccgaaccttaagtaagttaccacgtctcgtaaatggcaccccccatctctaaattctggcttcgccactgcatatatatatatatatatatatatatatatatatatatatatatatatatatatatatatatatatatatatatatatatatatatatatccccccccccggttggacttggcttatgctaattcaagtccaaatgggtgatattctgacgttttgaataaattgtaaataataatccacattttatttgcaaaagatctggatcgatgtcatgatcatatacgtgtccatatgttgccgttctttccactaaattaatttaattttgcaagtcaactctcgctccggtttttataaatacgtacaaacattttgtatttacgtactgtttcgtttatatcaatataaatagaatttgtatttttagtaaacaaatcgatcaacctagctatggtcattttagaccccacaccatgataaagatgcaaatatatattcttctacgtggcatttttcagtcctccatgtaaagatatatttatgacctctattagtaacacgatacaattaattagtgcagacttttgcactacgttccgatgactttgtatacgtgtgacgtgtagtctgcagaggacttccagatagctgggaaaattatactgtatatgcgtactgtactctgtaagctgtcgctgtactctgatgtgttttataaaaagaaatacgttaattcatgttactccatccatttcgtattatatataagttattttgttttttaatcaaatttgtttaaatttgatcaagtttgtaaaaatatatactaatattttcaatacaaaacaaacatattaccaaaatatattcaatattaaattcaatgaaactaatttagtggtgtagatgatgctaattgttttaataaatttagtcaaacaaaaagatctttataaagaaaaaagtcaaacgacttataagagcaagtataatatagtagactataagccagctaaatgctgaggtggaggagagaagacaggagaagcgggcacaataaccaataaactctgtgagagagacaagtgggccctatattaattataaatagctaactatcatataggtagactgagagaaagctacaaagaaccttatagccaacag

SEQ ID NO: 41302 - DNA, 717 bp, Oryza sativa
atacgcaaaccgtctttttcagaactggacattcccttctcttctgtaactaacatagtatgtgtatgaaatgcgatgagtcaacttcagaactaattgtagtttgctggttataacatttggatctcactcgtcagtgccttaaatttgttggaatgctgatgcttttaactcaaatcctcctgattttctaggtttctggggatgggttcttctatgttgagggtgcatctgctactcttccagtgtcgattgctaaggttcattcgactaccttattggttgtcacatgccaactattcaaactgaattccttcaatatagtgcaaccctttgacctctgtttttgcaccaggtgacactggatgaaaagagaaaaacagcaactaatttctctatagtctggtcctcttcagaggatgttatgcaatatgcgtcctactttagtttgcctgaatttatggagtttccaactgtagtcccggccagaaggcttatgcttatttctatgccccgcacaatcatattttccaagggtcgtcagatgagaaacctccgttattggtcagaacccatggtaattagttatatgatatttcgttgacttcaatagcctattttattctttttgtctttactggtcacacttgtagcagaagttattaggaaacatgatgttggtttttctcattccattttgttagtgatatagagcag

SEQ ID NO: 41303 - DNA, 858 bp, Oryza sativa
gcaaaaggtgactattacattggacatacgggttggattgaatacttttaccaaagcagaaatagtgagactcttatggtcttacctacaagattgtcagtatagtgagactcgaatttgtgtgtctctgctctcaacaaagataagtcaccaatctgctcattaatatggtaataaaaatgacaagtcaacaatctgctcaatagttcttatgtctatgtagagacaaaaatgattgacgttacaaaggtggaccactctgtgaactgcactttaatctttttatcagttttccatatcaaattacctatcatacaaatgcaagtagtgatttaatacctcaatttcacgttataaatcaagtttgttaaattcttagttatatctgtgaaaaacagatcctacaacgttgtgcactgggctgaaaaatattcttgaatattcccatcttggatatggactaagaaaaggatcatatcgccaattattttctaaaagataatgcaattgatgtgtaaaaagtaactattacttaaaaacaatcacaagaaatctagaacctgcagcccccattgttctttgttatgtacatttataggaaagccaaaaaagcagaatcctagaaagatatataacttacaccatacaaagaagctccagccttgaatgtgtccctgaatgcgagtgaagctaacgtagtgtacccacctgctgatcgcccagtaatacaaaggcgtcgctcatctactttcccactctccacctaaaaaatgcattaaggtgttttgttagcattactataatgaaatgctattatataattacaaccattactactaggatgtaccaggactcttg

SEQ ID NO: 41304 - DNA, 1818 bp, Oryza sativa
  unsure (1)..(1818): unsure at all n locations
gtagcggcatcctagtctctacaagttggccacgttggagggcctaggggggagaggtgttctattattctctctcaccctctctcccttactcctaaagacttggatagataagggctttgtgttgattgtaagggttgggttttgggtgatctcggccgtgtttctttgttgacctagcggtagccggtcacgcttagcgacgaccggtccaatgctagccttctccttgttctatgtgttggcactgtcgatgtatgggtgtgatggtatactttttttttctttttcctggttacgaccttctaggtttgtaatcttataatttttcttctgctctatcaatataacttcgcaccgtcttatgtgagtcgttccagaaaaaaaaaacttttagggcccctttgaaacgcataggaaaaacacaggaatagaaaaaacgtaggaattgaagtggcatgttttcctaatcctacaggaatggaaaacacaggatgaagagggtccctttgatagcaccataggaaacaaacaaagcaaaagatagtttccaagaggttgaatctcttgcttattttcctatgaaattgagctataggaatgcaatcctaagaaaaatttcatatactttcctatgaatcaaagggtttgataggaaaaaatccttaggaaattaaatcctccaaaattcctatgcaaatcctccaattcaaaggggcccttagaggaaaatcgaatacctgtacatagctaccaggtacatcattgacagcaattgacgacaattgtcatcaatcccaggctagcaataatcttcagttcttgcagcctgctagatcatgcagctgctctgaccaggctgcttatggcgcaccgccgcgttcaccttgatccggtgcatctccacatgatcccacctctgcaacgaggcgtacatgttggacaggccataggcagcgccgtcgtccaggtccagctccgatatccggtccgccacccactcgcccaccctgacgccgtcctcctccgacgccgacgacaagcggcgggcgtgaagcaggagacacccgagaatcttggcgttcggcctgacgggcatcgcccgcacgacgcgcacggcgtcgccgaggagtccggcgcggcagaggaggtcgaccatgcagccgtagtgctcctcccggggctcgacgccatggaccggcaccatctcggcgaagaacctccggccctccgctaccaggccggagtggctgcacgccgacaggagcgccacgaacgtcaccccgtcgggccggatgatcccgcggcacgttcgactcctcccgaccatgtcgtggaacgccctgacggcgtcctcgccgcggccgttcatgcctagccccgcgatcaccgtgttccagcagaagaggttggggccgtcgggcatggtggcgaagacgtcgagcgcgcggtccacgctcccgcacttgaagtacatgtcgatgagggcgttgcttagcacggcgtcgatccttgtcccgagctgacggatgtagtgatggactcgccggccaaaggcaaagtcccctgcctgcgtgcacgcggtcaccacggtggctatggtgaccgtggtgggcatcatgagcgtctgttgtgcactgtctgtcgcatcaaccggcggaacatggcgatggcggtagcggggtcacctcggcgcaaatacccggccatatcgtgttccatgtgacaacgtccggcgacggggaagaggagaaagagcagnnnnnnnnnnnnnnnnnnnnnnnnnnnnnnnnnnnnnnnnnnnnnnnnnnnnnnnnn

SEQ ID NO: 41305 - DNA, 711 bp, Oryza sativa
atacctcaagaatttgcagcacgtactctagctcaagaatatggaggtggtgcattttcagtcaaagataatgttgttgtgttctcaaactacaaggatcaacgtctgtacaagcaaagtactaaaagtgagtcatttgctatggttgtaggactaaggagttaggtgaacctaactgaattagcatgtcaataaagaaatataatttagttggaaggatgtgtttttactttccttacttatggtaattctttgtctagtacttcattgaaaaatatttcattgtgtatatgcatttataggttactgtatagcatgctcattcaaataagtagaattggtggagcatgtcttaacaagcgaaaagacttgcgtttataatgaaatgacagccagtgaaatgataggttgtgtttgacaggattaaaaaggaaatctaatcacactattcagctgttaaatatttagaaccacttaatgcttgatgatcaatatgcatattaaataatgatatttttttctgctgaaatatttcacatgatgattttcccttgtcagctggtgtgcctgtgcctcttacacccgattatggtgggcctgatgtcagttatgctgatggagtctttgatcctcacttcagccgttatgttaccgtgatagaaggttaattggcatatgattttattacaaactatagttgcatactgaact

SEQ ID NO: 41306 - DNA, 1744 bp, Oryza sativa
  unsure (1)..(1744): unsure at all n locations
nnnnnnnnnnnnnnnnnnnnnnnnnnnnnnnnnnnnnnnnnnnnnnnnnnnnnncagccttcctctaaaagttattacttcctccgtctcaaagaaataaaatacttagggatatctagattcatgcttagaatttaagtttttttaattatatttttaatcttagtatcaaggtgtctaggctgtgtttagttccacgctaaaattagaagtttgaagaaattggaacgatataacaaaaaaatttgacatttgtacgtgtaggaaagttcgatgtgacggaaaagttgaaagtttgaagaaaaaaaaagttgaaatttaaatagggcctagtatcaaacgcgtagccactgatttctaacgtgctgtcgtttgcaatgacgtcgcaggacgtaagcacgcgtgcggcccaacgttcgcgtcgctttctttcgatgcaacaatccccttttgttgacttaccagaattcgccttattctgtttatgtttggtctgtttgtagtgtttgagaatcctacgtatttcgaactttatgttttaagagctaaacatttcactttatccttggcgggcacatgataaatttaaccacaaaatactacagtaacatgcaattcgaaagatatagagtgttcctttaaaatcatactcctacttatctcaacttggttgttttaaattttataaatacctggcattgtcaaccgcgtcagtattgaaacgtaaaatactagtagtagtatacagagtaactacaaacaagttgtttatttactcaaagcactccgggaatccacacgcactagaacaagcaatggaaatcggaaccataaacaaatagggtcatgtttgaattcagaatcaaacgtacacaccaaacacaccatcgcgttgattggcaccgtcctcggcaccaaactcctgctacctcgatgtcttgatcagaaccacaggagtacgcgaactaaaaaacggccacatgcaatgaatctgttcccacgggaacaaatggaaaccttttttctaacgacaagttgtgatgacggagagggtgacaacagcagttgggaacacttggcgtctcggcgaccaccaacacctataagtagaggcaggcaccaacaaaaatggaagtagagcaacaaagaacagagcagagcagagcagcagcagcaagaaacagagagagaagcagagcaatttcgatcgagaagaaccaaagctactcctaagccaaagatggtgcacgcaccggcgaaagtggcagctgcggcggcgatcccgctgctgacgccgtacaagatggggcagctggagctctcccaccgtgtggtgctcgcgccgctcacgcggtgccgctcctacggcaacgtgccgcagccgcacgcggcggtgtactactcgcagcgggcgaccaggggcggcctcctcatcgcggaggccaccggcatctcccccaccgcgcagggctacccggagacccccggcatctacacgcagcagcagatcgaggcgtggaagcccatcgtcgacgccgtccaccgcaagggcgccctcttcttcctgcagatatggcacgtcggcagggcctccaccacaggttcgtccatctgccagattatttacttgctagttgttactacttggttactgattgattcgaaagaatcaaaggtcattgggctctttgattgattaaatttccaaatgaaatcgacagattttccagccgaatggacaggc

SEQ ID NO: 41307 - DNA, 3705 bp, Oryza sativa
actctagaggatccccaactttatgatagaaatttaacggtcaaataatagtcaactgatgaaaggggtatacaaggggatccaaattgactgcttagggatatgaaagaaaacaataaacaaatctcaggagaatagaagggattgggtgaagttcaagggtacatatggaattttctcaacttggagattcgtgcatacatctaccagtccatatctattgcaaccgttcattcattttctgtgttccgtattctttaggcctgattagatcttctggcaagttttttcaccctgtcatatcaaatgtttgaatgcatgtataaagtattaaatatagataaaaataaaaactaattacacagattgcgtgtaaattgcgatacgaatcttttaagcctaattgctatatatttaacaatatggtgctgcagtttatagacggattatgtatttttttttgttattagactacgtttaatacttctatgtgtccgtatcttcgatgtgacaaaggtataaacacggcctttgtaacctttgtaagactgtgtttagttcacgccaaaattgaaagtttggttgaaattgaaacggtgtgacggaaaagttggaagtttatgtatttaggaaagttttgatctgatgaaaaagttagaaatttaaaggaaaactttgaaactaaacacggcctaagtatagtcatgtcaactggacccacacctgtcctaatagctggtggggatagagtggcagtatatccatccccaaaccacacgcgctgtccccgtcatgcgtgttggtggtatagtactagtcagccacgttcagctaatctgatgcacaggaactcccctaaagccaagatttctcactttaaaacactgaaatgcacagtattcgattgaagttttataggttttcaatggtagtgcaccaccttagttttggtgctagctccgccccaataactagtacatctttctagtaccaggatcttgtgttggtgatagagagggccagcacatccatccccaaaccacacgcactgtcgtcttctttccccaaccttcctctctactctccctccaaacatccatggcgtcttcgccgccggtgttgaagtgttgctgccgttttcctgtggcaatcaaaacctcacgcacggataggaatccaggccgtcgttacctcgtgtgcgctcgtgaggtgaatgcccatacatttgttagattttctttttcttggtttgttgcactaactgaagcagttgggaacagaaaagcggctaccagtctatacctgacgaaatcgcgtgcgcactccaggccaagatggtgcacgcacctgcgaaagaggcgatcccgctgctgacgccgtacaagatggggcagctggagctgtcccaccgggtggtgctcgcgccgctgacgcggtgccgctcctacggccacgtgccgcagccgcacgccgcggtgtactactcgcagcgcgccaccaacggcggactcctcatcgcggaggccactgtcatctcccccaccgcgcagggctacccggacacccccggcatctacacgcagcagcagatcgaagcgtggaaacccatcgtcgacgccgtccaccgcaagggcgccctcttcttcctacagatatggcacgtcggcagggtctccaccacaggttcgtccacttgctggtggttggttgattttttttcaaaggtcattgcaaattgtgctcgttggttgattaattaaatttcgaaatgaaatcgacagatttccagccaaatggacaggcgccgatctcgagcaccgataagcagatcacaccggacgattcaggcatggtgtactccaagccccggcggctccggacagacgagatccctcagatcatcgacgacttcaggcgagccgcgcggaacgccatcgagtcggggttcgacggcgtggagatccatggcgcgcacggctacctcctcgaccagttcatgaaggacagcgccaacgaccgcaccgacgagtacggtggcaacctcgagaaccggtgccgcttcgccgtcgaggtgatcgatgccgtcgtcgccgaggtgggagcgcaccgtgttggaatcagattatcgccattcgacaactacatggactgcttcgactccaacccggtagctctcggctcatacatggtgcagcaactcaacaagcacccaggctttctctactgccacatggtggagccaggaatggccatcgtcgaaggacggaggaagatcacccatggtctcctgccattcaggaagcagttcaatggcactttcatcgctgctggcgggtatgaccgggaggaagggaacaaggtggtggctgatggctatgccgatctcgtcgcctacgggaggctcttcttggctaaccctgacttgccgaggaggtttgagcttgacgcaccattgaacaggtatgacaggtctaccttttatacacaggatcccgttgttggttatacagattacccttttcttgaggagattgatgaggagtcaacaactacctatgcttaattggcacctaaataatccaattttagcctattatttggattaataatgtactacctccatattttaatgtatgacgccgttgactttttatccaacgtttaaccattcgtcttattcaaaaaatttatataattatcatttattttattgtgacttgattcaccatcaaatattctttaagcatgacataactattttcatatttgcaaaaaaaattgaataaaacgaatgatcaaacgttggttaaaaagttaacagcgtcatacattaaaatacggagggagtaacgcttctcatgtgatacggacaagcatgaatacattttttttcttgaaagtttgtagctggtggttcgaaattaacgagctaatgtaataatattgttcgagaaatatgtattccctttcctatgatcattatagtgctaatactatcaaaatcctattgcattatctaatgcagctcaacacacctatcatggagcacctatgatcacactgggttgtttcagtcatactatatttttacacccgcatcttcatagtttatattctatattcgccactgtgttgaggtataacatctcaataccaatgcctagtgctgagctcttgtccaaggtggcacaagtttacaatgtcatcgaagatgagcacattgtccaaggtggcacgagtttgtgatgtcatcggagtttagtgccaatgccattgtgttgagataatttttcgtgcataactttgatcgttcgacttatttgaaaaaatttcaaaaaaaacttaaaacataagttatgtataaagtaatattcatattttatcatataataataataaaattactaattataaaaaaaattcaaataaaacgattgagcgtggtaacttatggttacactgaaaaagcttattaagataacaagcacaaatgaaccgagttggctaaattatccaaccctatttggggagagaaatttttcatggtttcttgcattaaatagtaatccacccctaagtttgggagagaacattttcatggtttcttgcgttaaatagtttgggaataagagagaaaatcatggtattaaacatgtggagattaaaaaaaacgataatctggcgtcgcccggactcgaaccggag

SEQ ID NO: 41308 - DNA, 1916 bp, Oryza sativa
tttccatctacctcaagaagcactcccccagttaattacagttattatgcacgtgtaaacaattagcaatcctgcctgcaggtcgactctagcagtatccccgaataatagaaaactattaaaaagtattcagtggctgaaaaaaatgaaaaagatactgatttaatcatttgagctcacagccaaagttcagacaagataaaaaatggagctatctcagaatcattccaaagctcgctatctcctattcagagtcgatggttttccatatccaacttgttatgagaaatgtgagaaaataaagctctgttgagctgtattttatagtcaacggtagtgcagaaccaaatgttccaagcaaatgcacagaagatggctagaagggatgacatcgatgcaaacttctgatgagctgaaactatttcctgaatttgttgaacaagaaactaacccatgtagatagtcagaactcttcatcatcaacaatcaaaatcaataattgctagttcccaaaaacctcatgccctgcctgttctaggattggcaatatcgacgcccacgggtgccgtttcctccctggaggtgttgccttgtggactccctcccccctgggtgaaaaccagcccagtttttggacggacgtcgacagcggcttatgtcgttattcacctccttggagatttcatcttacggtcttgctcatccctcggcctccgacagttcgtagttgtcttgtctcaggctttttgtgtcttctgtgtaaggttttcgccggtttcactttagcaaaccgggcagttgtatgttttttgggcccggttttccttataaacagggtgaactctattcgtctaatatattcggcaatgctcttgccacttcaactcaaaaaaaaaaactcatggccgctttgaatctatcgagcagtactcatcaaaaatcaaaatatgtgcagtcaaatttagaattacaaggaaacatatgttttcaattttgctttagatgaaaaaaaatgtaagtaataaaattagtggactacttggagatttttgaaattaccattggcgtattcaaaggcaattggagaccgctgaagtgaccagccgctgccaggttgtggcctctgcttctgctaagtaacggagtttcttcagaagtgacggatcaattctgcgctcattccaaaatactggcattggtatattctgcataaatttcagaacaaactgaaagattgatttcaaatactacagactgaggatggttagtataaaaatttcagaacaaactgaaagattgatttcaaatactacagactgaggatggttagtataaaaatttcagaacatgaaccagttgctaatccacggctgaaagccaaccagcaaagtgagggttcaccctggaggaaagcagctgtgaatcattagttaccgtggtacaccctcaaaactgagtataacatattcccacgctacaaactggtatagttcagatagattattttcctgtgctctttcccatactattttcataagataagatgcgtagattattttcaattttcttgagtctgaaatcattcattcagttaattaggccatgacttgactcgggttactaacaggtcaaagccccctgaataaatgaccattctaattctaaataacacaatggatctaaacctagggaactgatcacagatgaacgccaataatcatatatgtatgtactccaataagcaggaatataggatcactgatgcactgcaaactaatttttcttataaaaccaaatacatttatttgttccgaggatgtatattgtacctgcttggaatggactctataaactgaggaatgagacgagggcatggctgacgaggcttcgcttgatcccgccgcaattccaacctc

SEQ ID NO: 41309 - DNA, 2740 bp, Oryza sativa
  unsure (1)..(2740): unsure at all n locations
gatcaatgctactcaatctggttctaaagaaatatatcaacacaatggatgcctcgctatcaacaatacatcacctatcatcgaaagaataatatattataaatataagcatctatgataagtctagagcttaatccgaatagataggttgcaccataaaaaactaccagctacgctcacttcgcaatgttactcaaccattactctgtttcgaatcatatcatcctacacagaagtacttgaaatatgcttcatgaaaacccttaaccccagccaaaatagcaaataggcgaaggcctctttcggaatgctgaaattttccccaattcctactagaattataccaaatttcgtaaaagtcatataaaattcctgcaaatgtgctacaatgtgaaaacgtgggagaaattctagctaacggaagcatttattccattatattgaccagagtcgtatgcaaagcttcaagagattatttcaaactacagctaggacagcgttgctccagagttccctcgagttgttcccagaagttgattaggtgacgaataacttcttaacgcttacaaggagggttcatcaaaattgtcgatcttgattggagtgatgccatcagccaccttgaagtgccccactaatctagcgaagaacaccatctgctgctccaaggtaaacttgatgttctcggcctgctccagaaatgcaagtcagatatgtgcctatgtaaaattgtctatttactggtctaaaagtttcatatactgaaaaataatatatacagttagccttcaatccttcatggtaaaaaaaaaaaaaacaattcggtaggaaatactcaacctgatacattactaactaatatataagtttggtgttgcaaagataaagacaagaggtactcgtcagaccttgcggaaaccatgttgttccccttcatactcgaccaaagcaacaggaaggcctttgtcctttatggccttatatatcgtcgttgcctgaactggtgacacaacctgaagatcatcaaagaggtgaaaagctggtaaggagaaacagaatgtgggaaatgcacccgctgctaagtcactcttagccgattttcgttccctctgttctgggttaacagattacatttgatttatcgataggtaactctatctgtaagtgcacttcctagccatatacatattgatcatgggacacgaggactaaagtgcatcagtgataattaaatacccttcatttttgtttatatgatgttattgctttttgtaactttgtactagtacagacgattatattataatgatttgggagtttctttaaagacaaatcagccaaataggtttcatactgaataattatagatagctttgaatatactggtagtaaaaaattgaactcataatgcattgaannanacaaannaaatgacccgaagaggagaagttcagatcttatagctttaccgtgtcttccaatccttgaaacaatataattggacatgaaaatctatcaacgaagtttatcggtgatctctcaaagtaagcctttctattccctggaatattgaaggtatggcaagtaatgttgttaaccaaaccctgagcatatacatacgcctattttccagcatagatgagtgcaaaattccttaccaacaaggttgtcaatgtagtatgcctcaaacttgtgcatgcctgccctcaacgaagctaagtcagcaatctgctttggaccgaagcataacaccagatgcatcaaaatctcagcagatagatagtttcagcaaaagagagaatttatggaaatctgagacttgccccatataaagaagaaccagccttgaatatctgtctaaaagcaaggcagctaaagttgtgaatccaccagcagattctcctgttacacaaagccgttgcgcatctactcttccagtttccaccttaataatcagaatgacactagcataaatgcttacaacctccacacgaaaatatgaaaaaggtctgtgtctgataagatataccaaaaatgtagcacaactgcagcaatcatttacatcaacgacgccccactgccctaaaagcctctcccgaaattttctcccatagcctttaagaccgtgaagaaatatcaagaaactagtccgtatcaaacaccaaaatctttgatgctaaacagatagtatatgtaaataagagcattgtaattcgtcagaaaaaataattcatacatcaaacatccaaataaaacaaatgcaagttctttatcagatatattagagtcaagaaagagctgaagacctgtgcttcccccatagttaacatcaacaaatgcccatcctcggcttgtccagtactgaacaccaagatccagaactccacgtgcttcatctgtaggtccacctaaagaattgcaacaatgtcaatacgagtttccatttcctttctttaaaaaaaagtacatttccttattttaatgttctgctttctagcaattcaaaaggcttgtcagtcaagtcagtcaggacttaggaccaatgagagctctgtgatcttttatcatcactacaaaacattcttcaaacaaaaacaactgaaataaaagagaaacaaagtgctgctctatatcactaacaaaaatgaatgagaaaaaccaacatcatgtttcctaataacttctgctacaagtgtgaccagtaaagacaaaaagaataaaataggctattgaagtcaac

SEQ ID NO: 41310 - DNA, 2925 bp, Oryza sativa
atatgacaacgaatctgaatagaattatatccagattcataatattacgatgtgatttttcatggaacagagggtgtatcacataaaagagcagttaatcatagctcgatatctgcagtactaggggtagttgctattggtgatcatcttgattaccacttcggagctttcgaggcttcaaacataggaggcatggtaaagatattctttttcctgtaaagttgatcgcaaaggtcgtcatttctacagtgtatccagtgtgaaagagcaaaagaaatgctgacgaatgtatagtactttacatgtttcacagataacagtttcaggaaagggaatttatccaattcaggatattgttggtaccagagatattgtacactacagacatgcttccctgatgcagaagacgctcttgaagacacccaacgctaataatctcgcaaatcttcttttacagaacaatccatccattagcatttcttatggggaggccccttagtacgatctgtatagtcccattaagggcttctccctatcctccattctttttcttgctgcttcacgcgctttaagggcggcttcctcctcctttgagatcactttgggcttgccgtcctctctttttctcttgttaacagcaatggcggatggagcaccctttacagttctcatcggattcagtggtttcttgacgaccaaacctggagcttggccccctttaattgtggggacagtcgcaactgaagcagttggttttgtttgtgaacttgaggattgcccagcattagcttgggaggtttttgcccatgcgtatgcctcttcctgagtgacccatttacctgctcattaagaaagcataaatattagtgagaaatagcagctccctcaaaggcatgacataaccacttaaagatccagatacacatgttaagagaagtacctaaaccgtcagaatagtagaaaccagaatttgagtcaaaatagagtccagtagatttgtcataatagtatcctgaatagagtcgaattcccatcctgcacaaacaggatgttatctaacagattgaacaaatattgttaaatagcgaaaattgtaatagtgctggcggacagaatgatcagcgcacatatgcaaacagtgcatcatggttcatgctactcagtgtgccagggaaaggtaggaactggtctgttcatctgttctcctgtctttaatgacatataatcatcagtaaagacttaagagtattaagcatactaaccagaataattctgctagggcacattcatgaaaatctaacatcatttcattaacattaatgcaattgttagcaaaatttatcgtcaacatagtagcagagcaagtattactcacggctcaatttggtagtaaaagttttactcatgatgacatggacaaatctcaaacattcatttctacatcctatagtagtttccaggttacatattttcccatacatttgagccaagagaaagatatgtttgaaggacggatttaagataaaacaattttaggctttgaaaattgacagtagttagacatttctgctaaccaaggtattgtattacatgagctaggttggaatatatttcaagcatgtcaaaaactagaatcagcaggagaaaaaattaagaagataagactaatacaacaagttaatacaagctcaaaatagtgaacaaaaagagaaaacagaaatcatgaccaactaaacccttcaagattggtgaattaacctaaccatcaactaaaaaatcctacaaaagcgtaacagagaagtaggatgttcccaaattcctaaaataaaggaaaaaatattttcactatcctaaacaaaggacggaacgaagatagcaagcatatatcctctaaaattagtcatccttcaaaacggctcttcctagggtgaggtattatctgtccccataaatagaaaattccaggagtaataaataggattaaagtattgatataattggaattgcagaaagaaatactccatactaatttactaaaaaaagaaagtacctcatccaaaggactcattttatattttaggattaaacaaaagggttcgcaaataaaagcgcttagggatagcttcatcagatatggaggcctattttttttttatacaaagcagagataactaatggcacaaaagaaaacaggctatgcagtggatcaggcattgaagaacactattgatagacaacggtgagccatacacaccatctccaggtgccgcagaagtgtcaccgtccacattcctttgactgttctctaaatctttttggtagctctttttagctttctgcagtgaacagtaagttacaaataacaaggcatggtagttcataaatcaaccaattgcaagataaattgaaacaacacagcaataagggaaaggataaattcaaaaagaaaaagcctacatggttttatcaatgcagaagtgtttacccttcacaagctctgtagtttgtgacataacaatatgtacattaggtgattaggataccaacatactggggaaaaaaacagcattacaaacttcaagcttctatttgcttgagggcccgggctgcttgctgctgctccttttctttggcagcaccctccttttgcatggttgccaatcttttagtgacattgtccttgtggcgcttaccgatttcatgtgttctgatgcttagcgggttattagctatgtaaatcttacagaagtcacaccatttgtttccttggctcacccagtactggaaaaagataggggaaaaagttatttataacaaaaacacttgcaaagttggatgcttgtgatgacagtgtacaacaacttaaatgtcaaagaagatgatcgcagataactttcaaagggctaatagggaccctgtattcct

SEQ ID NO: 41311 - DNA, 1290 bp, Oryza sativa
ctgcttggcattttgaccctcattttaacttctgttcatggagcttatggatgcatctactacagtaatattttctatatgattgagtggatggtttcttttctagtttgctgtgctctttttattccttttgcttttaacaccaaaagaggacagttccactctctgttaacttgggatttaaaaatgatgatgagaaactttgtcctgatacaactgcatatacttcactgaaaactgttgtcacatcttcaccgtaatctctgagaccatgtccggtaattgttgttcttgtagggatcttgcttccatcgcgttatcaaaggctttatggtacaaggtggagatataactgctggtgatggaacaggaggggagtcaatttatgggttgaagtttgaggatgagaattttgttttgaagcatgagaggaaaggaatgctatcaatggctaattctggtcccaacacaaatggatctcagtttttcatcactacaactcggacacctcatttagatgggaaacatgtagtttttggtagagtaattaagggaatgggggtggttcgctctgttgagcatgctcctgttggagaggctgaccgcccgacttctgatgttgaaattgtcgattgtggggaacttccggaaggtgctgatgatggagttgtgaacttcttcaatgatggtgatacgtatcctgattggcccaatgatcttgatgagaagcctatggaggtttcatggtggatggatgctgttgagtctgctaaggcttttgggaataataatttcaagggaatttcctcttcaagctaattttcaagtatttttatctgttagattaatattgcatcatttactaaataaaaccaaatcagcaaagtcaggtgacgacagcaaatcctaatcatgattaaatgtttaggttttagcttaagttagtgcatggtagtccttacttgttcgataccagcttcgatagttctagtatttacagattcatgtttcttaagccttctgctgttgatttttgaatggtttagtagccaaactactgctgttttaatgaaatacctgcttgtatcagttgaacaattctagttaattactttggcacaatttatatttcattatctgtttccctgaagctgaagttagtacttctggtcttcacagaaacaggattacaaggcagctctgagaaagtacaggaaagcactgcgttacttggacgtttgctgggagaaagaagatatagatgaaggcaattatctgtctcactacaac

SEQ ID NO: 41312 - DNA, 1358 bp, Oryza sativa
cagctggtgtgcctgtgcctcttacacccgattatggggggcctgatgtcagttatgctgatggagtctttgatcctcacttcagccgttatgttaccgtgatagaaggttaattggcatatgattttattacaaactatagttgcatactgaacttctgacatgctcaaatttcttgatagaccgtcgaaagagtagcttgaatcccaccacaacaatcgcagctataagcttgagtaatggggttgttcagggtaagactatacgaaatgtttataactttcacaaagttaaatctatgtgtgcgtgttgcttgtaattttctcatatctgctttttttgtaagaattcttactttttttttctgtattgaagaaccaaaggtgctgattagtggcaatgacttctatgcttttcctcgtattgaccataataacaagcgtatggcatggatagagtggagtcatccaaatatgccctgggataagtcagaactttgggttggctacttctctgaaagcgggtaagcaacattatctttagaaatgcatattagaacatgctgcctttttcttccaatcaggtaatataaacaaaacaaatgttacattcgggatgacagaaatttagatggatccattatctttttcttggttcataatacatgctagcccttctacaggaatcatttgatggtacactttaataaactttgagtgtccctaaggaaccctatctctaatgcatggaatatatatataaagaagttagtctgactacagaggaatatctcataatactaaaaacttttggatttattttctgttgtaatctctagtgttgcagtctgtctaccttatgctagtccattttcgacctgtttctgatttttttttcaactgttagctttttatgattaagcacccatgattctttgtttgtagagacttgaccaaacgggtctgtgttgctggtagcaatccaatgttagtggagtccccaactgagcctaaatggtctccaaaaggtgtcatgttgcttgttaattttgtctgattatctgaaacatgttgcatatttatttgttacttgagtgagaaagccgttatatgtttgtaatatgtttgtttatttatttatttatttattatgcctgtatgtttgtaggaattcaaacatatttgcatgagaagattatacaaatgtaacattgtgaagcagtacctaccatatcttgctctttctttaggcatgcatattcacatttttaattgactctaatactgaacgccagaagatggaatcaatactattctaccgagatgttacatcatgatttctgtcagtattgctctaaa

SEQ ID NO: 41313 - DNA, 4680 bp, Oryza sativa
  unsure (1)..(4680): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggacacccccggactaaccggtcccataaccctggtctgttcagcctcctccaaaaaagtaaaggatcaaagccactaagtgcaatctcaacgcatatgctctagtgtagcctattgacacctcattgccaagttgccacccatcttatctttagtacaacaaactagaaaacaaattaatcaaacatttcgatcggcgataaaacctcgatagacaaatagactagctttaccgtcttccgtcattcgccttacactgtcaaattttaatccatggtgatcatccttgacatactcgtcatgtggtcctaattcaaattatctcacgcaaataaaatggttagtgtacaattagtgtttgtcattaattaccaaaatcaacgatcggggcctagatactttaggaggcgacaacctaaaaggtttggggatttatcctatcccttgacctaattgatgcttttatatttgttggtgtgtgttaatgggcctaggcttgcacattgcatcgccgctaggctaagggttactgtcacacacctcatggtctacatatcgactacaatgaccttgcaacactggtgagtttcggtgcacatccatattaattttgatatgcctaatattggccaactgtcggttgttttttatgcggttatcatgtactgcttttaagttgcaaggggttcaagacattgagtcatttgcaattttaggttgagacattgagtcattgattcatttgcttttaagtcgagacattgagtcatttgcttttaagttgcaaggggttcaagacatctcaaggcaaagggctcgggggctactgtggattacataggacccagtatcatcataatgggccttgcaatatgggccaacaggaggtaaaccaggtagtagacccttgttgtcggttgtacacaaccaacttgtaactccagatatgggaagataagtggtaagatataattctatctatcccaggtaacatgtggagagagataacaaacgattcagttaagtttggtaagccagatcccttaaaatttggctctccatgtctgtctaaggggaatagaacacccctcgtgaggatagagataagcaccatgctaaaacacatgtgtgtgcttttaagagaaaatttaagaaataccattgacaaacaccaaattccaagaaatatcatcgacgagcgcgagttccataaaatgacatcgtacaagcgatgttgttctagaaataccatcatcgttaaggttactgatggaaccctaacaacgatggcatttctaggataaatagcttgtacaatgacattatatggaactcacacttggcgatgttatttcttggaatagagcgcttgtcaatgatattttttggatttttctctacttttaaataacaaaacatttcattgatttatgaaaaaaaatctagcccccccctctatatatacacactagaaaaaaaaatgtccgtgcgttgcaatgggtgaagactattttaatcttattattattattattatacagtttagttaaggtgaaattcactgcgggaattcgcttggatatatctctatattttttttagaaaatcatgagttgcagttaggaatccgattgtctcaagttaatatgcgagttttttaaaagagtttcttatacatctccttttatatttcccaaagcgaacaaacttaaaaatcaactcaaatacggagaaatgatcggaacgattgaggaaagaaagagaatggcggcccctttcctttcgcactcatatatggatgacgtaccaaagtaccagtaaaaacatcttcaactttataataagagataatatcaaccaggaatacaaaactaaaaagggaaaaaggaaagaaatgaaattgaaaaaaaatcctatacagattgacaaggtaaagcattgactactccaaacaaaaagaaacatggattaagtctataaaaatattcacaaaacaacaccttttaagagatcatcatttattttccggtgatcgaaattgacttggacgtgtattaaagtggggataggcttgactactcctcaattttcatcaatttccatttccgttagtatgttttttaaactgaaaatcagctcattttgctaaaaactatatatataaattactttaaaaatcaaataaatttatttttaattttttcaataattaatacctgactaatcatatgctaattatgtttatcattttacgtgtggctaatcaggattttcgatccctttagaacgtcaccataaggtcagtagccttagaaaacaaaaggatgtatcaaatccatacaaacaaaacatatatatatttacagagaatttaccgtgaaacaactttgtcctcaaacagatgccagttgccacccaccgaaagatacctgtacgtcgtatgtactactggtaaaatggcacctctctctctaaaaaaaggaaaaagaaaagataaagaacgaaagagatggaaagacggtaaagccgaggaagagacgacggaagagaggcatatgggtggtggacgtatgaaacgaaatcgtcgcgtaaggcgtagcgaccacaaggcgcgctatccacacttccacatggaccacaggcggcccaccctgccctgccaggtgccaaaaccaaccttcggcgttgcggcccaaacgttcgttttccttcgccagttcagctcgccatttcgccatggcccccgccgccgcatcatcgtccgcgctgctccccgcggggaccttctccaccgcccgccccgtcgcgggccggcccgccggccagcgccttcccacgagggtagccgccgcgagcaggacgacgacggcgcgttctcctgccgcctgcctctccgtcgggggcaggaggcggggagcggaggccgtccgcgcgtccgcggggggagcgccggccgcgtccctcccggcggcgctgctgttcgactgcgacggcgtgctggtggacacggagaaggacggccaccgcattccttcaacgagacgtttgccgaggtccggttccttcagccccggtctcgctaattttggtttgatgacgcgtttggcgattgctccgcaggtctaaagtgttggtgtcgcttatgtttggtaattactggaatcgacgtcttgttgttcacggattaatttgtttctgcggagtaacgaacctaaatcatgtgaaaatgttgagtagatgatcacctagtactagtaatattacttcaactcggatcattggaatgcctaattcaaattcattgattgcctaactgcactgcaatttacatttaggggctgtttgcttacctgcagcgcaatatacatttaggggttctttgggagaatgatttttatctctcgataagtagtgatcaattttaaaattgagaaattctacttctacaagttgtaacaaaaaggaaaaatcaagctgaaactattatacgtggattcacagttatatatgttacaacttgtaaaagttgaatttgattttcatgtttgtatagtgatatatcacatattaatatacattcaagaaatgaggggacatcgacacaaacttttccctgttgtttatccgattaccatattttaataaataaagtcaactatgttcaattgttctgtttatttcattggccatctctgtcgctaagtaaccccatttttctagcacacttccgaaatactcagtctcaccaaaccttgccatagctgcagtgagcggcttcttcaccacaagtgtgatttacctgatatattggtagaaataggttggttagtgtggccatcaactatggagcatatccagtgaaaacgggctgtgttgaagaaggtacattgtaatttcttccacctggacacctagttcaagccgttgttaatcttccttaggtggaaatgaaagagcgacctgggatacctgtacttacaatagaaaactgtaatacacttttcaactgcaactattgcgttaacacaaaaaacaataggcagttattaaaccttttttttcttctttatgatgaaccgtggatgaaaaacaactgtcaactgtaatacatatgattttatatcatttaaagggtacctactgactgaaatatcaaactgcgtgttttgttgtttacagagggaattaggtgtgagctgggatgttgagctatatggagaattgctcaagataggtggcggaaaggaaaggttaatcaacactttgctgctttctttcatttgttggcctgccaaaatcctagccattcatttgcattcttcaatacaaacaggcgtttcctcgaaacatgttttgaaaatgtagtttgtgcccatataggttatatctatactcctttaaaagaccccaatagtggtggtgagtggtgaatct

SEQ ID NO: 41314 - DNA, 2055 bp, Oryza sativa
tcccccaaatagtgagataggtggacttttatcccatcccccaaccagaagccatcaaacaaggaaaatttattttaaagtgagatacaaaatgatgaaaaatatgattgaattatttacagtggatataattttattttaatttttgaggttttaaagtctttttttaattcccgttgcaacgcacgggcattcagctagttctgtatgaaatctgtagttatcaacctgaaactgtaagaaaaaaaatatgctgctccgttactgtgtcaatttacatatttacacttagtcactactgtgaacacataaatgataaaacaatagtgttaaatgcacaagaaaaaaattaagattttgcaatccatctccttaattatgttgtatacatctaaacagtttacgctttccactaattgttcacataacagatttgcaatttattattgattctgactattatcttgactggtaggggaaacattaaaatgcattttaccactggcatttactaaggatattaaacttcggtaatcagtgcaagaacttcactgtcctttgctaagtctattggcttatgttgatatgaaaggttaacaaatattgtctctggggcagggacatcaaaccatttgtttgttctaacacaaagaacaacatggactgttccgtttgtgtataaaggcatcataagtgtatgctttttcacggaaactaatagttattacctaaagaaaattcaaacaatctaattatcgccaagagcaatatcaagatgtccagggtgaaggatcatcaaatcgaattttgcttatccaattgaaactaaggacctaatcatcagcagtgtagagctgattatttagcattggaacttaatgatttaattgtccattagtgtcagatgttagaacatgctttttggcaatggtgatactaaaagagctacactaagaacaatgatttatagttttatgttggttccttttatgttttcctgtaaataaaattgaattttctggttgaatttaactctagcacctatttcaggatgacagcgtatttcagcaaaatggggtggccagctaaagcaccaaagactgacgacgaaagaaaggagtttattgcttcgctgcacaagaggaaaacagaattattcatggctctgattgagaagaagttgcttcccctccgtccaggtgttcaaaggtcatatattttacatgaatttggactttagcaacttaatgcacttcaaaagttctaacacttcgatatcctgctttgctactttaatacaagtcagttattatgtcttgtggatagccattagcaattgttcatctttaactctcatttgcattctgcaacatttcattattcttttgctctttctcaaactatgtataaactgcagttatattctagttgtagccaagctatttttctttgctggaaaactaaatgcatcttaattaatattgcttcttgtacttacaattataacatgaaatcatgacgataattgaaacaagctttacagaagtaatatcatgaacttcactgttttactttctgttgaggaagtctgcactacatgcattaggaagacataacaatccaatcccactatggaatgttgaatttactaacttcggaatatgttgaagtaaattagtatggggtaagttacctagatgttttaattacaatttacaggttaatagatgaagccctaggaaaaggagtgaaagttgcagtatgcagtacttcaaatgagaaagctgtgagtaacacaatatttccaccttaaatgtacttttatgaagttaattgttaggattggtaataacaattgttttcattttttatgaaatctttcttctgattttttcataaggaaatactccaatagtttcttataaaaacttaatatgtactatttttcacactttttaaatagtagtacatgttgatagtagctgtgaacttgtatgccagatagctcacatatttatgcttgactgaatgcaggtttcggcaatagtttcatgt

SEQ ID NO: 41315 - DNA, 11116 bp, Oryza sativa
gttgtcttgagagaatacggtgttccaagcaagcacactacaaccaaaccctgaaaagaaataaagagaacttgccagcagcagtggtgcaagtgctgtacctgagcggccattatttatttattatgatatggcccagatagtgccttcctttgaaagttgctggttcactcaaatgaaatcatgatagtttaatttgatgtttgctggattgatgatgattccttcaaaatgatccttacatttatttaataatagtatgttttttttatgaagatcaactcttctttcaaccaaattaagttatatttgcttatgtaggaagtaattaacttttcttgtgctataattggattcctggatttcatttctcacgagagagtatgtttctttttatctttgcaggcaatctacttacttgcagcaaccacacttggagtcgatccatctaggtaaggaatgcctgggtttctttctgttgttctgagtacaaatgtttaatgactgttagtacaaacttgtaattaatatttgtagagtctactgattaatgaactagcttggttagatgttaattactgcttgacaactctcataactgttaatccattcaaatgtaaaagaaatattgtgcgtcctttaacattatttttttaagttacattttttttaaaaaaatgtttttataagtaagcaattctagattatttttccagtaaaaaaatataataaagctttgtcgacatatgatgtattttgtaataaataccatttttatcaacagtttaatagtttttcagtttactaacaccttttttcttggatatttagttgtgttgttgttgaagacagtactatagggcttgcagcagccaaagctgctggtatgaagtgtatcgtaacaaaaagcgggtaagattttttttttccatgaaatatttcagttgcatcaaatcgctttcactaattttgcatgtattccataataaaggcatctgttgatctcttctgggtggaagccgattggattatcattagctgtagcaatagtgacagtattcttcttctttttcttttttttttgaaaatgcatgagacctgtgcttcatctcattaagaaggaaaataaaccacccatacaaccaagggctcacgagcccttcacagatccacaaacagcaaggtgacacacgaccaaaaccactctactgcagcctagtgcccttgggttagcgacctacaaaggaaaacttggaacacaagagctccagtcaggcaccaaactagcttctattgatactgcccacaacacctccatgatgtatggatttgctctgttgaaaacgcagtcagtacggtgtttccaaatttcccaagcaactaggatgatcaatgaattcagtcccttttactgctccttaggtacattcttgacagctttccaccaccatttagcaaaacgagttaccgaaggttgaggggcagaggggcagcaaccgccattcccagcttcaagaaaatcaaggtctgaacttgccgagagaagacacatgagacaaggatggatggttacgtccttttgatcacatagtggacaggttgccaggtgtgctagtccatgtttggcaagtcggtccactgtccaacaacgattgtttatggccaaccataggaaaaacttgcagtgtagaggagcccaacttatccaaatacacctccaaggggcatacttgatggatccaagaaagtaagcattctaggctgacttgctatgtgtagggacctgtagttgataacttccatctctgttggtccggcacatcattttgtagagataacccatccaccatgtcccaaatacgaaggtattcacaaataaccttttttttcgataatggaagctttattaaaactcagtcaaatacaccaagatgatacatttcaactgagcccactcccggcctctgcataagatgcacacagccacacacaaagaaagacctatgtatacccccctcacgaaacaaaaaatattagtggctatcaatccgtagactagatcaccaaccatgctcttgggtaaaaaattctagtgccacctggtccaaactttgcggtaccaccacaatagtatcccgaagacccggtttgtagaggatagccaaggtgcgaagccatcgggtgactaaagtaatagcctgcaaaggagaagacaccatcttgttatcaaaaattaccccatttctacttagccaaatggaccaacaaagagctgttgcacccatcaaaaccagatttctcatgtctttaggaacacatgtaagccaacacccaaacatatgagtcacattttgaggaggttgtaagttataggccatatgaataacagaccaaaccaagagagtaagatgacattggaagaacaaatgttgaatggtttcgtccttatgacagaagcaacatttgttactacctttccactttcgcttagctaggtactttgtaagcctgagttgtaagacctcctttagtatcatccacccaagtaaataagacttgtgccactgtgcaatgtttccttgcccttcggagagccttcccagaaagatttgggggtttggggccaattctgcagttgttttgcctttcagccatctatcagtccagaatttggtattctccccattaccaattatgcattagctaattaactgtatatgtaggacaaccctgaatgtgctattgaaataggtagattaggttgctgttaagtttctattttatgttattcgtcattgctttcttctgttctgatctttcaatctaaataaataatacgtgagaattattcacctcatgttccaatgaaatgtacgtgatattatgtttttgggggcgctgtgcagatacactgcagaagaggactttgcaacagctgatgctgtgttcgattgcattggtgaccctccagaagtacgctttgatttggagttctgcgccaacctcctccagaaacaatttgtaagctgaaggagcagacggtcaatttcacccatatcatataaattctataaattcttgcccaggattatggaaagcggaaatggtctctataaaatcattccaaatacaagagtcaagaggaacagcattgctttatatactattgatatttgttatttatgtatagaggagtacatatatgaacataatagaataagaaatcgaaatatctttaattgaaatttgttactaaatctgtcctaaaaacaagttcacttttctaaccgattcatggcagccacttgtccaaattcttgtagaaaaatgaagtcttttttgacggaggaggtagtacttttcagtatgtatgctttgatggcttttaatcgcttggcatgctgatccaaatagtgggttccatgagcacgcgtttttaatggattagctttgaacgaaaaatgaaagtttgtcatgacagtggtcattggttggaacttgtaaccatctctagactctaggttttttttttcaagacaggcatctaaagttgtgcaaagcgtgactatatggctagtattatagaaaacgataatatcaataataaatcgttaaactagacaaactcagtagcttatattagattctatatgtgtcaaaaaagcaaatacaatatgatgtaacggactttataagggtgtgttaggttcatagtcaaagttggatgagatatgtcggtccatattttgttggatatggttatctagttttttatttggttaagtgaatatggcgatgcaattttttgtttggtcgtagggatgaaggtggattttgagatctaatttttttttttggctggagggagtaggtgcatttgcaggtgtagtcacctctcacttgagatggtgaatatacccccattaaattaatacataatacaaattataaattctccaacaattttacaccactacctcctttataaatacacatagaaaaaagaaaaaaaagaaaaaggaaaaggaaaaaggagaaaaaagcagggtggatctcggggctcgctgccgctgcctcctcctatcggccgtcgctgctcgcctcctcccaccagccgctgcaacctcctcccaccaacgcggcgctcgctgctcacaccggccgcagcgaactgttgtcgtcgtcgccgggttcgcatcgtcgtcatcgtcactagccgggcttgatcatcatcgtcttcaccgcggcgcttgtctctcgcgccggatccctggctcaccgctgtcccctcttgccacactagccgcagtgcatcgttgttgtcgttgccgggctcgcatcgtcattgtcgttgccgccgcgcttgtctcttgcaccggatctccgagcttgccaccactccctcctccaaccaacacggcgcttgccgcccatacctgccgcaacgcattgtcatcgccatcgctgggcacgcattagcgtcgtcatcactgtcggctcgcatcgtcatcgtcatcgccccctctctttccatggaggccccgctcgtccgatcgctcgggcggccaaccatccggcatctgaggagaatattcccctccgggccgccatgtcccacttccgcccaccaaccaaacacccaaaaaaaaacgagcagccatgtcctatccacccaaaacctcccatctatgagaaggatcgcatgacacttgtgtttatgaaaatgagagagaggtgcgctaagtattaatggtgtagtatatatccatatatagctattgtgtgagtgtgttattaggtcgactatggataatgtggatatattattaaacttactttttttatgcaaaaaaacttgctctttaagctcaccagtgctacatacagacaaccttttttttttcattgataataaaatacgagaacacgtacctataattttcgggaattttcgagtacatcttttttacccaatcaattagaattcaggttaaagaaggtctttttcctcgtcgtatcctttatatggaaatccggggccagggggccattcccttgacttgtactgatgagaagttttttactccacgagaaattgaacaaaaagctgccgaattggcttatttattgcgcataccaatggaaatattttaagtaccaattgaattttttgaaatgaattgaatgaagaagaataggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaaaaaaaaaaaggcaagaacaaagaggagcgacacgcctgtccacatgcagttggcttccaaagtcgttgcctcgcctgttgcgagtgaacacggaacaggactctggagccactgccgatgaccgttttttcatcgtctttccaggaaaactatggatgacgccgttagctaccacttcacgtctccactctccacccaggcacctactatacggctccacccatagtttttcctatgaggtcttttaaggtgcttgagaggtacctccagtacctcctctcggataaacactcaccattgattcaataaggacagtttaggaataaaaatattgtaaacatggatagcactgtaactttttacaaatgtttccgtctctaatatgcttcttcggcttctgtagtgcttccgaattccgatacatgttcgtgggactcattcaatttccatatcaatcatttactcctattttgttgtgacttaggcacgttctccctccgttttatattataagtcattttgattttttttctaatcaaacttatttaaatttaaccaaaattatataaaaacataataacattcttaacacaaaacaaatatatgtaatattagattttttttttaaaactaatttaatattttaaatgctactaatttttcatgtaaatttgttcaaatttaacaaaacttaagtagaaaaaagttaaaacaacttataatataaaacggcgggaatataactcttttttcccttttgttgagatactatgagaatataccatatagattaaaggaaaatatgtacacgattattatcaattaatttctcagtttatcattaattacacaattactaatcgcgaggttagtggcgcattagggcagtcccaacccttcatctaggatggtgtctataacattaactacattgccatgtaagacttttagcttatgtggcactatattaattaagagagagagtgaagagaggaagaaattgggtctcatgcaagacacagcttcaacgcgagaacctatgcattagacactatcaagttttgcattaggagagaatagtgtcttcataatagatgaagaataaatatgattggtagagaagagagatgatgtatttattaatggcccactttaagaaaccataggttgtagagtgtagtttctattgtgatgtcttattgacatggcaccatagacactacttatagacattatgggttggcactgcccttagaccccctgccgatcacgccacgtcatgatttaattaccctctctcagcctgatctatgcaaaatcaagataattacctattaaactttccacttaatttacggattaagtaccttggcctattttttactacctttcagaagatacctctctatggaccattagattttagttgattaacggaccatataacttccgagaacccctcttttcgggcaaaatcttctcggtttagtgttaaccagcgacgaacaaattatgagaggaagtactgctacacgtgctgaagtgcatgcttgtttttcctcttagatatgtatgtctttttctttcttcttataaagttttctttcaaattacttatccgatctacaatccggttgcaccattgtgttcgttacaattaaatcttcacaacaagatcttacatgattatattacgatgaaaaaatatttatatttgtaaattacttttattatatacgtaagttacttttatcatatatatatatatatatatatatatatatatatatatatatataaaagttacttttagatttgactaagttacttcttagaaatataaaagtaaattcaataaagtctaaaaggtatttacatgtattaaaaaagtatcttaaaacaaaacggaagtaactttgtcacggtattagaagtaaattcattaaagttactttctttttgttataagttacttctataatatatgtaaattaattttaagctttattgaatttacttttatatatcgaagaagtaatttagtgaaatataaaagtaatttagatttattataaaagtaatttataatttttcatcaaaatataatcatgtgagatcttattataaagatttaattgttacaaacacaacgatgtaatcggatcgtagaccggataagtagtttaagagaaaattttatttaaagtatagatggataaagtctcctacaggtggagtggtactagctagtcacgtccctcttttcgtgtacctccagtccacggctccacccaagagttttctgttttttggtcgtcaccaccgtcacgccgtgccgtgcagaccatcctctctctcctccattaccatccgctccccccgactccgacgccgcgcaggtgcagcgcaagcatggcagagtaaggcggagacagcgtcgcaagcagaagcagctctgacactcgccgccagattccgctccccaaacaccgcactccaattccctcttcgtcgggtgcatcggccgcccaccaagccccgcccgccgaacaccatggccgccggctacggcgagcagccgctgccgctggtacaggaggccaccgcccgaatcttctccggtggcgcagacgcgtcccgcaccaccgtccgattggcccacttcctcctcccccgcgcgggcgcctcccacccgcccgctctcccgcccctgcctcccagcgatttcggccccgtcctcgacgacggcctcaaggtcgagttcaagggctgggcgccggaatcccccaagctctggaggcggtgggtcgccaagctccgcccgcgccacgagcccctgtggcgtaaggttgggatcctcgacgccgtcctcgccaccacgtgccgggtgcgccgcgacgagggcgcgctgctccagctcgccgccttctggtgcggcgagaccaacaccttcgtgttcccctggggtgaggccacggtgacgctcgaggacgtcgcggtgctcggcggcctgccgctgctgggcaggcccgtgcgcgcgccgccgcaggacgcgctccgcggcgacgtggacgcgctcgaggccgtacgccgcgctctctacctcagcaagaacaagaacagcaggcccgaccgtaccgcttgggcgagacatttcctcgagcgccctccggggaaggtcaaagtcggcggcggcggcggcgacgaagcgtgcgggcgcctcgagcacggcgcgttcctggccatgtggctgtctctcttcgtgctaccggcggctccgttcgatgtggtccggacggaggtgctcccactcgccgcccggctggcgcgcggccgcggcgtggcgctcgctcctgctgccctggctagcatatacagtgatctctccgcgctcaagcgctacatcaatttggagaaaagatatcaggccttcgtcgtgtgggcacccctgcaaatcgttcagctttggctctggaagcggttccctgagcttcgccctcctgagaccacgggcaccaatcaacctgacggccatggcatacccacggaatcccagtggcaaaatgctctcaaggtgcttgaccccgtttatgtccacgcagtgttcatgtcacccaagaagtttgaatggaggccctatgggagtagcagcttcgcgctgcggccagagatgggtagccatcgtgttcacggccaagatatagcagaaagtgcagaattgttatccttcatactatgtttacgtgcttgtgagcttgtgggcatgcgctgcattgagcattaccgtccgcatcgtgttgcaaggcagctcagctttgaccaggatattcctggaactcttccccgtgttaactcaaactgggtggctgcatgggaaacatacaaaatggagcctaagaaatttgtattcattgttcccaagtacaagcccgctgttacaattgattatgtgcaatggtggaagccttacttgttgggatgtgctgctgctgttgttaaagctaggaagatgaaagaacttccacttttacttagtccaagaaaaagaaagattgatgtgcctcctgatgttagtccaaaaagggtaggaaatggtgcaaaggaaaaggcagtggaattgtcgtttgaggcaccaataggctcagtaagcacaataaacgaattatcttgtgtatcagccaccaaaatagtacaaggcaaatcttttcagcaaggtaataaggaaccaccagaccttgtcgttgcacatgacagagagaatagaagctcgctacatagtgaagtactgcaaaatctccttgttgaggatgccacaaacactggcagcaatgaagccttatgtgcagtaactatagctgatatgcactcaacagaagtgtcgtttgatgttccagttgccttagtaagcattgtagatgaattaccttgtgtgtcagcctccatagaagaacaaggcaaaccttgccagcaagataaagaggaagcacacaacctttctgtcacacatgacagggagaatagaagctcgctacatagtgaagtactgcaaaatctcgttgttgaggatgccacaaacactggcagcaatgaagccttaggtgccataactgtagctgatatgcactcagcagaagtgtcgtttgatgttccagttgacttggtaagtattgtagatgaattaccttgtgtgtcagccaccaaagaagaacaaggcaatgattgccagcaagataaagaggaagcacgagacctttctgtcacacacgacaaagagaatagaagctcagtagtttatgtgcactcaacacctgttgtggctgcaaacactggcaacaacaaagcctttggactttcacccataattgatgtgcagtcagcacctgaagacgttgtggtgatcagcgatgacgataatgaggatgaggtcggtgggatgcaccaaaaaccaccgcagttggaaacagcaccatcctccttagaagggcaaaatgcagaaagtcagataatcagtgcaagcagtaatcctcaggacagccgagtgatgaaagatgttagggtccaaagcaattgtgatcacgaaactgataatgttcgaagcaatattgttctcagaaaagaatcatttgaagtacttgctgttgatactgtccagcctggttttaatctcttggatacaccaacaggggaaacgcagacatgcgctgttacaggacagatagacaagggatacatggtggaaaaagaaattttggctggtgtggaaggtatcaaaaatgtaaatgaagacgtgtccccatcatttcaagaaataaactctcctgtggaagattgcatggtggccaatagaagaatgggctcaggtatgaggattaataaaaatacagttccatatttcaatcaagctatgtaccaaataaatcatgacaaaaatgtgttgacgataacgtaaactttatgctattttttcaatttttgtaggaaacaactattctagtggtttggcacatgtgaatactcaattgatcaacagagtagtttgtactaggacactatactatcttagaccattttggttgtcaaaacatggtcagaacaaagatgcaagtgacaccactaccgatgaaggaactttccaaccaagacgggaagttgggacgccacaaatgattgaagaggcatttgcagctcgacaagcccaaaagttgagttgcaaaaggtaattgatcgcctgaaggaagagattgtggcactagaggttccatagagggc

SEQ ID NO: 41316 - DNA, 7154 bp, Oryza sativa
attggagtgcgtcggatgtcgagcacctacttgatggtcggttgatgatagggcgctggcacaatggctgcgtgttgaaggagtgcggttggtggtagcttctatgtccagtagaagaatcgatacgggggtacaggaagattacggggcgaaagcctagcctctctaggctagcaacggtgacgcctggggtgccgttttcctcttggggcgttgttgggtgatctctcatgtcccctaatggattcctctaagtgaaaaccacgtcttgaatcccaggacgagcgacgacggtattctcagtgttgtacgcttcctgaaggcgtcatttagaagattcttttccttcgggatgtcgttttcatgtcttttagtagcgggcttctagttgtagatacgtgatgtggttgtaattttcttttcctgactatagccttccaaggctatagagttgtatttttttttctgttctattaatatgaaacgttgcactatcatgtacgtgttgtttaaagaaaagaattttgtagaattgaaactcctggtatctcatgtcttgtaacttaaaatcagctggggaggtgcctttgtatggcgtgattttttttttgttgaagaaattgcttctgaaagagagagggtatttattggacttcttataggagaaaaaatcactgcatggattgtaggagtttttttagctgtcgcttatatagctataagatatgtaaacctaaaaacaaaaaataattttacaacaaggttttacattataattctccatgattttgtcaaatcctattcttccaatcgaaagagtgtataacaatagaatccggtgctcataaatattacatgtacgtgggtgtaattagtataaatttatatacgtgatgctattattagtattagtgagtaatctatgccactggtctttgtttgacagcgtgttaagatggtgtactgtgtatatttttaatggtgtgtgtatgtatatattctgtgtaatagaaaaaaaaactctgtagtcctaaatcctaatacttggatcgaaatgatcaaacgaaaaaaatgtgggataagatttaaatcctacataaaatccttcattctctaaaatctatcaaaaaaataatcccccctctcccccgttagacctaagcatatatgagatgtgaagaacatcactcttctaatcaagcataatctcaaagtttaattatcaagtccttgttgtagaaaaaaaagtgttatgtttgttatgttgactatacgattgctacgcactgaaaatacacattagtgcactaatcgtgatcttatctcatgtttaccttgcagttgtagtgcatcaagatgttttatattttttatgctcgcacacattttttttaactttctacaccataagttttaaaaactactattaactcgaagttttaatattgaccatgccatccttgataataggggtggacaaaataaatcgagaaacccaagaaaacaataaaacaagatcgaatatgaaaaacttgaattcttagttgtcgattctttggttagtggtagcttcgtgaagatcaattttgccatagtctttttgctcaggtacctaaactactcaatctatctaaactcaccagtttcggcgatccttcgatatcactaatctagcattccaccaactcaaatctcttacttctaaccctagccgcctaacggcagtggctaccaacccatcagatctgctagtcacatcattgctccacttcaccatcttgtcatgtcttcctccacgcttctgcttgcacttatctctatgtcaagccgtcacattttccagactccacactgccaccttgtgcaactatcaacaccattgcctattgccgcaccacgctatctgtggctctatactatcatccgcgttatttcctgtgcataaatttagtttacttagttagacctcggttaaccaaacagctgatctacacatttttttgcaacaaagattggtttttctaattttaaaaaccaaaatttaaaatactaaaaaatattaatcacgcgcccatccataatttgtagctggcagaataatattattgtgtaagtttatagtgttgtggtaaataaagacttgtcattgtcacccatataaacaatgttaccatagagcacttattatttctagaatttttagttgaaaactaataataaggtttaaagattaaaaagaaatccccaagagttgaacaaatttgccctcttcatttttcctcgacggcccagctccctcgaccaaacagaccagtagggttttaggaggcaacacgccgccctgcgccgccgccgccgccgccgccaccgccaccgccaccgccagattctcctaagcggcgatggccatggcacggcgttccgcctcccgtctcctctcctcgttccgccccttctcgctcctcctccaaccgctcgatgacgccccttcgctctcggccgcggcggcagcagcgtcggcccgccgggggatgtcttcggcgtcggcgctgcgggcgcgggacgagaaggaggtggcgaggtggcgcgagtcgatggaccggatgcggaatatcggaatctccgcgcacatcgactccgggaagacgacgctgacggagcgcgtcctgtactacaccggccggatccacgagatccatgaggtgcgtggccgcgacggcgtgggcgcaaagatggactccatggacctcgagcgcgagaagggcatcaccatccagtccgctgcaacctactgcacctggaatggataccaggtccatcaaatttctgcccgtctcacttatctttctattcgattcgtatacatccgattgcctgctagatcaccatgttttggctatcgaaaggaaactttcaaatcgttcactagtgtgcttattactctctagcaaatttataacaaatagtattctcttgattgtttactcatgtgcttccttgtttagttgctgattctaattcctttttgataatcatatgctagtgaaagcattgttaaactaaatatgctggatttgactaatatgtggtgtatagtttatattgaagcaataattagacaatttatttgcgtttgaaataatataatagtaatatactataatttatgtttttaacttgttattgtctcccaatgtattagattttgtcttcatatccattttctgttagttccaggagtattttatggcaccttattcatttatcttccactctatgctgaacttttgtttgatattgctttaatatcttgataaattactaccatgccactatgtataaaaaatacttgaaaaggtacatgtataatgctctttggatcagtcttggattgctttttaggttttggtataagtatttgaaagtgaaacctcaagatacaattttatgcaggttaatatcatcgatactccaggtcatgtggatttcactattgaggttgaaagagcactccgtgttcttgatggtgctatacttgtgctatgtagtgttggtggtgtacaaagtcaatcaattactgtcgatcggcaaatgagaagatatgaaattccaagggttgcatttatcaacaagttggatcgcatgggagctgatccatggaaagttctcaaccaggtaaccatgaactctttatcctatgttttgctgacaaatgcttccattctggtgatacagaatttctcaagaacattgatacatcaatatgactagtacaacgaaaaattaagctgaatgttttttatttgatttactgggctgtcaaatgagtgatgatgggctgttctatcagattgtatcaggcgctgaaactcccgatacacagctgatggtatgtgagaactagggttctgaaaccagtttggctggaattaccagcctccatccagtaactggctggtacacgcccgatacctgattttacctaaaattcaaatccaaaatttggacttttccccagtaacctcaaactggtagaataattctaaatttaatttcatatccttctgtccaatagttgcccttataactgttccttggctctggaccagttactgggcagtaaacgccgttaattttaactattgtaaccctgaccagaactatcagacagatacaatggttcggaggagtttcagtgcctcatagtccatccatcttgatgcattctgatgccatccttagaatttttatgatttggaaaaaccattgtcctcggtgaacagaagtcaatcttgcattccattccatgtctgcagtgtgcattagttgatctgtacaatgctgcagccgtcaaccacacatcaacggaagaaatttgtctaaattactgtggtgaagcaggactggccaaaaatcatatgagggccaagaacacattacgtagaactttatcaaaggaggccagcatagcataataaaaaagtacaatttggtctttgtttaacaacctatcagtagatggaaggacaaggacaaagaccctctttggagtcaactagaccgctgccacttctctttcgttaccttttactgcaaaaaatagttgatacttgataacagaagtgatgttattgagttgtatttacttgtagctttgccttcttgttttgattttatttgctgatattattgaagatggtaatggagcaacctgtcggcctttactttctctcctgtataaccttattagtgtctagcacttgttttttagcacctataagatgctacatggaccatgattacactaacagtacagttctcgtggtgaaactactgcaaagcaccatttaccttattccatggatttttgtccctgatgttttgttccatcttattcctagttcctgtaattgatttgtttttggtcttaacattccttttatttctgatgaggcatttcacagtgatatgttgctatttccatagctgatagctttcattttctttctttcttttcttttttgctattgaaggcacgttccaaacttcggcaccacaatgcagctgtacaggtgccgataggattagaagaagagtttgaaggcctggtggatcttgtggagttgaaggcttataagttcgagggtggtagtgggtgcgtccctgttctttacaagttcttcaccctgaaggttatgtgcatttggatatttcaataacatacctagcctcatgtttaatgtgcagccagaatgttgttgcatctgatgttccatccaacatgcaagacttagtcatggagaagcggcgtgaacttattgaagttgtttctgaagtagatgatcagcttgctgaagcttttctcaatgatgaaccaatacaagctaatcaactcaaggttcgttaatcatacttcaattttttcgtatattataatcttactctgccatttaatattcatggaattattcatattaaacaatatttaaatgcctgtgtattgcaatggatctcaaatgcataatactataaaatgtaaactagaaataaatcgaagttccttatatagaaaaccattgaagaccaatcagttctccactctccaggctgcatccagatgtccaatattttactaaatcgaaaagaccataaaagaaccattatgcagaaatttttttatttaagtttatgccctcccattcatatttacatgacatttaggccactgcacaggaagtaaggtatcaactcatatgatcacactaccattgctaatttcttcaacagttcattgtgcatggttaaaagtcttttggaatagattagcaatacaccgcagagtgaaaagaggacctccccagatggcatgcatattgtctcaatagtcaatggaagtccgtaaagtatttaacatgagtaagggtaacagggcatgctctcaagcattctccttgaaaatgtagaacctcatattgttaagcaaaagaaaaaatacacttggcaatactttattgctgatctgaaggggtacaaaattcgcatcctaccatcaagccctagagagaatcatgtgaccagtcacatgcatatacacggtgatgtacccaccccacgggtcacacacatatggatatactatatttcgaggtgaggccactgtcattggttcaaacatttgtaggagtaaatatatactatgtccgttccaaaatatataagggattttggcgatgcatatatttcgggatggaggtagtaatagtatataagaagaaaattcatctgaaaagctgttccagcttaggggtgaatcatgacaccaatgatagacgaaatctaagtatttaaattcagtcttcaatcatgttgaaaacttgttattgttccgggcggagcctgacgttggtcaggcctagagctgagcaatgtgcccttggccagccatgaaaaatcgatcaactatgtgataaaacatatttagatactttgtaaccagatttccatgttgaacttttcaacattagtgatgatatgatattgtctagtaaatttactgacatggatttgtagaatatcgattactttatgatttagtcattaattaacttttgtgctacttttgtcttgatatcatatttcattttgaccaggcagctattcgaagagcaacagtagcacgcaagtttataccagtttacatgggaagtgcattcaaaaataaggtttttttctgttgttcctcatattttttatttaactattgttcatcctgccattgaaaatggaatattgtaataccttttgtagtaatagaagtcggttcttaagctgagttgaattcctaatgatgtttaaacataatataatagtgtgtacagcttcatattgcccagtgattttccaatgtaatagcaatcatgggaatgggaaaactaacaactgtgagattttctttaaattagttgctggatgtttcagaatttgcatgagcttacattctgactggtttcgcagggtgtccagccgcttcttgatggtgtgcttgactatttaccttgtccaatggaagttgaaagctacgcacttgatcaaaacaaatcagaagagaaggtagcacaaaatcaagatatatttaataggcaactgtggtgcaa

SEQ ID NO: 41317 - DNA, 12129 bp, Oryza sativa
attcctgcagcccatttattatagtctctctcaaaacatatctcagtagctattcttttctatttccattgcatttaaaggtgggtcgcatggcaatttaaactcatctttctcttgatttagtactcttcttaatccttgtgcccactcaaaatatgccttacattttgaaactgagggattacagttgccattatttgtaacaattaagttattcttttacacttaaagttacttttagctttcgcagtgaattattcttgtctcgatgtcaggtcttattggctggaactcctgctgagccacttgtggcattagcatttaagctggaggaaggtcggtttggtcaattgacatatctaaggtatctgacaactacagactaacctttttgcagtatcatgcgctttactctgaagtagagtacattgctttgactttatttctgaactaacctttccttcatgttgttgtcgttctagaatctatgatggggttataaggaagggtgatttcatttacaatgtgaatacagggaagaagattaaggtaagatttaattcttagctcaagcaaggcagttgaagcagttggttcaaattgtcgttagcagggatttttaataataaatcataccactatgtccaattttatttaggatctctaagcaactatagattgaatatgttgtgaagacaacaagagggatttattgtgatagaagagtaccaattactggtttaattatgtgccagagcatttttttctttataagagcaaagaatgcacacaatctattatagctatgattactatggaggtgactagcatagttctttgtgatgaatttcaaacaatataacagtatgttctgtttggccaactcaaatatctttttttttttttgttgggggggggtggggttgggtgggggttgacatggagaagaatggagttttatacctattttcaagtttgaattcctacgtattaggatgtctttttcagctatctaaacctaaaaaaatgatttggacatttatgtggtgcttatttagacattaatagcttaattggtgcttgtttgagttcaaatttgttgccttatgctttaaacttatgaacttgaaaatttgtttttacctttccaatgttggaatttaactttcgacttaatcttctagcctgctatgtaaaatatttacttgttcttttatattttattttataacaatttaaaactaatatatgaatgtttaaagttattgcttgtttttggtgattttgttgaaacattaatgctgatattttttaattaaattatatttttaatattgaaagcttgtaatttgtttgaaatgttcatggtaaataaaattttaaatatccattattgaaaattacctatttaggaaaattcttttttttttacttagaaatgtgagcatttatgttgattctagcttttctataaccctaatgttttatataactgtgtgatatgcatggcatttcaaataatatgaaatcattggtaaaacgtagcaattatgccaggaatacattagatgctcagttagagttaaaacttgtgccattatgtttttctaggttcctcgcttggtaaggatgcactccaatgagatggaggtaagttgcaccagatgttgtaaccaaaataattactaagtattagtttgatctgatcattggagttgattgtttcctttataagcaaatccacccctaggctaatatcttctttattctgtggtcaatataggatattcaagaagcacatgctggtcaaattgttgctgtctttggtgttgattgtgcgtcaggtaaatttttgagtgaagtgtagggccacaggctattcaagaagtacctctgtccactatactaccatgtgctcttcgattttctgttgacattttcggatttgttctgtgttggtctgattatttgttctcgcatcaataggtgatacatttacagatggatcagtgaaatataccatgacttccatgaatgtccctgaacctgtgatgtccttggctgtctcccctatatctaaagattctggaggacaagtatctacttttctattttcaagaatgctatattaactttaataccatacatgtgacaaataattaattaaaataacatttcagttttcaaaggctctgaatcgtttccagaaagaggatcctactttccgtgtaggtctggatccagaaagtggagaggtttgttttgttatctgttgtatttttctaaatctatcatttgtgaactttaaagtgtaaattttgatcgcagacaattatttctgggatgggtgagctgcatttggatatctatgttgaacgcatcaggagagagtacaaggtaatgtatacttaggtcaatggcatgattcgttcccctggctatatgtgcaatgcaatttaggattgatggatgtttattgtactaaaagcttgtctgtgtaaggctatattaccagtgtttgatgaaatcctccttttacagccaaactagtccattcttttgtgagataatatgtcaatatcatgcctaactggccgtggatttgccagttaaggaagcacatatcatgatatgccaattaaggaggtagataatctctgaccaacacaataggaagaatatgtaaaacagccatagttatcctgaccaatcacaaaagatcatttgctacctgtttggtgtgtttttgtgtgggggaatcatatagctacccagcaaacctattctcaaaatcaagagatctcagagctggatgttacattcaattgttaataatactatcgtattatttttggtttggtttatccctgtattgtcctagacatgaagttgcgttaatggttttattgaccttttccaatttttgaggtgctattttgattaataatttccaaacttaagtgcactgcaatacatggttgttaaggcggtaaggcgacctgaggcgacccacccacgccttaccgctatagcggtaaagcgctaaggcatggctactccttaatctacgtgattagcagcgattagaagagggagataaagaaaattagcctagcaggccagcccacaaaagctcattaaccttcataccatcccatggtgaaggaaacaaccctaatgcctgcagcaggtgtgtctctcctctcacagcgctgcctccaatgtcgcttcttcctcacgtggtcacgcctgtacatctcttcttcctcgtgctagctctgctctatatgtgctcctttctcccctgattcagaacgaatccaggtatgcttctatttgtatgtgccccttcccttgatagatctgacactgctcccttgagtcaaaatgaatctggcacaggagagagaggaagagagtggaaaccagagctgaggagtaagatggcaatgacatggagcagagaacagggaaaagggtatagttggtgctgccttcacctctctctttctctctctctgggttatggccttaagcccttaaggcggagggacaccttaacccctcggcacgccctagcgctatagggacgccatagcgacgctatagcaacaccttaacaaccatgctacaatattaatgaaactatagtctttcatgtggtgtatctagactatttacatactgttggtgaaattttaaaattgattacatggactacaaatcctttgagaaagaacagagggagcatttgaggtcccgtttgatttagattattgagtggattattgctgtggattatctacttgattatagggacaaattacatattgtaagcaataaacttaacagatatcttaaaacaagtggtctaagtagtacagcagaagaaagttttttgagaaaacatattttccgaagcttggagcaaataacccatttcaataatccggtgaataatctgaaaagatcagtagttggtccgcattttggttcacattaattattggcctgaattcttgataccgatgaggttccttgctcagatggccaatagggaactggcagtaggttaaatatacaaaatatattttacactagtttggtgaaatatcatggtgtttggtttgagttaacagatggaaagtggggcatcgttatccaatcctctttagtttaagtaatggtgcgagatggtaacatgaccaagccatccctcatggtgacaaggtaagaaactgaaaaactgggctatcctgccaaagctgtagggtgacctcaatatggaccaaatcatcttaggatgggttcactcatatgttcatttatctttgtgatactgtggagtgagcactaaatagcagaactcagataaatttctctgcactgcctgatgcctgattgagccactgttatatgattgtatgcctactgtttttatcaattgaaccacatccctatgttgaaagttaagatcatcttaaatcctgtatggctactgaaactttcaacaaatctaagtctccttctacatgtgtaggttgatgcaaaggtcggaaaacctcgtgtgaacttcagggaaactatcactcagcgtgctgaatttgattacttacacaaaaagcaatctggtggtcaaggtcaatatggacgagtttgcgggtgagctcttataaaccttgttactaataacaatttaattctcggtttaatttgtgggtgcatcttcaacttattcgcttcaaaaatattaactggcttctaatacatatataggttataatgttatatagggagatatgtatttcataaacatgataatttggaaatgtttagtgagaaaatctacttcttaccacttcatttgataaacactctctagctgagcagtttaccattcctatgattcccacttgtatgatgagtattgcatggtgaaaacagtacacatgaagtgcaccatggttggagcactgcacctaggcaatcaattacactgagcaaatgtcaaatgcattgcaaatccatctagattgtagtgttattattgccggattctgaaaaacagtaaaaaaaaatcattttagctgtcagctgcttatcgtagacggtatatttgatcaatggtttagtagtcacttaatttgattggaaggagtggacttaaattcataatttagcagtcacacttcaccaaaactgttgcaatgcccatatgtcacttatatttgattggaaggagtaaaatgtgtttttacttctgttagccattgttttgctgtcttgtatcatttggctgcaacttgtaaccatctacacatggttcatctgcacctggggttctttcaattgggctcctaggcaatccttttttctcatggtaatactcaatactggtttagttgcacatggccttggtttaatcttctatccatatgtgcttcattttcctttgagcacgtgactctttggttttattttattgagtgtttgaaatagcatctccgattttggttctgaccatgttcagtgcattgacttatatatgcttttattatttctttcattttctgctatgggtccatctttggtatcaatttctttatttttcaattcgtgcatgaaatcaaaagcctggattgggcatttcatatttgcgcataaccatataataggtgttagttgttccttatcatattaggcacttgatgatgccgcagtggacaaaatacaaatgcttgtgcccctagagttaattaaattggtgatggtacttcctttccttgcattacatgtttattttgttggtcataaatactaaaattttactttctctggaagggtatcatgatgtatgtgtaaaatacatcttacaaaagctatgtgcgtgtatcttgaatacactggtgcacgaaagaaggtttagatccgccaaactccgttagaaaatcaaaatcttctggtttactttagtccttttgcttatgccatgctatcctaagttcctaacagttgttatctggatacatttatcgattattctactgaagtttgttggagctatcaattgtcttcacaataagcaacaatatgcaggtacattgagcctcttccatcagaatctgatggtaaatttgagtttgataacatgatcattggacaagcaattccttcaaacttcataccagcaattgagaagggttttaaggaagcttgcaattcgtgagtccatgtctcccatcacgtgttaaaagtctattttgtttgcagagtgataacttgtgtttgtgtttccattctatgcactgcagtggttcgttgatagggcatcctgtggaaaatattcgaattgtgctgactgatggtgcttcacatgcagtggattccagcgaacttgcttttaagttagcttctatctatgcttttagacaggtgagacttgttatatttgtacaatcagcattctttcaagtaaacagtgacattagagtgatgaaaatacaaatcttataaattgatttgctccttttgtctctccttttgccagtgttatgctgctgctagacctgtaatattggaaccagtgatgaaagtggaactaaaagttcctacagagttccagggcacggtaaccggtgacatgaacaagtgagtgtttgatcgtaactttgcttctactgaaatgtatggttacacactcttaatcagtttcatgtgaagtgttccttttgggttcaagttaatattttcctgccattcactggaaagacagtctgttatagtgccattagctgtgatgctggcatgttgagcatagcaccgtatgcaattgacagtttgataccgatgatggtttttagcaaaatgttactttttcctcatctattatgaaaatttccttttagcaacttgtttgtcaagttataactatgcctactaagtctaagtctaatattgttttcttcatgtggaaaacaggagaaagggtatcattgttggaaatgatcaggaaggcgacgacacagttgtggtttgccatgtatgtaaaagccttggtccatatgatttaatcttgaaaatatagtgcttcatatgttatttgctagtaagatagaatgtctaggagtttcttatcgaattttatggttaacattcatcactagtaagatgataagccatattaacaacattagtggatcctacggctcttgaagagaaatacgtttcaaaatgtcatcctttgttttatatgctcaagatgtctgggaataatcctgcaactatttcaaaggtgttacatttcacaggtcacacctatttgtgttgaaaattgtccttttgtgattcctcgttctttatctagtacccggttgcaatttgtttgatatagtgtggtacttgttgtacaagtatcaaaattccttacaagatttattaacataaaaaaagttgggctgctaagaatgtggcacaaaccatagggcattatttgtcctgtatgaaaatttgcagcaagattgtccatggatagtcacctgtgccttgtaatgttgattgttataggtgatctttctatggcttgcgcaagatttgtaagaaaaacaattgaagaaatcagaataacattgcgccattgcagaactaaccacaacactacagaacttgaagtgcctttgtaatgggtaaatatggtgggctggtagcatagatattgtattaatctactcttaagaacggctagttttgcacaaaaaaagaggttcactttctacttcttcttttattgtgcaaaagtaacttcactagttcggtgatttgttcctattcaaccctacattatcacctgatgtgtacttatagacaaggaataaacgttttccatagtttgtaacatagttactgtgagaagtaccattctcattttttgttgagtttaataataaactaacgaatcacatctcgctctctttcaggttccactaaacaatatgtttggatattcaacagctcttcggtcaatgacacaggtcaaatgttattcttctatactttgtctatcttttattttattgacttatatatacccagaaaatgctctttgttttagtcagtcaaactactctgtgatagattgatagtcagcagaaatatccaattatcatctgggcagcaatggctatgattttcaaaaagagtgaaaaattgctaccagagtgaaaaattgtcccctgtatttaatagtagtgcatcattgctagtgcatcattgctgtactccaaaaataaatagacatactgcatgtgatatgttggccaaagtacatgctctgttgatgaatttctgctcttccatatagttattggtgttccaaagtacttataagtatgttcaaaagtatctactcttggtaacagaaacatgtcctgaactatgggcagttaaaactcaattcattatcgaacatataagttaggaactgatacatgaaaatagtttccttatattgaaaacatatcgttttggacataattctaagtcaaaatttgaaactttgaacatttataccttttgcacttttagttggattgaatggatgagaatcatatctatagatttgtttcggaaaaatactctcataatatttttatttcatcggattatgtgaatatgttgcaatagaaattagtggccaaagttgtattttgagaaccatgtcaaatgtttaaaacaacatgcttccaaagccagatattgtataagttatgaaaccatgtcaatgtttaaaacaacatgcttccaaaaccagatattgtataagttatgaaataatactttataatgctaaatctattctgattttattttaaataaatcaaggtagtggtttagatgacatacttttttttttactcgagagagtacgagtgcctgaaaatagggagaaccgatgagggatattttgcgtatttaatttattagttattgttgtgtcctgcaggggaaaagtgaattttcgatggagtatctggagcacaataccgtatcgcaggatgtacagatgcaactagtgaatacgtacaaggccagcaggggcacagagtaatacagaaaaaaaagaaacagtcacttagttaacgttgcattttgtggcccttaatgatgctaggacatcactagtagagtgattcttctagattacataaacaaattttggtttcactttgtatgttaacattgtattttacggccccccgttgtgatgagccatgacatcactaataggtttatacatgggtttctcgatacgacgatagaattgtgatacaataatctgcactccttatacgcaaacgtacgtgatgatcgaattagagcaagttctgtttggacaatgaaaatttcgttatttcttcaagaaatttctggttttgtgatttgttgtccagttttcttgtggttaccagggaagttgtctaactggccctggctccaaaaggtctttgccaatctaatcctgcttgcaaacaaccatgcgcatcatcaaagccaacagcttatggggtgtaggcggcatcatcaaagccaacagcttatggggtgtaggcgctgaagtattattatctgcgggaaaattcccgacgtgccctgtgtttttacctagagaaattcttttcatgtccttttgcctcatcacacacgtgtcactgagttttgattcactccgtactcattccacgtcttcgtttccttctgttggagggagattactagcagaggtgaaactagaaagtttattaatacatgattaattaaatatcaactattataaatttgagaaatagatttatttgaatttttgaaataacacttctactccctccgttacataatataagggattttagagagatgtgacatcatatttaaacgaatctagatagagagcatgtttagatacattgtactaggatatgtcacatctctctaaaatctcttatattataggacggagggagtatatagaagacttatgaaatagcttaccatttaactatttgaaaaatgtgctaaggaaaattgggaagttgaagtttggagttggaaaaaaaaacagggctgagcgtagagcaatttgacatatttggacatatgactatgagagtaaagctcacgaggggttgggtgaagatttgacgataattgtgacgagtggctttcaatgtgctccacacttttcgtcaccaggctcctatcctcattctttgatctcgtcttctcccttttttggccgtatctagtggcaattggagtgtagccatcacatctagcagtgccttacgatttgatggtggagacactatagcgacaacggtgattggcgctataggcggagcaagcgacgactacaaggtcaatgagacaccgtccgtttttttctctttccttttatttatttttttcttcatcgattattttcttcctataaagatttagagtgaatttcataaaactacagtactatgcaccatatatcacaaaactacatatttagtgtcttcgtttatcacaaaactacagtactttgcacaatatattacaaaactatagatttaaaatcttgtttcaaaaaactatagatttaatatcttcatttatcatactacagttttagtgtcctcattatcacaaaactacaggttttagcaatgttaaaatctgtagttttgtgataaatgaagatactaaggctccgttctaaagtgcagacttggctgggctgagctgaattggtagcagtctgaatagtaggtagtagcacattaacctgccactttagaacggggcctaaatgtgtagttctaggataaacgaatacactaaatttataggtttgtgaaacaaattcttaaatatgtagttttgtgatagattatataaagtatctatagttttgtgataaacgaagacactaaatctgtagttacatgaaacaatctcttaaatctatagttttgtgataaattatgctaaatacatgtagtttcgtgaaatttactcagatatttttgcaaggatatacatatccttgaatgtacacatgaaaataacctaggacacgtgaaaaatgaaaaaaaatcaagggtaaactggatcttcatttccaaaaaccaaagacaaaagaaaaattatgattcaagacggaggcaagaacataattgtccctcgataaataaatatatagtatttcgatcaatagtttctgggacaactaagccatctacacgtggcctctagagcatagtaaaaaaaccggaccggaggtcgacccgctctggtcgttgattcaccggtcgaaccgctgttttttatttattaatattatatttgatttgttttattttaaatattgaatcatcacaaattggtgaaaatatgcataaataaactagtatatctattattatatggccacaacataaaaaaaaaataaatgtagtgtggtaacataattaaaaaccggtttgattcttaaaaaccgctaccggttcactggttcacataaaaaccgtccggttcatggttttttaccggttcaattgtagggcggtctttttgttgaaccaagccgccaaggtcgctgtttccggtcttttctggatcaaccgccagcctggtctagtttttttgtactatgctacagagatgaagctcatgaaggtgaatgggccattagagtttccgttgtatcttacttctttcgtccaaaaaaaccaacatagtacttgaatgggacataatctattaatctggactagattatgtcccatccaaatactatgtttaaattttctttaggtccgagggattacactggaagcagacgtcagcaaccgactagccaccgcctatttaagctgtctcccctccctcctccctccgctgcccccctggtttccgtcccctcttcctcctactccacgaccacgcccaaacacacgcttttatcaaaccttctagatccgcgccttctgtaccactggaggtagatgtttctcctcaccttaatttcgagtttcacctctcctgcctgtgattcgagcgctcccatttcctgtctgcctatgagga

SEQ ID NO: 41318 - DNA, 1766 bp, Oryza sativa
aatttgacattactttgcattaatacaaatataaaattatatacataacacaaaataaaatatcaaagaaatgtgggggtaagataagatatgtggacattaaatagagtgataacttttgtgactgtatgtctgatgtactattaacaataaatatttgcatgccaaaagggatcaaatacactcaccacaatgcatcttatcaagaaacatgtgaagcaaattgctgtcacagtcccaacctgaaacaattaaacatacacagagttagcatgcacttgaacaaggtcagtcatacatctaaatctacaaacatttttctcatcagcattcattataatgtacaatgtttcagcattcaagttaaatgttgaagtttcacatggtttcagtgtttgtaaatgaaaaattctatgtttcagaattcaagtagaactaatctttcacgaacatagtacacaaagcaagagtacagaatctatcttcaacaacaactttaataaacaggagagcaaatgtgcatatattgcatgctaaaaataagtgtaacgacctcatagagcttctttctgcggccctttgattcaatcggaaaacgcctcagcatgaaaaatagcctaaacaaaagaaaaatatatacatatatcatcaaaatgaacaacttattgaaaggaaaaatgcaatatcaattgaacaaaataccttccaccataaattaagaatcccaaaagagctaagaatgagacaactgcaaatgaagaaagaataatcagcgagctatacagctgacaaaatgattagacaacttatcgaacagaggaaaggacagaacatacctgatataaaaattttgctcacaggctctagcagaggactatcatttgtcccaaggtatatccaaatacaaacctgcacaaatattccattagatatgttttacggttacagaatgatcaaccaagcaacaactcagatacattaaatacgcaggatacaagatgaatgcaattgactgtgcatattactttcatggttaacttagtagaacaattatcatggaaaaatcatatgaagaatataagtacctccgtccaaaataactgcagttttaggagtggggtaaattaagagggagggaaaatgacccaggtaccccctattgaatgggggatggttgggatttgggagtgaagagtagttgagggcaagatagagagaaatttgaatgagagatgactggtggaacaagtagtactatagaattgcgcttattgtgggacagaggtagtacaataatttgagtatgtaagcaccaacctggattacatatataacaccattaactgccatgtatataatccttagcttgtcagtgggaagattcttagcctattagatatataaacaaattaacaaataagtaaaaaaacacaatcatttcatggattaaaaattaaaaggaacatgaaactataaaagacatagttaaaacctgatggtatatttctgcccagaacagcacaagtagcgtgtatgtcgagaaaaatagaagaccaggaagatccaataacaccaaagtatacacctatttaaacataaagagttctgatgagcaatccagctagaacacaaacattaaaaattaggaaatccattgaaaagtccacaaacaaagctaggtgtcgtgagtagaaatataatttacacaagagtgttagtccaaaatcaattcatatactatatattataatagggctgcaggaatt

SEQ ID NO: 41319 - DNA, 2202 bp, Oryza sativa
ccatattttctcctcttaggtagacagaaaaaaaagataaaaattctaaggtagagaggagaaaatatgttttctacttatatttttttctatgtgactgacacgtgggtccaactaacacgtatgaactatcgtggcatgccacatcagcgcatggaaggggttggagctcatttgaacctatatgacaccccaaaacaagttcgaggacacgaaaatgcattttgagagtttagggacctagatgacacacccgcacaagtttagagaccgctcgtgcacttcactctttagaaaacattagtgcaaaaaaatgtaactataggaagatagcaatagcagtctcctcacttttcagtaagtgtaggatctctttgaaatgaaaaagccatctgcttagatcacatgaaatgtatactccacaagacagcataaacattttcattgaaccaactgaactcaaaaggattaagaaatggaaaaaccatctgcctttatctcacgaaacatatacatattcacttaaccaactattatctcacgaaacatatacatattcacctaaccaactaaagtcaaaggaaacttaatgtgtgaccgtgtgagaaaaagagtcctgcacaatgcagtgccatatgagcttcttggactaaaacacgagtgcataacaataccaaagcagtattccctcctagagaagaacaagaataatccaagtcagtggagcgcgcacagtattatgcagcatgaaatgcaaaacataacaacagcaaaacataaaatcccattaatattttcagctggagattaatttattttgcgcccccccacccctccccaaccaaaaaaaaactaataataaactgtttcaagccaacacaatttggccttttgtattttttttttcatttggatgacaaacaacatgaagctgtggtcatgtcacaatactacaaagggacacatagttcatacctcttttcccctcatcttggaattaacatggcaataagtcagttttttttcttggcaattgtcctccaagatctttatttgtattgattaactatttcttttagatacttctaatcaaagaaaaggaaaggttgtgtgcctatggtagcttgaatgtacataaaacatgtttctccacgttattccccaacattcaagtggcatgtgatttaaaacgaaggaggtggaagggcatacaaatgtaagacactatgcacatgtaaaatttgtatgcattgtatccatagcaaaggatttttacagttaattgaaggaatccataaacctttaggttttataaatgatgcttatgcagttgcagtcgaaatgctcaatcaaaacaataggaaactaccatgattccaccattcactaactagaatcacatgctagtgtgaacatacgcataatcgggaggaatattgaactagttccaatctgcaataaggtatatatggtatagcaatataagcttggtgagaaacggccacacacaaacacgaaacgcagtgtaggaaagcaactgtgaatgcatcagaatctaatgacacagataccgcccaaataattaaccaaacgggcatccctacccgtaacctgacacatcaaatgtccagatcaagcagtcaaacttatccacaagccccgccatgagatggggattaggcgattcgcccccccgggggggggggggggtagggttacacgaggggggttaccagcgcgacggcggagacgagcgcgtaggcggcggagagggagaagaaggcgccgtcctgccacgccggcgacccgttcacctcctcccaccaaccccgcagcgccagcgccagcgccacggcagccatctccggcgtacccgcgagcgccgtcgccgtcggcagggacggcgaggggaccagcttcctcatctccgatctcccacctctgtctctatcgccgtgtcgtggtgcgggcgtcagcgagagaggcgatagctcctcttcctcctccctcctccgcctcctgggaaggaaagatcgagtcgaggagattaggcaggcggcgtctccgtctcgaaaggcccaatcaactcgctcgcttcttcacttttgctgcctgagagttgagatgtggacgcgctgagacgtggacatgtggggctccgccgcgaccatggcccacatgtccgcggcttattcgcttacc

SEQ ID NO: 41320 - DNA, 1812 bp, Oryza sativa
tctaccacaacctccactcccacgcggatcgtgatctcctctgtgtctctctcccatcgctaatcgcacaccttcccttatctctcttagccaccaagtgttccccttactcttgtccataccaccctcaatctccacctatgcactcgtcttcgcgtcgcccctaatacgcgctgttgcaacacctaaatctgtggcgccgctctcttttgtgccgccctgatccgcgttgctagatcactatcgctgtggccatcgtcgcttgcctcttcgatctcctcggcaccatcataactccgttggtcaacctcgccaatttcctccgcgccgctgacgtcggatcgtcgccattgccatgcctcattgatcccctccgacaacgcgatgtcactgccgcctcctctgtctcaagcgccatcgacgccgatccgtactcacgccaccgcccacggttcaccaccgtcacccacaaatcgctgtcgaaaaaaccttgacatcgtctcaggctccggcaccaccattctcgattgagggccatgtacaagttcatcttcccttcttcctcagccgctcggccccctcccctctaccacgccccgatttcttccgtgtcgaagacagtggtccagtgctcgctctatgtcgatgttgacggtcgttacagaccaacttcaaccatcaatattcctaaaaatgataaagaaccggcactactcgcatgcatatttatttagaaataatctagttccacatgtacttggcaaaaaatttgaatacaatagattaccttataaataaaggagaaatggtggaaaatacaagttcaaccaatcagaggtcgacacatggcatacagatggatggaagggcccacaaacccaattaaacacatgtaaatgggcccaaccactatgtcactggaccaaggacccaccaagaagagccccggatgaaggactaggccagggggaccagccaggggtcgccgagacccagggctagcccacctggccctcaattttcatgtgctggtagttaccaaccttccaaggcggttgtgaccgtttctaccataagaaatcgccatagaagggacacttggtagctcaagagagaagatgctcctttggatgcttagaatctctactccccaagtcttgtccaccactatataaagggcactcttcctctcctccaacacacaccaagaaggaatcaagaagaagaagctctccttagctatttacactttgttctagtgctagtggagttagaattagaatagtttcctagttcttcaagtttttcggagaattcggatattgttctagtagcttatattcctcttgtaagactttattctataatgaaactttcttctttatatagtcttggtcctttacttcatttgcacaattatttgagtaccaactctagtctaggcttgtcttgtattaattatatggctagcttaccagagatatgcaatggtattggcttagtgttcgttcgtatgattgctctatgtcatctgcagagatgtagagtaatatttagtaatgtaagcgcgatgcttagattattgaatatcattaagtggtgctatatgccacggaactgtagaggtaggctgctgatggtgacagctcagtacagatattcctccagtgcgtatatagggctaagaaaggttcatgatgcgagtactcctccatatctataaccaattggatggccatgatagattatcgtaaggaactcggtaatcaggggtggtttctcgatataccaggagagcatagccaggggatt

SEQ ID NO: 41321 - DNA, 707 bp, Oryza sativa
aaactgctttaagtttaactaactttatatgaaaaatagtaatattttcgaccaaagataaatttattataaaaatatatttaattattaatttaataaaactaatttggtaatataaatattactatatttgtctgtaaacttagttaaatttgaaggagtttgactttgaccaaaatcaaaacatcttgtaacctgaaacggaaggagtaattaagttcatttccaggtgaatataattcgtatccgtaaactgtccaaatcaagcatccacacaccaattttatccctttgatgatctgaaagtggcgaagcatattttagggcgccccaaataaactgatatcatcacgctgcatgaagccatgaatcatgtgtggcatactagtatccacctgtgctgtatcgtatgcacaaataaagaaacaatatatacacttaactatcactcaattaaattgatcaaataactccgaagtaaaaaaaaaaggttaaatcagtacaggaaagcaatcgattaatagctcgatgctgatcacacgaaccatatatacctacaaatcaacaacaaaccagctgaagatacattgagaaagttcaactaatttgtggccgtacacaaatagagctctaattaattaaacttacttggctatgaatatcctttttcttctaataattaatcttatatccaccacacattattc

SEQ ID NO: 41322 - DNA, 1181 bp, Oryza sativa
cctgcaccccatgggcaggatataacaaaatgtttcttcgaggatgcgtgtccacatttggcattctaggatttgttacctcgtctcacaaatttgcatcgttttgccgtttcaatctgtgatggtgagaaatatttgtcttcggattgaaattgtaaatttgtttagccagcttttttattcactaaatggaattccaagttaattcatactcctagccaacataaattgtgaaattagtttcagttccataagacagtgagtaccacacaaaatgagaattcgaaccaatgctgcatacctgtgaacccaatgagtaacattgttccactcaaccgacccatcacctcatgtcctcctccttgatgatccttatgtgccaatccaccaattgttgatagctgctgatgcattgctcctggtttcttctttcttgtgtgtattggtgtgttcatgttaatcttagtgattttcctaaactatgttagatgatgcagaggagagctctaggtggaggatgttgctcaggagctgccgtgtttctttctttggcctaatccggtagcatgtgatttgtccttccatattaatagtatctgtgtagaatggtacaagtgtgataaatacttgactgtgtactagcactcagacttgtgaattgttttattgttaaaaatcatgtgcccctgatctgatacagtcttagcagaggctaagaaagggttcttacttgtcaccgacaagaagaatggatactccttcctctacccatttggatgacaggtaataaacagtcattgctaaagggtcacatgatgtaaggttgcatctcatttccttcattttattttgagtttataactacccatgaagtggtttgttcaagggtaagataaggtgtacgaatcgtacagcctttggaaagtgtgagcgtcaacacaattacgaccagcaagaaagacatcagtgagcttggtcctccaaatcaattttattttttatcttctattcgtcaaacatttggtcatgtcgctgcagttgtatggtgagaaggtataaaatctgatccactataatgtgttatttaggttgttggagctcttatacgaaaggttctggccgcatctacacaaaagacagttaattgaagcaaaaaaggtgccttttttatcacattattc

SEQ ID NO: 41323 - DNA, 2325 bp, Oryza sativa
cctttccttgtttgttttttcgtttcaggaggtccaactgatgaggttcgatggtgaatgtggggaacatagatcggttgtactgatatcttcctaacgtcggcgctgatccttcaatttacatgtactggtgagattaagaaaatatgtaaatgatccatctagggatggcaatttccccattggggccagggatccggcagggacccgcccccacgggggcgggggagaattctcacccatgggtgagtggggacggggccccgcaaacttccggggatgggggcggggatcggaattaacccgcaggtgacccggaggggccccggaggtgagttacttctctaaaagtagctcattgcaataatataaacccaacaaacccattcaaaattgacatataaaagctcaacaccctagttcccctcaaccataatccttcaaccaacccacacaaccgggggctattgaaattttatcataatattatttagtgtattgcaatatttttatgaagtattagctccatccggtgatgcggggccccggtcacccgccgggtcccatgtggggatggggacgggtgatgttttcacccgacttcctttgcggggccagggccagggatacccgcataagggcggggacgggggcattccgatccaacccggccctgccccgccctgttgccaccgctagatccatcgaataagcgatgttgattagaaggtcatttgttgagagtgagaagatctatactggccaaatgtctaggttttatggctcaaataatgcatgtatatatatatatatatatatatatatatatatatatatatatatatatatatatatatataactggtgctacatagagtatgggctccaagattcaaattgagtatatatccaatttgaatgagtatgaattttttttaaatgtttagatatgaacgttaacttctttactaacaagttcaaacaagtttgaactgagtttgaactttttttttgttagattttggttctaggtatataacatccaaacatataattcgttaggtatgcaataatgaattatgaaataaagttgagtttgagttgttttgttgttaggtatttgtatgaatcaaattcatatacctagatatctacttacaatttgtaaatttttaaaaatttgagagaatttgtgtgttttataccttggagcccgggcaccatggagtgccatatgggtatcctatatatatatatatatatatatatatatatatatatatacacccggggtgtagaatagctattctataccccctccttaccaaggcccaaaacccacctcccacctcggtcaaaggcccctcccaccggtgaaacccgcctactaactccccccaccacccacctcttctcagctctcgtctcaggacgatgcagtaacacgacgaccactgtgcaataacactgtgtcttacgtgtagtaacagcgttaaaatatagttgaaatacagtcatgacgtatctacttttgataagctctttttttctagcatcatggtacaaacggttttaaaaaacgttacatcacttgggagatattgttcttcaaagcttgacttttttgcaatttgtctccacaagtagtaatactatactattactattacttgttactacttgtctgttgtacgttaccacaatcgcatcatgatgttactacactgtgttttactatattttttgagtagtgttactgcataaacacgtggtagcgtgtaccttccgtgcagtaacacttttacttttatgcagtaacaagtatatggttatcatatgagacttttaacctatatatttttgtttaaattcatgatttactgtaattcaccacaatattactgtcaaaagtgcagtaacgtcatatacatgcagtaacactatattggagggaggagaccgattttcttgaaagagggaggaagaacggtttcttgaagaggggagtatatagatgcattttgaagtttaaccctccacatgcagtaacactatagcatcatggtgggaacgattttaaaaaataatacatatcttgtgagatgttgcttttcaaatattggcattttgaactttaaccctccacatgcagtaacagaatgtgtaacttgcagtaacaaaggcatacacatgcagtaccatggttttaccaaatgtataaaattgtttaaacaactcctacatcaatcagacctcgctcaaagccacctacagactttacctgtagcccacctattcgatcttcatctcgtaaaaatgacatag

SEQ ID NO: 41324 - DNA, 12905 bp, Oryza sativa
tcgctccaggctcatggctagagaggagacttgcttagtccaacctgtcccattcactctccaatctcaatccttttttttccggatctaggggcagccggcagcctcatcggccaccggggcgacaacgtctccctacaccggcgacgtggcttgctccgagagagtgagcctaggcggcagctcgtgaacggagacggcgcaccgccggatctgactcctcacccgtgttgcgatgggcgacgccggcatcaacagaatgcgcagaggaagcctatcctgatcgtcggcgtcaccttcctccgacgcagccccgcacggtcgtcggcgtgcacatccgcgcattgcccctccaaatgggacaagtcccccaccgagccctgctcttgattggacgccgacaactgctcatggctgagctgggattggagctcctaccgcctctgtctctagtctccgccgccaggacccatccagtccatgcccgccttcatctgtgccatccacatccacctcctcgccaccggcgttgtttcctgcttgggagagaaaggggcatctggtctgctcgcagcgctggagcgatagggatgctcacggtgctgagaccggcgccgtcgcctcctcgctcatcaccgcgttgactaggtctgccttgctcatcttcttctctgtttgggaacagaggaagacagctccacagccgctggttttgctttctcgatctgaacgccactgagagccatctatgccttcgttcttcccgtgtgtatacatgtgattcaacacagtggagtaaaaaattttattacgtgtaaccctttttatacatgtgatgtgattcactatacatgtagactgaaaaatatgtaatgcaaaccacatatacaataaaagcctggaaactgttattgaatcgaaaaatagatatatgagattcgtccacgtcactatgagtaaaagtttaactgccaataaaaattttactcatgagtaaatttgcgagtaaaatttttactcatgataacatagacaaatcttaaatgtctatttttcaagctaatagtagtttttagatttccactacacatataatttacaccacatattttccctcctataacagttgacagtggagtaaaaacataactactgtttttaatggttcaattctatcatactacgtcgtggtcaatagacctctctgtactcatgtctatcagtaaaaaaataactattgatatttcatctgtgtaagtttttgacccggtgagattttgatttttaatagtaataaagtccgtggtaaaaaaaaactgctatccacgtattgcaataattgaaattttatatacatatattcacttgtatatataatcatgggatatgtgtattttttctcctccttgtatgttatgtagtttcttacccgggagattttttttaatgattgatatggatgagtgaatgtaaaaataatatgcatcataatcttgattgtatgtgttaatatgcacgtaaaaggaacatgatactcgtattttaatgactgaacatttttacacacatttttcaatatggaatgattaagcaaatttattactaacaaaaataactacaaaaattgatgtaataaaaatattactgcaaacaaattgagagtaatgcaaaagatttacaggagtgaaaaatttactatactcctactattatcgagccctgactttgctcagtaattacgggagtaaaaattttactccatgcaaagatagacatgatttttttactctagtaacttttttactcagtaattttttttacttatggtgggaaccgatattgaaggccacgtggagacaagaagaaggaagtactttggcacgtcagcgaggaaaaaccaaaaaaaccggaaatgcggtgctctgtgaggtagccggtaattttttaactcgagataggagaggggtgggaacaaaacagaggaaagagataggaggtggactagtagaaaacgcaaaaccaagaggaggagcgctactaattccgtagcgcgtctgtggcgctgtgtgtgtgtgtatagatagatagatagacagacagacagacagacacatatatacacacacacatatatatatatatatatatatatatatatatatatatatatatatatatatatatatatatatatatatatatcatgatatttgatgtactagtatacattaacatactcactccgtcccataatatatatttcacatccctccaaaatctcttatattatgggacggagggagtatatatgatgcatttatgtcttgtcaagctgataaatcaatcctatcctctgttttaaggacgaacgaatctcaaattaaattgatactaagaaaatacttttattttggaaagaagtctatttgaagtcaagtttattataacacttaattttaaagtgctctaactaatactacatccgtcccaaaatataagcattttctagctatgaatctgaacaactatgtgtctagattcataactaaaagttgctatattttgggacggatgtagtattagttagagcacttaagttagttacatttatttaaggaaaaatagcagccagcaggagcaatatcgagaataccacaacaatatcatctgtcatgtaatcattaaatagagaatttgctatgcctcagcaatttctctcttcatgcacaaaatggcaaaacaagaacttggtaattaaaatggatccattatccatagtgttcagtcatgtcttgctaaaaaaattagaaaggaaagaaatatattactgggactgactactgagtgctagctgcagtttcttcattactggccttccacaggctatttaattatgatcccattttcactagcaagactgctacagcctattataactgtacaaataatatcaggagttcaaaagtacgaccatcactgaagttatacatcaagttttgaagggttcctatccctcaattgttccttcagatgtttgattactctttccaactcaaccttttgggcttctcgagctgcaaacgatttctcaatcatttccctcgtcccaacttccctccttggctggtaaactccatgatctctattcatgtcacttgcatctctttcatgagcatttttcagcaaccaaattttagtaagatagtacagcgtttttgtagaaacttttgtcctgaccaattcagtacttgcatttacaagaatatcagaagaaatgccattgtttcctacaagaaagagataacagggatgcattagcttctgctcaaaaaaacagggatgcattagcaaatatcgtgtaatgtcgtgtaatactggtaactcttctttcatcttaatgaaatttggtcggcgtcattccgccgacccggcaaaaaatagcaaatatcaacttgtatcctgtttgcgttactatacatggtaacacagattaagatatccaaactgttattggaattattatacctgagttctttctgctgatttctatgcaatcttctataagagaacctgctgttgcttgatttgatgttgaatcatcttcattttctttttcagtacctttcaaagatgctaattcatccttgtctgtcttggctctattatctctctctaatgcaaacatgcatgttcccatatcttcagttgattgctgttggggagcagcacccagcaggacagcatcaagctcataaccacaattgcgttccatcataacttcatcacttgtcactagaatgtcttcaggtgttggcagcatgccagctgttgttgcagcttcaatggcttcattactgccagtactagctgcactctcaacgccatgatgtatcattacttgtccagagttgaaattgtttgcctcataggcactggcatggtcttgtgctttctgtttactttgtaggagagatatgtgttgttccattttggtgactgacccacaaaatgattcatcagctgaactatccaagactctcattgaatcagataagtattgctcagcatcttgttgcacaatcatactgttatccttccctctgatgaactctgggacagaatacttcacaacgtctgcgatttgctcttgcctagcacattgtaccataattatattgtttagcctctcaatcagaggaatctcatccagtggatcctccatggtaccaggtaaaggcacactggtgtcaacatgctgctttttgcaagaattagccccagaaagctcttcagtgtttcttttcattggaataaaaagggaatggggttctcttgtgtttgcatagttagaaacatcagtagagcaagccaacgaatatggctcccaccatcgcgcatactccagtgtcaccccaagcttatagtgtggaacaaccaatgcaaactttcgatagccaaacgtatatgttctccatgccaccttccagtttgagttagcgcgagcaatcgtcccaggcacatcctgatcaaagccaaactgccttgcaacacgatgcggatgtattgctcaatgcagcccatgccgacgagctcacattggcgcaaacatcgcgtaaaggataacagcgtattacttgtcattacatcctggacaacccaagtgccagccttagcttccttgggtggcagagcaatgctgcgactcccgtatggcctccactcaaacttgtccggtgacatgaacacgccatgaacaaactgggggtccagcgccttgtggacgccgtgccaccgagcagccattggcacacggcaagcatcagtggttgcagggatggtggtggtcgccatggcagggcggagctgagggaagcgctcccagacccagaggtggagaatgtgcatcggcgccgtcacctggagcgcctcctcctccctgtcgcgcaagtccaagaagcgcttgagcgcggagaggtcgccgtagatgccggcgagcgcggcgggcgcgagcgccacgcggatgccccgcgctagcagggcggcgatggggaacacctgaggcccaaccacgtcgaacggcggtgccgcgaagacgaagagcgacagccacatggccagaaacgccccgtgctcgatcaggtcggcgccggcgctggcggccgtctcgtcgtcctcctcctcctggcgcttaagaaagtactgcacccacccaggataggagggcttcttgtacttgctccggtgcagggcgctccgaacggccatgagcgcgtccacgtccccgacaagagcgtccggcaggcgcgcccgcacgggcttgccaaagagcggcaggccggcgagcacggtcatgtcctccagcgtcaccgtggcctcgccccacgggaacatgaacgtgttggtgtctgcggaccagaacgcggcgagctggagcagcgtgccctcgtcgcggcgtacccggtaagccgtggcgagaatggcatccaagatgccaacactccgccacaggggctcgtggcgcgggcggagcctgtcgacccactgcctccacaggccaggggagccagcccagcccttgaactccaccacccggaggaggccgtggtggtcaggaacggggccgccactgcagagcggggaggagggcaggggcgggggccggccaccggcggccgcgcgggggaggaggaagtgggccgatcggacggcggggcgggaagggtcgccgtcggagacgatcgggacggtggattcttggaccaggagctcttcggtgccggccattgcggctgcggaaaattggtttggttggggttttggtgaagtgtgaggaggaaggaaccgaggaggaggaaaggaaaatggggggcggatgtgtgtgactgtgtgagtggggactactgctagtactcctgtcctagtgtggacaagtgcgagattgtaggtacttcgtctcaactctcaagccattattgatgtgagcttccttaaatgggtattgctagtaacaaaaattactttatatatttgagtggtacttgttgccttgtactcctagggcttttctgttccgtatgagaaaagacatttatcgaatagccagctgtcgggtccaaaacatctagtcaatttaatagccaattcatacaatagttacctataaacatatactacacaattaatatctggtcttacctgtcacacatatatcttaaaatccgtgctgcagctggctacaaatatgtagcctgttgcttttctctctcatcttttatcttctcgaaatatgtttatagctagcttatattccgctattgtacctgctctgatatttgtggtcaaagcgtgggtctataccacgtgagactcaacaagagacgttgctggcttgctccttccgttccaaaataatttattttttactcttttcacacatagtaataaaaaaagatagatctgaatcacaccccctaaactattaggtgagtatgaattacccctaaaatccaaaaaccaaatatatttcgccctcaactatcaatacgtggcactctagtcagcattttttttaaaaaagaaggaaaaagtatgaattaccccccttaactataaaagtcgatcgaattacacccttaaaccacaaaaccagacattttcaccccaaactatacaaaccggacaaataacccaccgactcaatccgcggtggttttgatcctacgtagcagtccagtcagcattttttaaaaaatggtgggccccacatgtcagttttcaccctctctgtctctctcttctctctctttccaaatctatctctcttctccctcccctcccctccatccccaccggcagcggcaagctgaggatggcggcacgcagggggcagagccagttgggggtggcaaaggggggccgagggcggcggtggtcggcgacggaggcgaaggccaatcgggagcgcggtgggcggcaagcagcaagctgatggtggcttggctgcgtgcgggcgggtggcgaaatctcgcgcaatcccgtcacaccgtctgggagccgcatgagccggtgagcgccatcgctcgctcgagagcgtcgttgtcttcgagcttctaccgcgcggcgctgtcgcgggctcctcctcctcatcatcaccgccgcaatcggcactgcctcctggttgtgatggaccgcgcgatcaccgcacgccgctgtccaccgcacgtccctatgctcctctacccatcactcgtccccgcgcttcgaccgccagtctttccccgcccgtccccgtgcgccaccgcccaccgcctgtacgccaccacctgcccaagtgcttgcacgagagagagagagagcaactgggaagagagagaccgaggaccgattctccctccctgccgttcccgccaccgctcgcctagctgcgcccgtcgccgctcccgccaccactcgcctagcgcgcccactgccgctcgccgccgaccagttccaatccttgctgcgctgccgccgctcgcccagctgctcatgtccaagttccaacgccaacagcacacacagatagaagtgacttgtgggccctatatttttttttttttgctgattggatttccacgttggtgccacatgtatgccacgttggatcaaaaccgctccagattgagtcagggggggtaatttgtctggtttcaatagtttgaggtttaatatgtctagttttgtggttggggagggggtaatttgtacgatcgcaatagttcggggggtaattcgtattttttccaaaaaagaatcgatgagcctcacctgatagtttcaccctctctcgagcaaaaaaatgtacaactcacactccaactccgatgtgtcttggatcctttgaaaatttttccacccccactttctccctagtcccctctctctctctttctccccttacctccatctctctctttcactaagagggggaacgccaaagagggagtcggacgagcagaggcaatccacggccgccggcgtgcggcttgtcctcggcctccgccgcgagacgacgcagccgctggcgcacctcctctacggtggttgacggggggtggggcggaggcagtcaaggcggtggagggggagctgccatcggcgtcgagggcataggtagtcggggtgacggatggggagctgccgtcatcggcgagggtggaggcaattagggtggcggagggggaggcggcaggcagatgcagaggggggagggcagctttaggcgcagaaggggtagtcgacgacggtggctgacgggggaggggtagaggtagttggtgcggtggagagggagccaccgtcattggcaggggtggaggcagtcgggatgcgaagccggagccgaggacagtgaccaatgggccggggcggtggcagaggcaatcggggcggtggagggggagccaagggcagcggtcgacgggggcgggggtggaggcaactcggggctgccggcacgcggctcttcctcggcctccgcaacgagatgcatgcacccgctggcgtgcctcctccacggcatctgatgagagagagagaggtgtgagaggggaaatagatagtgagaagagaagtatgacaggtggccggtcccattgatttttaataaaagaattgctgactggactgccacataggatcaaaaccgcttgcaaagctgctattgttttcgggtttagggggggtaattcgtactcaccaaaaagtgtaggggctgtaattcggacttttcccataaaaagagaaggaaaagtacgaattcccttgaactatcgtggtcgatcgaattacccctggaactcaaaaaacaaacatttgacacccttagctatacaaactagacaaattaccccctagcactattgtaggcggttttgggatagacttgctggcgtggcatttcagcgtggaaaaaatattttaaaaagtaatgaacccatatgtcagtctttatatctcctctcttttttttgtacctccttcctccatctctatctacagcggcggcggcggcggagagaagccaagggcgggccggccggcgctgtccgcaggggaggtcgagcgccacttctcctcctcctctttatcctcgccgtcctcatcacaccacctgcgcatccgcctctagatctccttgcccccattgtgatcggaggtccacgtcgtctgcgagggggacgtggatgtgttctatgggaggtggtcacgccgtgaccgtccacggcggcgcgcaaatggtgggagcagtgaactccgagagggagccggaatgaggcggagacgaaggatgccgagagggagtgggtggtggtggagggagttggaggaggcggagacggaaacgaaggaggaggggatggaggcaggagggagggaggaggtgcataaggtggcgcgcggggtggtagaggggatgggggagggggagggggagtggaggtggatggggaaggggaggagatggaggcggacaaaaagaagtcgtctgggaggatgatgcggtggcgatggaaggggtggcggcgtcaccatgggggttggagggaagggagatcagacgggggcagctcccacctatgggctgtcggcaacgccgtctggccttcgctccgcctccgggccccccactctggctccctcctggagttcgccgctcccacctccgcgtctcgcgccgccacccaccgcgtgcccgcctttgcccgccgctcgacttgcggtcatgctcgacgacacgagagaaagagagggaagagaagctatgacatgtgggtcccaccactttttttttaaaaaaagaaaatgctaactggattgccatgcacatgccacctgttgacggtggttatcgatcagtttcgaccgtcaatattaccaaaatagaggagaactagtaatgcttgcaatgcatatacatgttagaataataatattccactagtattaggttcactaaccttttgcagagaataaccataaagtggaggagaatcgacatcaactcaaacgataaatcaatcggacgatgtcgagaatcagtcttatgcatgaatgggccaagaactcagaattgacatgatgaattgggccaaaattcacaagtctgtgaaagagagcaaaggaggaggccacctgccgattttgggccaggtcgacccagcccatggtttggccaaaccccccgcagcgccactcgatccagggttctcctggatggctgagatgactccccaatgatggttggtgggtattaccgacctttccaaccgtcgcaaccgtcattctcaagttataaaaagagctctcatcctcacttcactcacacacctcaagcaaagctctctcatattctctcaagtttagtttagtagtattaagctagtggaataggaatagagtagaaatcatgagtccggaagtcttcggaagagttcgggtatggatcttgtcggagatatgggcatgggggtatgtgaagtagaggggaattactttccctccggtcacatgactctgcaggttggccccgctcgcgcgtcacgcgagtcgtggaagcgccggggggggggggggggctcggggcatgacgtcacccctcaggctcttccgcggcttcgccccgaggccctcacccggtcaccacgtggcagagggagagagcaagaggggagcacaggctgaacagccataaatgtgcgatgccccaactgtccctcaccgcatttaatgcggtaagggcagacgtgcggcgtgccttacgaacccttgtccatcggatgtgaccggtctgtgaccggcccgtctccgtcacatccgatggatagggcaatcatgtcctcacgtcgcccttgtccccagtggagtgggggtgggtatgacccgtcacatccgagcgccgctcgaggaagggctgttgcgtgtcattgttcatttatgagggaatgacagggctatcccccgcgtcaggcaggggacggcgccgggttccactcgagaatcggttattgcttagcttcgggagaaggcccggtttaaagcccaaaaagtggagtggggttcccccccggtggagggtaggtagaggcggcacatgtggtatccccttaagctataaaaggaggaccctgcccattgagatagggggacgactcccagaaaacctgagctcgagaggagaaggagcaggtgcgctctctggggggaagaaacccttgtaaaactcatcaataatcccaaacacaggagtagggtgttacgctctatagcggcccaaacctgtataatcccactacgtgcaagcttgccggtaatcttagggacgagcgagtgatttccgagaggcgggcctccgcccccggccgaactcacgaaagggggggtctcacgacctcccgctatcggggggccatccctcgacagctggcgcaccaggtagggggcggttgcgcgttccgagaggaagttgttttcttccgtcccaagtttctccaggccttagccgaccatggtcaaggtcctggaagtagaggaggaggcggtggcatttacccccaccccgtccaggagtggggattccggcgagagccgaggtcctcgtcaccgtcgccatggttctcgaacccctccccgccgcgaaccttcgcggagggaggatcccactcgttcgggtggttcggctctctctccgccccctggcggagggagaccgcgacgcgtcagggcacgccgccgactcgactatggagacggcggttcaccccaaggcgcgcttcaggcagcaggcacccttctacggcatcccccggtaaacccggagccggagactcctgttcagcgctggctggacgacgtggccaacttggtcactgctgcccagcggtagttggctacgggtggccgatccactgccactggtacatcacgtacctcggtcaccctctcctcgtcggcgaggagaagggctcgtcgatcggccacgatctcgaggcggtccacggttccaacatcgtcgggggcctcgggaagccgaaggcatcatgacggcctctacgggacgcaggacgctcgagtaaacatcgagcgacgccgggacgagcgccgagctgcccgtatgggggaaggcgcctcctcatctggagcgccacgctcctcttcacgaggcggccctcctcccacactcacccctggggggacgggttgtagggccttcgtggcgagtctccggaatgtccggtggcccccgaagtttcgccccaaccttacggagaagtatgatggtagcatcaatccctccgagttcctccagatctacaccacggttatcatggcggcagggggtgacgaccgggtcatggcgaattactttcccatggccctcaagggtcaggtgcgtggctgattgatgacccagcccccgactccattcactcctgggaggacctatgccagcagttcatcacgaacttctagggcacgtatccccgcccgggggaagaggcggacctacacgctatacggcggaaggatgacgagtccctccattcgtacatacaatgcttctgtcaggtccgcaacactattccgtgcattccagcccacgcggttgtatatgcattctggaacagcgtgcgacataatcgtatgctggagaagatcgcctccaaggagcccgagaccactgccgagcttttcgggctggcagacaaggtggcccggaaggaggaggcgtgggcctggaactctcccagcaccggtgcggcggccgcggctacccccgagtctgccccccgctctaagcggcgagataggagaggcaaaaggaaaccagcccgctccgatgacgagggccatgtccttgcagcaga

SEQ ID NO: 41325 - DNA, 38132 bp, Oryza sativa
  unsure (1)..(38132): unsure at all n locations
gagtctgccccccgctctaagcggcgagataggagaggcaaaaggaaaccagcccgctccgatgacgagggccatgtccttgcagcagacgggctcacgcaggccccgcgcaaaggaaaggccaccggcgataagccgagcctcaccgttccctatggcgagggccggttggcggacaagtggtgttcggtacacaacacctaccgccacagtctcgccgactgccgctcggtcaggaatttggccgagtggtttcgaaaggctgatgaggagaagcggcagggtcgacgggagggcaaagcccccgcgacctcgaccggcgaccggtgagaggaggccaagaacaaggcccccgccgatgatggcggagacagtgaggatctggatttctagatacctcaggggaccgtcgccacgctcgacgggggggcttgcactcacacctctcgccgaagcttcaaggccatgagacgagagcttctggccactgttcccacgcatgaggtggtccggaaggcgcgctggtcagaggtgaagctcacattcgaccagagcgaccatccgacgatgctcgctcgggggggaaagttggccctggtggtctccccgaccatctacaacgtcaagatgaagcgtgtgctggtggatggcggggccagtctgagcatcatctccccggctgcctttgacgtgctcaaagccccggggatgaagctccagccgtcgctcctaatcattggcgttactccggggcacacatggccgcttggccacgtagagcttccggtgaccttcggtgactccaccaacttccgcaccgagcggattgacttcgatgtggcggatctcaatctgccctacaacgcggttctaggcagacccgcgttggtgaagttcatggccgccacccattacgcctacctccagatgaagatgccgggtcctgctggtcccatcaccatttttggtgatgtcaaggttgccctcgcctgcgcggagcagcgtgcagacaacctggcggtggccacggagccacaggcccccgaggcctctgcgtcccgcgcttccaagaagcacctcacctcggctgacgaggtgcccgtcaaggaaatgccccttggcgacgatccgtccaagaccgccaagattggcggaaccttggacgccaaataggaaggcgcgctcgtctccttcccgcgggcaaattctgacgttttcgcatggaagccgtcagatatgcccggggtccccagggaggtgtcgcgaccgagaaaaatacattttcccgaacgctagtgtattaatccctgtcccaggaaaagccggggtacaccacacaaacatgatataaaagacacatctttattatatcgataatatttgcattattacaaaggcacttaaggcctgacaatcaaaaataaatagcagcggactagcgggcctacgactccatcttcacaggcgctcaactggggtataagccaggactccacctaagacttcttctccaaagcttctcttactgaaggggggggggaagattgagcaagaatgagtacaaccacagtactcagcaagccacaccggcagatgcatgattaatgcaagggggtacaaggggtaataaataggggttaagttttgcagaaaacagcatttaaaagtcacttagttgcccaaatccattttataaagacgatcctagagttacacagtgttatttaatcaaggccgtgaaccctcacgaacctgccttaacccaaggcctacgatgattcagaccgaactgacaacccgaccctaggtcccagctcgtcccaagccaacccaggccaaccattccacattttagttgttaggcaggttttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtaggactaacaaaacccaaccacgcacctcgagcccagcctaaaaccattttaggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaaggtaaataggcatggctaaataaaacagtgataacgtaggaatttaaataacgtgataatgcattaatttaaatcaaaataattttataaactgggattcaatatgctcaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacagggttctttaggttataacaaacattaggagacttgaacggatcgattcggagctcgtatgaccaagatatgatcatccgaagtttaatgctgttacatggagatttgcgtattattgtaattaggttttacaactataaaacatgtgtaagcgctagcctggaaaagacaggaaggctgcgctgttgacatgcggactccacatgccaacctaagggaccacggtggaccgggtacacagagacggtccacgggtcgatggaagcagatcccgtgtgtcaaccaaggcgagtggccgacaaacggactccactagacaccacacgggctgcacacgtggaaaccacgcagctaccgagcgggcacactaacacggtcaccacacgcacaagcgaacgactaccgacaccggtacaggggtaccggggtcgacaaccgcacaacgggcacgggcgacaccgaaaggacgaggacggggcagcgagaggagagatccttaccaccatgcgatgaggcgagggaacgacaacgacgaacgggcgcggcggagacggccgggaacgacggagacgaaaggcgaggggacgacttcggcggcgatccttggacgaaggcgagacgcggccggcacaaggcttgacgacgcggaggcgaggacgaagacgacgacggggctgcagcggcacacttgacggacgcggacgacggacgagaacggcttgacggagggacgaacgccacgacgaccaggaacgacgggaggacgacgacgacgacgacgacgaccggggccggcgaggaggcgacgagggacagctagtagcagctgcacggagacgaggacggcatggaacacaccgctgcgaatccgacgatggaggcggcgccgcgagacgacgagccggcgaggaggaacgatgacgacgacgacgaacaccggcggggttcggtcgaaggggaggcgaggccaagggcgaccttgccactgcgatgccggaggaggagatggcgacgttggccggcgcacgggcacgacggaaggggttgccgaaggaactccggcgaggcggagggcgagaccgacgcgggcgacggcgttccggcgaaaccaagggtaggccggggtggaggtcgacgcggcgacgccgagggaggagacggcgcagccggcccgcacctgagcggtgcggcaggggcggctggaggcagtacagtggcggcaacgccactgttttgccggcgaggacgcgtctccggtgatttccccgcgaaacggaggtctgaccgggggagaggaggcagctgcgaggccgagggcggcgacggcgcgaccggacggcgctcgggcgaggagggagaggcggctggaggccgaccggcgccggagagagaaaaggagaaggcggggagaggtggtgcggccacgggggagctcgggaaggggctaaaacaagagaacgcacggagggggttccattttataggtgaggggagggagccgggcatgggagagggcggaacggcgacgggaaacacggccggcggccatggaaggcggccgggaatggcgcggccgttccgggcgattgggggcgccattcaagggggaaaacgggggaaatcaaagaggaatcaatggggattaattacccctatttaattttggaatcccatgattaaatcgcacggatttgagggaggaaaggagctagggttcacgggagagggaggaggccgtgcgggaggaggaagacgaccggcgcgtgggccccacaaggtcagcgcgcgtgcaacgcgcgtgcggcgcgcgtgagggggggcggctcgggaggctggggcagctgggtggcgtggcttgggccgggcggccggcccaggaggagaagagggagtggcggcctggggaagagagggaggaggagggagctgggccgaggggaaggagaggaggcccaagagaaggagggagaggaggagagggagagaaagagagggaggaagagaggactttggccgtgggccgagagagagagagaactttgggccagaaagggaggaaggaggattatttttagcttttctttttagtaaactttgatcatagttgttgttgcttaataaatatttccggtgctctgaaaattcatgtaaaatttgagggctctttttagaccaaggagaatttaacaaaaattctctggaccacattcgaatttttctggcacgtattttagtgtttgccaatttcttttcgaattttaattaattctattattctttttagaggatgatttttatttcgggatgaatttatcaggacgtgacaggaggtgatcgagcactgccttgccgtgcggccggatgcgcaacctgtccggcagaaggtgcggcatcaagccccggagcggcaggccttcatcagggaggaagtggcgcggctcctggaggctgatttcattcgcgaggtaatccatccggagtggctggcaaacccggtggtcgtcccgaaggccaacggcaagctacggatgtgcatggactacaccgacctcaacaaggcatgccccaaagatcccttccctctgccacgcatagatcaaatagttgactccactgcggggtgcgaacttttgtgttttctagatgcatactctgggtaccatcagattcgtatggctagggaagatgaggaaaaaaccgcctttattactcctgtgggcaccttttgttgcacaactatgccttttgggttgaagaatgcaggccctacttttcagcgcatgactcgtattactttaagtaatcagatagggcgcaatgtagaggcgtatgtcgatgatctagtggtaaagacgcgccaccaggacacgttgctacaagacctggccgaaactttcgatagtcttaggtccacgcgcgtaaagctgaaccccgataagtgtgtgttcggtgtgccggcgggcaaacttctcagttttctagtctcttcccgaggcatagaagcaaatcctgagaagatacgtgcgatagagaggatgcaccccccctagcaagcttagggatgtgcagtgcgtcgctggatgcatggccgccctgagtcgatttatatcgaggctgggtgagagggcgctgcccctattcaagctcctcaagcgctccgggccatttatatggacggaggaagctgagcaagctctcaatcagctgaaagcttacctcacttccccccccatcttggtagccccgtgaccagaggaaccattgctactctacttggccgcgaccccccatatggtgagtgccgccctagtagttgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtattttaaataaatggaattgcatttcatgaataatttaaattgaaaaaggtttttaaaatcctcttttggccttgggccgaaagtcggcccaaaaccttctctctctcttcccggcccaagccggcccagtccgcccgcagcagccgcatgcgcgcgccctcagacgctgacaggtggggcccgcctgtcaggtcttcgtcttcctctggccgcccgccgcccgagccctagcgccgcgccgccgccgtctccttccaaatccggccgcccctttccgtttccgatgaaattaatagaggggaaatgatacccgggatcccctctatcttttctcttatggaatcgtcggctaattcggtttgtaaatccgtggattcgagttcgattcggatcgatctctctcctccgaaccctagaccttccttcgcgtcgccggtcgccgtgggccttcgccgtcgcctccttgcccctagaaaaggacccccaagcccgccgctacccgccgccaccctcgccttcgcctctcgtcgccggtagagccctagcaccgtgcagccgtgcgccgccgtcgctccggtcgtcgtcgctgctcggggaggtcaccgtcgtggtcaccaagtcgtcgccgacctcgtccgccccaccgccgtcgctgtcgaccgccggaacatcgccgtcgtcgtcaagccgaaggtcgccgccgcttcttcctcgacgctgtcaccgtccgttgatcttccgccgttgttttggtcaccggtgagttcgccacgtcgccctctacgtgttggtgtcctccgttcgcgtcgtcgcgccgtcgttcgccagcgagcttgcgcgcccgagccgccgccggtgatgacgtcatcgccgacgtcatcgttgccgtccgttgtagaccggtcgtagaccgttagatcttggccgttcgttgtggataggatcgatctcggccgttcgtttccgtgagccgccgccgtgcacccggtccaccgcgaaccctagccgctgacgcaataaacccctttttccttttaaaaataattcattattacgtcataattcaattaaaatctaaataaataatttaatccgatttaatctttgaaaattcgtaactaattcatcttagctcggatttagttggttcaagtctctaaatttttctaaaattgagatctacatgttaaaaatatccacatgtactgttcatgcttgtttatgtgctgttttggtgttttgcttctttctgtttagattccgacgtttccggagagtccgttttcgtaggagaagaatttgaagagttccaaggccagcaaggcaagtcacatagatcccaaacaaccctttgagcatgttgatcccgtttaaagactattgtttctattcaactattgcatttattttcgaatgtcatggggtggaattaacctattgtttgttatagcccttttgttcttgattactttattccttgatatcttgggttattataaattgactagttgagctttatatattggttcagctagatattagatatgattgcttagccatgcatagaaacattagcacactattgggataacttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcacgagtttcggttgtgaaacattaatcgtgccaaccacaagccagcgtgggcaacggctttaccttttgtatagcatggttcattgcggagcaccagactgagaagtggcggagataagcccacgagggtcgctggggagtccatgccttgtttataagggggtgattatgatccaggaacggtgcactgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattactacttaactattttattaaattctgaaatgtttattaaatgttgtttatgcaaatgaaaccctactatgccatcctttgttatcctatgcacttgcatatttgctgcgtggcttgctgagtatgtcatatactcaccttgcaatcattcattagaggaggagttctacagtgatgctgatggtgtggaggattaggtgtagccctggtcaagctgcctgtggagtggagtcgtctgcgccgtttatcttatttttttttcactgcttagatctttattgattgagaggaactatctgcctatgtaatgacattttattcacttattaattagagtaataattgtactctattatcaatttgttattgtgtgcctcggctgattcctggacgagggttcacacacatgtaagcgtttggaattttggatagaaattccgggcgtgacagtagttgagtgtgaggaaggcgaacaagagggccctccggctcgcgatggcccctcatcccccgaaggtctagcgcccaaagcttccagcccccgggagggccccgaggcccccaagggaggagcgaaggctttggcaagtggccctgagcttgatgatcccgaggcagtccgggatccccccgggaccaccgaacaggtgcgccccgagtcaccagcccctgacagcacgaatcggccccgccgaaaggtgcagcggcccgtctacttcgtcagcgaggcactccgagatgcgaaaacccggtatccgcaggcccagaaaatgctttatgccgtcttgatggcctcgaggaagttgcgtcattacttccaagcgcatcgggtttccgtagtgacgtcataccctcttggccaaattttgtacaaccgagagggtactggacgggtggtaaaatgggccatcgagctggctgagttcgatctgcacttcgaaccgcggcatgcgatcaagagtcaaatcctggctgacttcatcgcggaatggaccccggtggatgaacctgttccatccgatgtccccttctcccctggagaataagaggatccaaacgccgacattcgcggcgggcactggattatgcatttcgacggctccctcaaccttcaaggtgcaggtgccggagtcacgttgacctcgccaaacgaggatgtccttaaatacgttgttcgtctcgacttccaggccacgaacaacatggcagaatatgaagggctcctcgcgggattgagggcggcagccagaatgggcatccgccatctcctggtcttaggtgactctcagttggtcgtaaatcaagtacccaaagaatatcagtgcaccgaccagcaaatggaagcatacgtccgcgaggtacggcgcatggaacgcaacttcgacggacttgagctccggcacgtgccccaacgcgacaacacggttgctgacgagttgtcgcgtgttgcgtcggcacgagccccactccccccggggactttcgaagaaaggcttgcgcaaccatcggcgcgaccgagccctttgagggaccccaacgacgcgcccttcggcccaacccctggcgacccgcgcccctcggggcccgaggaggtcaaccccgacccctctcgtcaggttgtgtggatgaccgacatccgggcgtatctcgacgggaatactcttcctgaggaacgcgcggaagctgaaaagctcgcacgcatctccaagcggtacatcctcgtagagggggccctctaccggcgtgccgcgaacgggatactcttgaagtgcatttctcgggagcagggcatcgagctcatagccgacgcccatcagggtgagtacagagcccattcggcctcacgaactttggtcggaaaagccttccggcaaggtttttattggccgactgcattacaagatgcccaagaatgggtccagcggtgcagggcatgccagttccacgccaagcagacccaccagccggcccaagcattacaagtcattccactatcttggcttttcgcagtctgggggctagacatccttggaccgttcaaggcggctcgaggcgggtatcagcacttgtacgtcgccatcgacaaattcaccaagtggcccgaggcctacccagtcgtcaaaatcgacaagcattctgctcttaagttcatcaggggcatcacgtctcgattcagagtgcccaatcgtgtcattacagacaatggcacccagttcaccagtgagctgtttggcgattactgtgacgacatgggtatcaaattgtgctttgcctcacccgcccaccccaagagcaacggccaagtcgagcgagccaacgccgaaatcctcaaaggactcaagaccaagacgtacaatgtcctgaagaagcacggggattcatggcttgaggagttgcccgccgtgttgtgggcaaatcggaccactccaagccgcgccacgggggaaacaccatttttcttggtgtactgcgccgaagcggtcctaccctccgagctttccctgggttcgcctcgtgtcgcactgtacaacgaggccaaccaagatgaccttcgccgcgacgatctcaattatcttgcagaacggagaaggtgagcggccttccgcgccgcgcgctaccaacaaagcctgcgacgctaccatcaacgccacgtccgggcccgatcactacaagttagcgacctcgtcctacgccacgttcagtcgcgcctagggctgagcaagctctcgccaatgtgggaaggaccatacaaagtgatcggagcgccccggccaggctccgttcggttaaccacggaggacggcacagagctgcccaacccctggaatatcgagcacctccgtcgtttctatccataaaatcgagattttttgctttcctagcgctcaggccagcacccgcacaacccctcggtttgtgcgggactggccgggggctaccactatatatccttttttcctttcacaagcaatgatttttttctacttcttcgcgaaggccgttttttctccccttcctctagcttgtcccgactcaaggaataatccgcgtttattctaaaaccctaagtgctgtaaagcggcctgaaaaccgccgaaagggagcatgaacgcgggccgcgccccgggttgtgccgaaccccgggggatcggaagggcctacacacggtcgtccccgacccctggtcgtcgcagcctcggcctggccagtcccactgggcggctcccttggggcgatggtcttgcctatcaccacttaggttccgtggaccgaacgcgggtttaccttctcgctagaacaagcctgaggggggggaatggggccaaaacggcatatcaatcgcaggctgtctaattatccatttctgccttggttttttcttctctctatgtcacaggcatccgatagaaaaagcaaaagagttaaagggttttcagttgcagaacaagacaggatggcacgatggcctaaatacaaaaagtgcctgctacgggcacacagcaaaagggaataaaaagcgtgagcggtcacggagtgcccggccccccgagaccggcgccactaacgatgtcgtcccagtcgtcgtcgccgtcgtcgcccccgcttccgctctcctcgtctgaggtaagcccggaggtgaaccggggggccgacccctcgaagctcgagacgatcgcgtcggccgcctcccggacttgcacccgggcccttgcttcggtccatgggggaaaatcttcaagcgcacgccacggctcgaagtcggggtcgcgcgcttggtggctcgtaaggaccagctccaccgcagcccgcgccaaagaagccgacgaacactttatggttttgccgacctcctcctccagcctctccaggtccgccgccagcccgtccagccgaagcgcgagtgccggctgtgtgggcggaagcttgctatcccggcgcgcggagatgccgactcgacgccccgcgcgctccagccggttgactgcgttggagagctgcccgggcccgagcttgttggtgaggcggagggccgcaatctccccatcctcatcctgcaccaggcgctccaggtcggcgagggtactctgagccgtggcaagctggctcgccaactccgcgccgccggacggcccgctcactgtcaagtccttctcccgggcctccagctcggaggccttcaccgctatcgccgcgcgctcagcgcgggtgctctccagatgacgagcctcgcgcccggcgacagcctcctcgcgtctcgcgagttgctcgctcagccggcgcgaggctacctcgcggcggcccacctcggcttcgcgcttggcaagtgcagcatcccgttccctgcatgcctcttcccgcagccgtagctcttccgcgcggtgatccggtcacgctcggccgcggcctcttcacggaggcgaagggaagcctccacctccgccgccgttctctcgtgagtggccaaggtggactcccgctgatctagcaggcgcgctcgctcctccagctcctgggcccgccgcgcctgttcttcactgcgcgcgttttgctcgcgctggttccgatcgaggacttcgatccgccgacggatcgtggcttcaaactcctgtgcggagcgagcacggtcatccaaggccttgcgctcagcctcgagtgccgtcatccgagcccgcagagaggcgttggcctccgatgcccgccgctcatgggcagcggctgcgtcgaggatgccgcgtgcatccctgaccctcttcgccaagtcctcgacgtgagcctcatactggaggcggatgtcgcccagcgcttcgtccagggcgcttgaggcaatcagcgctgcctgcagctcctcctctgtctcccgcatgacggagtccagcgcctcctcgcgcgcctggatttcggctagttgggtttggcgcattttgcgccccaccctcaccatgtcatccacggtgcgacgcccctcttcgactcgcgcacggtctacggcgagcggtgcctattctgcatccagggccgtccgctcttccgccagggcttgaatttgggtgttcagccctcttgtacggtggagtcggcggcggcgagcacctgcagaagtggctccatgctcgccggagtcagggaggaaaaggccgcggtccgtccccgggacaatggggtactgctggatccaccgcgagactgggggctgctctcggctccccttctacgagacaagcctcgagggcgccgcaagcgcaagagggaacggctgtctctctcaccccccacttcgggtcctcgggtggattcagcctcggcctcaacctcgggctcgggaccgccctcagcctcggcctcgacctcaggctcgggaccggcctcggcctcaacctccgcctcgggctcgggaccgccctcggcctcagcctttgcctcgggctcggggccacctctggcttcggctcccgggccgcgtcttccttcaccccccgatcctgggtggtgctccgcgtgggccctggtcctggagctgccctcgagacgagcgtcgccactcctgtcgcccgcggtgggtcggattcctcctaagggtcgctcgggatcgggcccggtgtgtgacctctgggccccgccgcgaggctgcgaaaaccccgcggccttggattggctgggcccagattaccccgaccgttcggactttttcccacacgaggggcctgaccctgagattccctgagaaggaatctcgctacaagggaacccagatcatgttaacaaaagaaaatgaagggacaagagaacgggttgagtaagagcaccgaagtgagcgccaacaatcgtacctacggggagggcggttgaaggtccacttcgggggctcgatgaagctcccccggcatggctccgtttgccctatcttccggagccgcttccttttccgcctagtctcgggctcggctggtcgtttgtggcccactagcgaacgatctgttgcgcgctcggcaccccctacacgcgggggagagggtggtcgggaataggtcaccttccgtttcccctttgggtcaccggcggaatcgcctccgggtccgcggctcgatccgggcgcccttgagccgccgccgcctggaccgccggcacggcttccgccagcagtcgcaccaccgccgcccccgccgacggcgctaccgctggcgccgcctcggctggaccggctcctgccggcgccgacggctaacatcacggccaggatgctctcccggtcgcggtcgcagcagaggggaagaatcccatcggggattagtgttggctcggcggagtctaggcccaacacccaccgaatcaccctcttcgcgtcctcctcaccccagtcccagggctcgcccacatgcgtccacatggggtcgttgggaccagtgtattcccacactccacgggatcgttcctggagaggtgcgatgtggcggcggaagtaatcgccaaagaccatcgcccccatgaggcccaggctccacaagcccctgaggcgatcccacaccacgtcgtattcctcacccaactccgacgtcgccaaccatgcggcagacctttcgggagggccagcgggaatttgaagtcgcggatggtccggcaacgtagtgtagaaccagtccttcttccagtcctcccatttcttgtggagctagctctcgatgtactggcccgctgtgcccggtcggggctggaagtagcatcccccaccaactgcgccttgcagcagctgcgggatgaagaaggcctggaacaaccgcatcgtcggtcgcaccccaatgaacatctcgcacaaatgcgcgaagatggccagcgtcatcacggcattaggtgcgagatgcaaggcgtgaatttcgtacaaatccagaacttcatgtaagaatctggagaacggcgggatcaagcccgccatggcgaaggacaagaggtgcacggatcactccagatatcgcggccacagcctcgactctcccgcccgcacgacggcaccatccggcatgatcttgcgaggaaggctaaggtgcctgtctgccgtgatgcgggaggaagggagcactgtgtcgccggcgtcttgggccatggcaaccggcggagaggtgatggagagcgtggagcacgagacagtgtggggtggcgaaaatgttagggttcgagaagcgaaaggacgagtgggcggttggcgaaaggaagaaggcagagtctccttctccgcccccttttatccttgcctcatccgcgctcgcctcctcgtttcgcgcccccataactgcccttacgatcctcgcgcccgcatttgtctcttcgcatcccgcgcccaatcatcacgtcgcccgttgtatccgcttccgcctttagtgtgcccgtcagtggcacactcgaggtggagtgtgccacggccatgagcgcaagttgggcaaactgtcaccactaccgctgtaggagtagcgggcgagagaatcgaggcgtggtctaactgaccccccggttatcgcgcctcaagtgtcttcatcatgagcgcaatcagaggcggtcaaaccgctgttgtggttagtacgccaacctggccacgcggtgatatccttttggattccctgccgggcccacaaccccagctcgaggagtcgtgaggcgccatgtcagaacgatcccaggaaatcgatatctgatatagcgccgggggctactgtcggagatatgggcccgggggtatgtgaagtagaggggaattactttccctccggtcacatgactctgcaggttggccccgctcgcgcgtcacgcgagtcgtggaagcggcgggggggggggctcggggcatgacgtcacccccttgggctctcccgcggcttcgccccgaggccctcaccctgtcaccacgcggcagagggagagagcaagaggggagcacaagctgaacagccataaatgtgcgacgcccaaactgtctctcaccgcatttaatgcggtaagggcagacgtgcggcgtggctagtgaacccctgtccatcggatgtgaccggtctgtgaccggcccgtctccgtcacatccgatggatagggcaatcatgtcctcacgtcgcccttgtccccggcggaatgggggtgggtatgacccgtcacatccgagcgccgctcgaggaagggctattgcgtgtcatcgttcatttatgagggaatgacagggctatcccctgcgtcaggcgaggggcggcgccgggttccactcgagaatcggttattgcttagcttccgggagaaggcccggtttaaagcccaaaaagtggagtggggtccccccccctcccgatggagggtaggtagaggcggcacatgtggtatccccttaagctataaaaggaggaccctgtccactgagatagggggacgactcccagaaaacctgagctcgagaggagaaggagcaggtgcgctctctgggggaagaaacccttgtaaaactcatccataatcccaaacacaggagtagggtgttacgctctatagcggcccgaacatgtataatccgactacgtgcaagcttgccggtaatcttagggacaagcgagtgatttccaataggcgggcctccgccccatgccaaactcacgaaaggggggggtctcacgacctcccgctatcagggggccatccctcgacagctctagtagttttcctttcctcttttgtaagctttacttttattagaatactcttctatatacatttatggtattgaaatactttccgagtatatgaatgcttactttacattatgttcatgttatactaaatatactgctagcttatctgggagatgctttggtgcgggtataatgtttgcttatgcaattactctatgtcatgacgatgatattggagtagtatctgatagtttagacgtggtgtctagattacgggatatcattatttggggttatatgctgcggatgaaaggtgggccgctgatggtgacaactcagtacgggtattcctccgtgcttatatataattctaagttaattccctggggagggtactcctccgtatttagccccggttgtatggtcatgacgggctgtcgtaaggaactcgggcagtcaggggtggcttctcgaagtaccaggagggcatcggatagagagtattagttagtatatcagatgactagaatgtatgtatactatgaatattagaagtataggaatagattatctttttcttttctttccacttagcttagatattttagtatgagaatgagtagctgatgcttgtgtgtcactctacccttggattatcttaacccctgcttagactttgattatcacaagtaacatataaattattaatcaagttctctctacatgatctttccacgggataaaataaatacgatacccttggaatactctcgggtgaaatgctacaatggtatatccgtgtgcttgcagatgaactctgtaaccataatataccaggagtatttctgcgtcgttgttgggaattatatttctagtattgtcgttaagaaataccaacaccacctaggacaaaaccactctgaattgggtcgaggggggtaattcgtctggtattgaaagttcaggctgagcgatgtttggtttttgggttggggggtaattcttaatttttccaaaaaagaataacctcattttatcaaattccagtgcaattattaatcactctatttactccaaatgtatttattcctactttcgtaagctctgatgcagtaattacttaatatttttttcttttgggacaaatagaggaactaaaaatcaacttattctaaggatggatggagtatgtctgacttaataataaaataagtcctcttttctaacataagttaactttttatagaatagagggataggaataaaccattttatttaccttcttatttaatgaaaaaattctactacatgtacaacaggagttaatttctagtgtttaaaatatgtcaaacaaaacaagttgaatttgaatttcgtacatactctcagccaaaactattaaatgagttttatttgttgtacccttactgaactacctgacaatattgtttttacagtttagtctttttcccctcgtcactaattttttatatagaaccgcaccaaaaaaagaagtattttataacaagaaaggtataatacatgaacatcatgtgatgttgtcctttattcagagagaactactacgttttactatactccctccgttaaaaaaaatgcaaactctatcaatgtatttagacatgatgtatgtccagatacatagctagctaaattttgcctattcttgggatggagggagtattaagcaatgttcaagtgagcaacatagtgtgaaaatttcactttttctatgcgcatatttcctaaactgctaaatggtatttttctttttgaaaaaataatctatagggaagtttttttaaaaaatagattaatttatttttaagtttaaaataattaatacttaattaatcatgtgctaatgacccacttcgttatgtgtatcttaacaatcttttccgatccgctcctttaaatacaatccgtctattctgcttgaacaacttaggcccctaaactaactactccctctatcccaaatattatcccaaatataataacttgtattcaaaatataacaagttctctacgtatattatcttcttaaccaataaaaatataagaacttgagtgaaaaatataacaagttctctacgtatataatgatccttaaccaatcatatgcttccaccattcaaattctccatctgcttacatataccatgtatggaacctaggtattatgacactcatatttaccaggtctaataccattattccaaggcatcacgcccattgatgccgtaacgacaggtgcaaatacatcctggagccttttactggctgcacgcgttaacacgatgtgataccaaccgatatcagcgttggtacttatgaatattagcatgataccgggtttcgactaataccaattggtattagatcccgtaccaatggtatcgtatggtaccgatatacttcctccgtttcagattataaaatattttaactttggtcaaagtcaaactatttcaaatttaactaattttatagacaaatatagtaatatttataatactaaattagtttcattaaatcaataattgaatatattttcataataaatttgtttgaaaatgttattattattttcttcaaacttagtcaaacttaaaacagtttgattttgaccaaaaccaaaacgtcttataccaggtctagtaccttggtatcatacctggtacgtatagcttggtacaagtcggtaccacatactagtgaacaacaaataatggaacacacatctataggtaccgcccaattatcacaagtgccaatcctcttaagcaaatacaagagccatggatacgtactactccctgaatgaaaatcaaactcgatagcttttgactaattatcatacttactatatctatactaattagtattatgcatgttatatcactatattcatattttgaagtacttttcatatgatgctaattttatatttgttgggatcatagaatgaaataaaatattggtcaaagtatattattgaagattatgtaaaaaaatataggttttataatttagtacagagggagtattaggactagaatttatgtggtgttgcattgctgcatcgctacatgagaccagccacgtcacatgcatacattcaactagcaacacagccatgccatgagtagatctgtagaacactgccacatgatgatcgaattaccgacatgcatgcaatagtcattcagacgatgattatatataccttccttcatcgagatggccggcggcggcaagccggcagcggcgaggtactgtggctgtacatgacggtaatgtattgttgcagggaaaggaacaaatggacgaactcgatgtgagcgacatccgatcgaagtggcggccgacgcacgccaatcaggaagagtcgcgcgcatggctacacgacctgttggaagcttgcgtgtgggggtggggtgcgcaacttcggggatatatgtacgtgggagtaattcgacggtgggctgttgccccgagcgaagcaaaggaccatgggatcatgttcccatggtcctcaataaattattttcattcattaaattagatctatgacagtaatccctctgtcctacgaaccgtctaatccctccctatatacacacacaactcctatgtacgtacatacttacgctagagatatagaaagaaaataatagagtttgtatatgatctttcccatttggtagtttacttttctttctagctctatggttttttcccaaattaagcatatacatagcgaccactcctatcgaggtggtaaaagaagcgacaccacgatgtcatctcacgtcacccgttgttccatccttttctcgtcaattccttaaaaagtttttttttattaacgatgtaaaaggcaatcctaggagctgatataaattcatccagatgcacactaggaatacatatatgtacaccctctctatatgatagataaatattcgtctaaaaaaagaaaaacatacgtccataccagatactactattcggaaaaaaaacatatgtttaattacattttatcccttttacgttgttttcatccaaagtgttgagaattagcacaaatatttttgacaaattccatcgaatattaatccccacgaacatatatgtgaattagatgtataatacaatattaaaaaaaatcaaaatccatattaacttgaggatcatagtttgagcaaatacttttttacatggtcctcgccactttttagctattagatttttaagtaaactcgaatgatcaatcctactaatttttaaatgagaaaattatttatgtaccactaaaatcaattagtattgattaacatcataaacaaattatatctactctatataataaatcgaatccagacataaaaaactactttcgtcacctccatcttctttcactcattccctaaagggcgccaaacatgaatctcaactagctacgttgtagtaacttggcaagagtatgcatcattgagttgagatggtccgagtaagaggttaccgttaaaatagagctcaactggcctacttaccgatacaatcctatataaaattatgctccatgcttgtcttgaggagcacaagtatatcaatgtaggagccatgaatcaaggatcgaagaaaaaaaccttagtggctacagtcggcttcacccagatgttagtggggtcggcttcacccagctgtaagtggggctacagtctgcttcacccggtttattttttgggtacatatgtaattctatctattaaaaagacatccatatttcaagataatgataataaatagtagtgataggtgacgacaaaaagttcttttcttggatatgatagacattctgattatttttgagtgtaggtttaaaaaaaatntttattggggtcttttgtttttttttataaataaaatgctcgcgtatctgcgcgagttttctttttagttatattaaaatttaaaattgttacatagtgagaaaataattactactagacccaatccaaaaggtcgatattacaacttggtatttactaattccgaattcaaaatttattccggacctgaaaaattgcagaaataactcaaccacttgctaacgaacaagcgcgctaaaaacaccaccaccattagatcatcacagccgccggagcaggagcggcgactgcgcgggccggcgagctccggaggacggcagccggcgacggcctcccgcgccccatggtgaaccctcgcgttccgtcgggcatcctcggcccctgcggcgcgtggcgggggctcatcatcatcagggagtccaaatgcccggccgcggcggcggcggcttgcggcgccccgccggcggcagcgtgcggcctgcttccccgccctctcccccacgacttcttaccgtgctgatcttcctgctgccaatcgaggatccagctgggtcaggtgttggtccgcaacaggtaagaaggctcagctggttgcgttgcttacgtgatggtcaggcaagtggtccgccattggcgaatccgacgacgcctgggattgcggcgagtgatcgtcgtcggagatcatgaggtggtcgaagtccggccgcttcaatcgcatcgctgatttgggctacgaacacaagaatcaagtgactattcccattttgtggatgcattgccttctacaacattaatctcaagtgcatagtcttattaaaaaaattagtataaatttgtaaaattataaattaagactagagtttcttctatgagaaataattcacaacaaaataaataatatttataatttttaaaataaaataaatgttcaaacgttataaaaaaagtcaacaacgtaatacattttaagatagggagtagtttgcatgggcgtagaggaagaatttcagattaattaccgatcgacgtagcaccgggcgaacgcggagcccctttctccagttgcgctcgtcgttgagcttatcaacctgtcaaaacacagttacattccttcagtccagaagaagaatagtagtactgaaacgatagtaaattcagggaacttactgcccgatcagcttgctgcgaggtctcatactctataagcgcgtgcaactttggaaccgggaatcaaacataatacaagatcaagatcagtgtcagcaacatgctcaatacatgatacacattttttttgcgtattgccaaaaaaaagaaagaaaaaaaactgaaaattaatgtaagtaccttgttactgattagcgcgtcagacttggaagatctcgcggagctaggctcttgcgggtggcatatcctgatgttcttcacgctgttcaattacggaacggaactccacacaagttaatggacatgccacaagttacacatcaacagttaaaccgatctgtcggtctgaccttcctatgatgccgaagatcttctcgaggctgttcctggttgaatcctcaggcaaattctccgcgatgaccattcgagactgtgaaattaatgggagttaattggccatggatggttcacaatgctaaacttgtaataagcatctgaatttcgcataaggaataaaatcttgccgctgacctgcaattcttctttgtgtcgctcggtgaatggctgtgctcgtcgcaccttcttaccgtcgtcactcacaacctccagagaaggaaatcatgaatcttaggattcaggcaataataagaagagattacagttagcaacggcgacttacgagctttgaggatgttcttagagcattcactagcagttggttggtcacccccatagccttgattttcttccaggatgaaatgacagacataggaactgtccagcacatggaaaggaacataaatttctgttaagattttttcctcggcgatcaattacctcatgtcattttttttcttatagacaatagttgtctgatctcaaaatagttcatcagtgtagtggtgtgtaaaactaatggacggcactatgcttcggacgcctgatgaaaaggcaaaaaaatcggacgctcaacttgtgcccgttgtcccattgcatggatgtgcacgcaaactgttgtatgcagatgtacgcatagggtgtgtttagttcacgccaaaattgaaagtttgattgaaattggaacgatgtgacggaaaagttggaagcttgtgtgtgtaggaaaattttggggtgtgtttagttcacgctaaaattggaagtttgattgaaattgcaacgatgtgaaggaaaaattggaagtttgtgtgtaggaaagttttgatgtgatggaaaaattggaagtttgaagaaaaagttagaaactaaactaagccttgatgtgatagaaaagttggaagtttaaagaaaaagttgggaactaaatcgggccatagtatgaatctggctctagtacatgctttcagtagtgtatcttttcacttttattttctttactttcttgtaaatctttaaactgaatttttctctaaattatttatccgatctgtaatctaattacaccattgtatctgttgcaatttaatatttacaacaagatctcacataactatatttctttaaaaagaataaatcttataattattgaaacataaaaaatacttactgaaacattcaaagacaaccatgtgaaacatttacatataagctaatgaaatatcacaaaatacttagtcaaacatcgaactagcaccatgtgcaacattgacaaataaactagtgaaacatcaaaaatacttagtaaaacatacaaataacattatgtgcaacattaaaaaaatccattgtaatatagtgcaacatagttgaatcctagttgaaacatcttattctgataaatgaatcacaaaatcttaacggttgaaacatatatatatattaattaaaatatagtcatatgtgatcttgttgcaaagatttaattatacgaatataatggtgtaataaaatcataaattggatcaataatttaaaagaaaaaatcgtttgaagtttgttaaaatgtggttaagacgagtagagaaagcaattcaaactacgtaaagtaggagagtgaattgaagaaccacgcatgtaacgtaagagtaggaataattgcattcagaagcacacatgcacccattgcatgcagcgtcagatttatttgataaaatcggttgaccgatatagagtattatccaaaactaatggttgttttctattaccatagcactcaggatccttgttcatgatcttcatcaagaaatcgtttgcgaccaaattcgtgtcactgaattggtactcgacctgattccaagaaacagagggaggaaacattgttgaattcaaagagagcactcaaatcagtaaaataataataaaaaaagataacgctcaatccaacccaaaatggcatcatgttgaaatgtaaacctgcttgatgatcttctgtgcaatgtcggccggacttgcccccttgggctgcccattgccgccgccgatcttggcgtgtccaaagtccggcaggaagaaggtcggatctgggtcggcgaagatgctccagtccgcgccgagcccaatgctgctgcccggcagctgcaagaacggcgagtagtagccggcggcggccgcggccatcgggctggcggccggcgacctcggcacgaactcgggagcgtggacgtttagcctgaagggcggcgtcgagcactcgccgctgctgctcgcccccgcagccgtcaccgtcaccgtcaccggcgccttgccggagctgccgcggctctcctgtggcatggcgaccggttcgatcgatcggagtggcaaggggcacagagatgtgtcgagatccaaaatgtgtgtgtgaattggtgtacaagagcgcgccgagtgtgttggtactctcacttttatgcgcgcggcgcctcgggaggctttgaccacttcttcgtgggcacttttgtgaggtgagagtgtttcttgggcagcttttttcgcgcatgtgtggggcttccagccttccatagtacgtaccgctactgtaggagcgaggccgctgaccaacggggggcagagttagaaagcgggaagcacctaatctttccgtgtacacattgtatacatctatatctatatctatatctactagcaaaatgtctgtgtgttacactgggtaatgtcatattgaataaattttagctgaacaattttttaagcagtatagtatgacaatcataattacaaattattccacgtgtacgtatatgatatgaactatgttcccgacacgttattttcacgcaaacgattgtaccataggaggaacaaacggtgaatggcttaggttactttcacgcaagagcatattgatgaaaatttgtgtgaataacaaaaagaaaatctgtatttaaaataggtaagtttatcataaaacaaatgataatcaggacagataaaaaatacttttgcatatttactcatagtctcgtagtggtgacgcgtgctttctcaatctgtaaactcgttcaatcagacacccgcatagaacaaatcttttgcaaggaaaaaaatttcctaggttggatagattaatctctatatataaataatacaacttaatagaaaatagtcctattttttttattttttaatacaattaaaaaaagaactgacattcggaattaaaaaataaggaatattgaaagatgagtttagagtccaaatagaaatactattagaaagaatgaaattcggaatttaaaaataggaatactaagaaggatctatatatagtccatatagaacatgaaatgacaattaacgcgcataatttcataagaaatagaaatactattaaaaagaatgaaattcgaatttaaaaataggagtactggaagaataatctatagtccatatataacatgaaatgacaattaacgtgcataatttcataagatatcaatttatctcaccatagggtaagaaatgaggctaagtgtccatatgtcaccaaaattaatatgagcattaaattgtacttcataataccattaggccaaaatgaatcaaaattgacattagtacccgaataatgaaaaaaaaaatcctaaatcgtaacttccgttgggccaaaatgataaaggcaatagcttaaatattttagccaaatttctcgttcattccatttagctagacatgattttatttgcataagaaaatttataatgcaattttatgggatcaaataatggcttaaactgattaaatttatttatgtaaatatgaaaacattaattcgggcaaaatttgatcaaaacctcttttaggctcgagagctggccgcggcccagaaggcatgcaccggcccattcacgcgtgcggaagcgcacccggccagtgagaagagtgttgacagctgttaaatacaaaatttaagccatcaatacctacataaaaccataaatataaaacatccaacatagtggtagggtttatttctaacaatttacacgagtgttggtgtatattcgtatgcaggtgacaaactacctaaattgagaaaaaaaatacatgaaggaggaggagaatcaaacgcgtatccgaatatatggagttttggacccagagacccaattaaacacctccaaataggccttccatccataccaatgaatgaagggcccaaaatgagtatccaggccgaaaaccggagcgaaaggagccgtccattacggaggccgctggcccaggcccaagttcagttcggtagtgctccgctctccctatgatggttatggcgttaaaaccggtagaaaccgtcattagaagggacacttggcatgagaggagtaaaaaagtcggaggaattctgaagttgtcggtaatcctcttcatatttcattctgctctatttattactttgattataattgaaatatcttttgagtaatttagttttgctcagtgagaattatttcttggttagttcctattcagagtacgggatcatcgttcactacaatcaactataatatggtgattgctttagtgagttataaacactaaagtagtaattaactgcgtagacgtggtgtctaggtagttgatttccagtgtttgctccgcatcccacagtaggtgtgaggtgggtgtagaggtggtgacagccctcaagacactgaagttctccctgtccgggtgcgcagtagagcgatatctgggagcagcgagctggctagtgcccgaagtacctcattagaattaaagttaagcttttcgtagacactgttcttcaccggtgaaactcctctatcctttgcctatccatagcttcgtgtccttggatgaacctgaaccggagttagcacacatattccctgtggaaaatcgatacctgagaatactctcgggtgaagtactacatcggtatattccgtgcacttgcggatttatctgtgatcgtaagaaataccaataagcatttctggcgccgttgccggggaacggttgttgtttatctccgaaccttgttcatcctcgtatcctttttatttttctttcttctaccttcacccctgctatcctcgagaagcattccagtaaaacattctcaatcgatggagccacaatctattttccaattgtctgctcctcggggtgaaatttaagagccacctccttcatcggagcctatttcaacacttggctatgaaattcgtcacgaattcattagtatggttagggagaaatctttctctggtttaggccaggaaaacccctaccatcatctgcgggaattcgagcagctttgctcgggccttaagattcgaggcatgaagcaagagactgtttggtggaaattgtttccgttctctcttcatgagagagcgaaacaatggtacacatgtaccgttgggtgtgtaaacggtgacagggagaaattgcaagacaggttctgcctcgcatttttcccaataacccgtattactactcttcgtgcagaaattctgagtttccaacagataaataaagaatcgattagtgcagcctggtccagataaactaatttagttcagtctggcccaaccctatctatacccgattacgtgctattgcagcattttcatgcgggtttagatagggagtctgcattctaccttgacataactgctggagggtcattcatgcacaaaactcccaccgaaggcaaggaaattctcgatcgcatatcaaaaaatacctcctttgtcgggcagtgtgttgaaccccatccagaggcatttgtgtcaggaagggaggacgaagggagtatgctttacaaaatgttgagatgagtatgtactagcactatttttttaaaaaaaaattgagaatatatgttttaataatttacgtttatttatatgcatgcatgggaagaattagcataaatatacccctataggggaacgcataacggggacgaggggagcgctacgtaatcgaggcttggatgtgggaccgccagctgggtcgttatatttagtatctttacctattactagtaagtgtgcacgtggaatccacgttgctaataaaataaataaaacacaggacggccttcctctggagagcccccaacggcgcgccactcctctcctctcccccgccgccgtgccgcacgccgttcctctcccctctaccgtgctgcgcgccgttcctctccaccaccgagctcgtcgtcgcgactgccgtgtctctccgcctctcccgctgctgccgcccctactccgcgcgccgttcctctctgccgccgagctcaccgtcacgccggccgcctctcccgctgccgccgcccttgctccattgaccgcctcacgccgagtttgctgccgcgcctgctcgagagaaggagagaagagaagagaaaaagaacagaaagggtggggcctataccattttctatcacttacatatggggctcacatatttattatattttatttttactgactaggatgccacatcagtgaaaccgagtgtctatagtgccttggtatgttttcttgaatggttttacgtagttcagggtatacatttcttgtattgcggttaggggacctcaggcagactcagcgtaaaattgagggacgtcaggtgaacttattcccaagatgaatgacctctgatgtactttttcccaaaaaatcactgcacatgggccatgcccgccttgagcccaaggctgtggtctagactaacgagcaaaacagcgaaaaccccaagcgccaccgcttcactccccgtcggcgaccagccgactttccccaatgccggcgccgcccgccgcttcctggcgccggcacgctgctgccgccgccgcctcctcctccacgcgcaaaaccctcctcctcctcctccccgtcttcctcctcctcctcctcttcgtcctctccagggctcctgatctcaccctctcccccgcggccgcctcctcccgccacctctccgccggggttcgcccgttcgattgctacgcgtcgcagcaggcctcgccggtcttcgccagcctggtggagggcgtgccccaccccttcttctactccctcgccgacatgggggctcttcccgaccacccccacaagaacatcgctcgcatcctcaagggcaagcgcttccgcaagcccgacatctccgagacaatccagcagctgctcggggggaaggtggggatcggatcccgtggtgtggtggtcgacgtgggtgccaatgttgggatggcgtcgttcgccgcggccgtgatggggttccgggtggtggccttcgagcccgtcttggagaatctgcagaggatttgcgatggggtgtatctcaacagggtgcaggaccaggttgtggtgtaccatgccgcggcttctgatcgagttgggaacatcacaatgcataaggtaatagatgagtactttacattgctgcctgtagttttgatgttcacatgtctattatttttttaaaaaaatactttgtgtgcaatggctgccttctatgttataaaattaacaaggtttttactgattgggagttcattgtacaaagttaatcattagaggtgataccagaaacaacaacaaaaaaaaggaaaaaaaaaaacaatgtgtaagctagtatggcaagctctcattatgcaaaaaatgaacctttgaagtattcttgggcatgtctcgagttttatcgggatccgggaactcattttcgttactaatggaaagaacagtcttcttacagagatgcatgaatgagtaagttgcaaactagaacaaacccagtatatgtttccatgcagatgtgattgtttcatttctgcattgtctctaaaaggatcatgaacattcctatgactttagttggtcctttcaatttcatagggaaagttttcaagattgtggtgctcatctgcagaaatgtttgaagctatatatgcataagtctgaaatgtttccttttcctttaacattttaactcactgttgggattcggtgtttatctattttctattattgctataatttctaaatgatttagaaatgccacaactttatacataaaagtcatttttgtaataatgtgctctaatgttatcaatgcaactcattgaccatttcattagagactaactttctcaaagaaatacataccatattgtatagttatttaatggtccagttgatagttcattaaatgcatgctggatggcgtaactaatgctttagataaattgccttgcattatactaaatgccttcattagctagttatgtttgaaaatcattgtggacaaggttctaatttcttgtttaccttagaacttcagattatgtctatagagtttttttactccccctgattcgaaatgtaagttgttttacaatttttagtcacttttcatctccttgttcgccattgctgaataattcttcttctctcacaagtcacaaataaatgacacttctttccctataacaaatgaacggtagcaaagtcatttgtgctgctttcttagttctcgtgcacaagtccaaattacttacattttcaatctgaaagagtatcgctgtgaaacaataatttcattgtgcaatcatacatgtgcaaacatattggaatcagtatgtaacttaaatgattcaaacatgtttcattttgccattattctgacttgtgcttccactggaaagtactctaattctttgaattctccaattgcactctgtatccagatactcgatatttttttaatttattcgacagcttataaataattattttggttacctaggtgattggacgactcgacaacagtgctatatctgcaaccggtgcaaaattggcttttaaagcaaatgaagaaattgctgttgaggttgctacaataccactggatgaagtcattctagatgcagagcgagtggttttgatcaaaattgatgttcaggggtgggaataccatgttctgagaggtgcatcaaagttgctttcaaggaggaaaggtgatgctccctaccttatatatgaagaagatgaacgcctactgcaggcaagcaacagtagtgcacgagagataagggcatttcttagtagtgttggttacaatcactgtacacgtcatggcacagatgctcactgcacgaaaaactaggcatgtgctttttattcatgtaagttgatgatcatctatgaacagagaaacattcatatatgatgtgctgatctgtagaaaagcattttccctctcaggcagcactttcatgaataaaaatagttagtcaacttttaattcatggcttctttcttttgggttagattgttgatggtcgagttttagtatcatgttgatttctctgatgttatgacgatgtagctatgcctgttaacttttgttgcatgttttgactctgttgtaaatattagtggatgtagtcaggcagtaacgattttcttattgtgattatgcttatatttttatcatgttgagaatttattccaaatcagttatgtttggtatatgcctgatgccacaatgacccccccccccccctctcctttcttttccttttttaggagtgcagtacagttgattgaaagaaaaggggtgactagattctgttgtttccaatatggtttagcttgtctatgctattacggaactaaactaatcttgtataatttttctatagtatttggttggcgtccaaattggaccaagtttcagagtgagcaaatgcaaatatactgcttgttcccttgcaatcactgcagaatttcaccatctatctcaacccaagggatatgcgcaatctttggccagtcaatgccacattcttttctgagtctatccttgagcactgggttacagagtgcgacttcaagctttctaagagacagtggcagctgctcgtctgggagtaattccaactcagggcaattccacaagattaatttatccagggactccaggctggacaatgaggaaggcagcgattgtagattgttgcagccacttatgcagaggctttgtagtgatcttagatgtaggaagacatcctcattgtctgcagtgaaggtggtgatctctgagcaatcttggatgtctaggttctcaatgtgctcaagcctttcccttaaaagagggcatgtgagtattctcatatgatcaacgataaggcttctaagtgactgaaagcttgctacaactccattggtcactggcgaggaaaatctggcaagtagcttggggcaattgaatatgcagagagatgagacagtggtgacagtggtcaattgtgtcatcttcacatcatgatggtatggaacccagaaccctttttttgcaattgtcagctctgtaaggcttggaggtagtggaggcagctctttgagcttttggcagtccttaatcacaatattgcggagattcatcatttcctggcctgtccatgaccactcatttagttcttgcatgtcatcaagaactagctcctctaatgactggaaagccacatgtgaacttctattgccatatacctctaggcctatttgcctcactgttttcaaacgctgcaaccaaatagtcctgacagatggaagctgaccaagtggtggaagctgctcccaagcattgcaaccactgaggaagatgagctcaagattgattagccatttgctttcaagccaactgggggctttgactcccatccaaccgatgatgtccagcctcttcagatttgggtgtggctggagatactctaacacctctgcttccttatctgagtttaccaaatctcgagcaggtgcccacatcagctgcagcattgtcaggtttactttcttacacaacatggcttcctttgcctcatcaggagcatcaatgttctcaaggttcctaatgtggagggatccacgaagctcttgtagataaccaagctgaattatgctgtttgtttcctcactggtgaccttgaaaatgggcaatctctgaaggtatcttaggcttcctatgtctgttatagtggaaagaatctggttagctgctgtcagatgccgtaaactgaccaggttgtttatgcttgaaggtaacttttcaagcctgcagcctgataagtttagaacttgcaagtggtaaagtttacccaagtattctggtaacatgttgatggcagttgatgagatatttaggtatcggagatgcacacactgtcgtatactgtcaggaagtctgtcaatcttgcaaggtgataaatccaagacacgaaggctttgaaggttatcaagaactacttgtgggatggaaatgttgattggagccaccattctgctcgtaaagaaaatgagagtgcgcaggttcatgtatggtattgtctcgtcaagcattgaaaggctatctagatggattgatagatggcgtacagaggatgggatccttctctgttcatcacctcctattcggaaacattcttcggctgaaactgatttggcaagtttgtgaataacgggaggcatcacataatagctgacaaattgtttcttctgaatggcaaaaaatgaccgactacataactcatcaacatattgcttcccaatgtcttccattctcctgcaaccatctgggtatacataaccttgtgccatccacatgaggatcaactgctcagcttcaaattcccagtccttggggaagatactgcaatatgcaaggcattgttgaaggtgcactgggagattctcatagctatgctgaaaaattggcatgatttcatcccatactgcatttctctgtaagacttgtttccactcatctgtggtgtgtttacatttcagctgtctagcgaccacctttgcggcaagaggtagaccattaagtgtcttagcaatctcgctcccaatattcgccaactgtgaatttataagatggttcgtatcatcaaacacaatcatttttatcagggaccagcaatccttatctgacaagcactccaggttagttatatgggctgactgtagcatctccgccaccatactggatcgggtggtcagaagtatcttgctcccatttgctgcagcctttaggggagaaagaagcttctgccagttctcgtgctctatcgccagagttatcttgtcattgctccagacatcatctaagacaagcagaaaccgtttggatacgagccttgctcgcagtgccacctgaagcctgttgaaatttgttatgctgtcatgcctaaatcgactgctggaaactgactctagcatctctcttgtgatcctggactcatcaaaggcatcagtaacacagatccacattctcatgtcaaagtactgtgctactctagtgttgttgtacacatgctgtgctagagcagtcttgccaacgccaccaactccaacaatggaggcaaccgagactggattatcaccatcaacctgagagcttaaaagagtacttaccaactgttggatttctgattctcgcccgaagatttccccatgggcaactgagcttgtcatgatgctgtatctgctgtgcctgggcttccttggtagactgagtgcttcactgactccactagcaacctgctcaaggcgctccaacagatttaccatctgattcttgaccctggttgatctatcccagtgtggctctagaccagaagcttgggccccttgattgcgaaacctggaatgcataaaggcgctgattgggctactgttgctctctgttgaacttgattcctgcatttgatgatggaggcggttgtactcaagcttgtctaggaggtcctctgcatggtacatgacatcccggagctcccgcatccatgggagggagccgtaagacagtgaaggtgttacctctgccccatggaggacagactgcgtgcgaagcagcgcgacacgaagtctgttcatctcatggctgatgccgcagtcggccgcccagctctgaagctggtaggacagatacttgtcaaaaatgacctggatgaaccagccacctacagctaggtaactggacatgtccatgcttctcttttcttgaactttgttatctccggcaaggactaagaatcccttgaatattttccaaactagctaagtccatcttcaattctaatgggaatcccctggacacctaagccaagtcttcggccaagtatttgcaaagacttcttcaacttgaatgttggaggttctggacattttgaaagggacacattttgaggacacattttgagctctgaattacaaggaacatttccgaaccttactatcttccttttagatatgttgaacatctgtttcgacgtgaactttccaagattcccaaaggtgtaaaatcgcacgctgaattttacaaaggtgtaaaatcgcacgctgactcctgagacgttccaagcgtcccgaaagtgtataatcgcacgctgaattttacatttttggtgtcttgatttcttgatgaatttcggtctaatatattcagagagatttacaagtagggcaatttgatggatatactgccaacgttgctttcatatagtgaagaaaagacaaggttatatagaaatttcttgtaaactatatatggtttatagtagagaagtgtgtttccgaaaacgagggaatagctaagtctattgacggaatcgaaaggcaaaaacagtcgtcgtccattcgtaatcgttggctgacgaatgaactcattgcattgtttaatagcttggcttcggtgcaactacatgcgtcagttgattttttttttccttctagcatcaatgcctgtattgtgatggaatcgattctaagcacagcacttctaacatcagtgaaatgcagcactagactagctaggctaggctaacgccgtaggatgataatgtggatttgggtttggtctgaatctggataggctgttcgacgcagctcaatatcgtaatggatggatgggagaggaatgcatcgtatggtagttgaatccatctttgaagcataaaaacacaagaatgaggtggaactggcttcaaggaatctttgcttctccctctattccaaactataataacttctagagttcaaactttataccaaatatagcaacacaatacttgtaaaaggtgattttaaccattaaattacccataat

SEQ ID NO: 41326 - DNA, 4617 bp, Oryza sativa
tgttgccagaccagatgatcaaaaacatgattgtgccactcaagcactcaaattagatcagcaacattcattggcatttcatcaatctgtgtgctgtagtactgctcaatatctctcaggatacggatgtcttcctttttgacaaaattgatggccacaccctacaatatgaaatgattatttagtcattagaatctgcccaatcaaactgttacctatatagtatgcagtcagctagctcgtgataataatcatttcttatggctggatgcatggagatgtattgaaatcatctttcctaaacttccaaaaaaaattggaattcagagagtaaatattgtttaatcatttctagaatctaaagataatgtgatgaactgttgggtgtttggttggtagccacacttagccacatctttggcaaggaggtttaccaacttagcctagtgtttggcttgccacaaaaacatatccattaacccgcatgtcgtatacagaaactttaacaagttttacctaaatcatggccagcaatttgttaaccacacattgtgtttgtgtcaacagtgtgaagtcagaattcctgtgttctaatttgtcatatactgacaacaaaaaaatgtcaaagcatttgatggattattattgatgatcattatcggtgaatgtgtgattgtgttgagcaaaaccatggtacatatgtattagtacaaatgtatcagtagaaagtgtagcatgcgtccaagcatttgatcccatttgattgagttgtgtaggtgtagcattaccttgcgaccaaaacgtccagagcgaccaatgcgatggatgtaaagttcacgattatttggaagatcatagtttatgacaagagagacctgaaaatgaaaataataatcaatactccacgcgcagtaaaatcaatagtcttcaaacaaaaatcacaacaatcttgcctgctgaacatccaggcctcgagcccacacatctgtcgtaattagaacacgggttgcaccagacctgaattcacccataatggcatccctttccttttgaggcatgtcaccatgcatagctgataccgtgaagttattgctgcgcattctttctgtaagccaatcaacctgaccaaaggaaaccaaggatataaaaaaaaaaacatcaataacaacaagtgggcatggttggaacacagtgcaattcaaaatagttaaaaaaaatagcatgattgttaagtcgtaaagttgagtcgaggtacccctggaccgacttgtcaacttggtcgaccagtccacaacttggtcatgcaaaaacagggtgcaattactaccattatactgtactaagcaacgtatatagtataaactatggagtatggagtagcaagtaataagacaaagtcaacaagaaataataaaactaaattactaaatataataagccaattagcatggtgaattgctgatttgctacgactcatcacgaataatctatgaccgcctttacgactaatctacaactaacaacaactaatcgcacaacttgctatttggtggagccatggttctctagtctagtcgactagcttgaccaactttacgacaaatctacggctaatcacgactagtcgagcgacttgataacagtgaaacatagcaaactaaaagtatcaactcgtgcaggattgtacaaacaagtaaagtttcaagagacatgctgtaatagcaactgcccagatggcaaaaaacaaaaggtgtttgaaagaactacaaaggagctatgaccataagatagcacaacaatttggtgtagacaaacaacactgaaaggatcaaaaaaaaaaaaagagcaccatatattacctttctcttcgtgttgcagaaaatgacagcttgggtgattgtcagtgtatcataaagatcacaaagagtatcaaacttccattcttctttctcaacagcaacaaagaattgtttgatgccctataaacatgatatgaaaaaatgaacatattaaaaccaacaaagtaaaatacataatgaagatcatcaagtttgtttgataagcaaaacaagtaatgatgttttacctctagggtcaattcatcacgctttacaaggatccggactgggtcagtcatgaacttgctggtcatttccaagatctcatgtggcagagttgcggagatcaagcaaacctgtaaaaatgaaaaagatgtgctggtagattagtattgggatatgactacccaggatatgccatcagttattgacatcaagttcaagcactatgccatcagaaaacaagtcatgcattacagaatccaaacagatacaaggcagcttagtctgttcgtatgatgacacgttacaagaaaccatcaaaacatggacagaatagtgtaacacaaactgcaatagagatggaaaatgctctccctatcccaaaatatgaggacttataagttaggcatgagtattaaggagaagtctaaaataaaatgagggatggttgtgattggtttagacagggaagtaggtcaagatattaaatgctccctctgtcccaaaataaggacttttagagtcaggcgcgggtattatggagaagtctaaaataaaatgaaggatggttggaaggatggttgtgataggttgagacagggaagtaggtgaagaaattaagtggaagatgattgtgattggttgagacaaggtagtaggaaaggtagctatattttgggacaattttaatgctaaaggtagctatattttgggacgagggagtagatgttagatgttatagactagtgaggagctaaatttaaaagaatcaattcactgaggggtgaacattgaaacacaagacaaactatcagtctagtacagttttaatctgtgattgacctggagctctgggggtagatatctgtagacatcatatatctgatccttaaagcctctgcccaacatctcatcggcttcatcctgtaattgaagaatgttattctccaaccatttgatcaaaccaaaaaaaggttccataaaacaacatgagaaataaactaaccagaattaggagcttaatggctcttgtacgcaaggtccttctcttgatcatatcacagactctgccaggtgttcctgacacaacatgcactccatgctcaagctttctaatatcctcaccaatacttttgccaccaatacaagcatgcacttggatattgatgtaatcaccaatggccagcataactctttctgtttgtgcagcaagttctctagttggtgagagtatcaaggcctgaaccctttaaaatgaagaaacaatattaactaccaacagacataacgattaatggaacatagaaaatgacagggaataatcattaataagtagaacaaggcatagaaaaattcatataattaacatggatgccatcactacattatacaatacctagtttctttttctttcaaaaaatataaattcctagccctaattattagccgacgaaagatcaggaaagaaaatattatagcaatagcaatatataaggtaaaaaacagataaaaacatgagccttgacatagaaagtcagaatacaaattgcggtgccctgaatcaaatagctcggaggccaagtcacaaccatagcaaatctacacaaacgtcgagagttgcagtaaggaataaaaatgaatcctatccagacatttatttaggtcctaattactgcactgtacctaacagctaatctgaagtaaaataaatcgcgcattcggaaaagggcgcaaacaagtaaaatgtctggcagctagtagtgaaaaagatgggggtagtaagagtaagaggaggcgtactctcggacggcggtgtcgacgatctggcagacggagagcgagatcatggaggtcttgccggttccggactgggcctgggcgatgacgtcgcggccgctgatgatggggaggacggcgcgctgctggatggcggagggcttctcgaagccgtaggcgtagatgccgcggaggaggtcctcgcggatccccatctggtcgaagctgctgatgacctcgaccccgggggaggtctcgaaggtgaggttctcgtcgtccatggcgccggggccgcgccggacgtggtggccgccgccattgggggagacgaagcgaaaccctagaaaggggaaggagatgggggtggtcgtcgtgggtggggagacttcctgcctgtggatgctaccgctgtcagtatgttttaatccgccgttccgttggataggtcggtttggtcccatttctgagttgggctgcgccaccccaatggcccatgccttacttggtgtcatctcgactgggccttgcctacggttacaattcagccctgctcggcccactaacgtaaccttcttggaataagttcacttcaggtccctcagtttgacgtcgagttcgaataatatcctcaaaccacaataccaagtgcctgttcactttgatgaaaaaaaaaaccttaccaaattttggcaacttcttatataattaccaaaatttggtagcaaactaaatgtagccactttttttaaccaaaatttggtaaggttgaaaatggcatcaa

SEQ ID NO: 41327 - DNA, 9860 bp, Oryza sativa
  unsure (1)..(9860): unsure at all n locations
cgacccgcatgtcagtcgaagcatgaataacctgttgagatggttcactttcggcggcagcatgcttaggacgtcaagcctcgcgagcgctgggagcgcggcggcgtcgaacgggccaaaaaccttgagccatgctgcatgatccgacctcccgcacatgagtctcgccggcctccccacctcctccaccccagtgtcagcgtcgaggatgccgcataacatgatgtcgtgcactcgtgtgcccgtacattgacacactaggatttggcgacagagatgaaccgaagctcgtccggtatcttcaccccacaggcgtggcaatgcacatatggcttgagaaggaggacggagagggacctcctgtcctaccgctcgtcgaggtcaagctctgcgtggatcttgccacctcgagggccacggtggctaggccaccaatggagattgggggcagggatggtacagtggagattggggacaggggcagcgaggtggaggttgggatgtaggcggcgtggcacggtgagttggaggttgggggcaccagcatagttgtcaaggccaaatctagtctggcgtggtcgtcgccgcgttgcggccctccctcccctcatcttcactgctttactatgagcctgctgaggatgttagcggggtgaactcgtggagaccaagaatgaaaccagcgagctcgcagaggacaccggtgaatccggcaagcgtcagagaagggaggagagggatcaagaacattgaacgttgcgccgccgccgctagctccaaccttgcagcgttgcctccacactgccgccgctgatgaagatgccacatcgttgctcctgccctcctctcgcccgacgaccgcctccatgatgtcctctttttggttttgtctttttttttttggctaagagaaaggaaggagagatatgacatgtgagcctaatatcatcattattgttattaagctgactggatcgtcacgtaggagcaaaacctctccagattgagttaggagataattcgaccggtttaaaaagtttgagatgtaaaatgtatggttctgtattttagtaggtaattcgtactgtcgtaattttctgggggtaatttggacttttccgaccacaattggtagcagcaggatcgatcgagtccccagtggctatgatcgcaactttgtgcttgactgcggtgaaggcaagtctggtttgtgcccttcggtggaagtaaactgatggaccgtacccttccagcttgagggtccttcacatttgggcagatgctcctggtcctggagtgcagttctgttctatacatggcatttgtctacgggaagcactctgcactccctctgtcttcccaaacgctgtgaaccagcctcggtggtcgttcaccctggtgacaaacgcttctagtcatatgatgctgcttgagttctcaacaaaacgatccagttcttgtagatatacgttcttgtctttcggcctttttttttttgcgaggttgatgcaatggtagttatatactgatttcatagggttagataacagtgtagcaaagttagggagcttacgacctacgtacacaagatttccctgtgtctgctcaatgtacataaaaaaaataaaaaaacaaatgcattgtaatttgatgaagtggatggtaagtgcataatgcattaggatttgctaaaattaaaggtattctagccttttaaactttggattgatttgtatatcatgagataaaaatgaagtcttttgatacggaggtagtgctaagcttacttaattttagaattaatttaggtttcttaattgttttctagcttttaaccttgaattttgatccgctaaaaagagaagtagaaaagtgttactccctccatcctaaaatataaggattttaagttggatgtaacatattctaggactatcaatccggataatttttttttcatattcatagtcctagaatatatcaaatcaattccatctaaaatcaggacggagagagtactctaaaattgtcttttcaagctttgttcacattcataaaaaataccttccaatcgagaaaatggacatttggctactttcaaaacatggtttcgctaaaatgtcatctcgaaaacgcgtttcgttaaaataccaatatggagcgcgtgctcaccgccactttgccatcttggccgttttgtgtattttcgaaatcatcttcgctcctccatcgagtgacgagacaaaattgtccttcatgtcctccgctaccgcctcgtaccacgagcagctcactgtcttcctcctcgtcctcctccatggatggcgtccggagcggtgctatctgggagagcccagacggcgagtcctctgacatcttcccctccctcgacctcaccacctccaccgactaccttgccgcggttgacgacggcatcccggaggtcgctgactacctcgccgcagtcgacgacgacggctagggtttcgaggcggccccatggcctcgcaggcctccgcaaccacgaggcctccttgacgacctcgcctccgcctccgcctcatcggtgctgtctggcggcaacgggcaggggcagtcgccggtggttccatcgctccgtccacccgcgcacccgcaggtgcgcctcgcttcgccatacccccagatgccctcgctggcagtggcgatgggctcatccggcggcgctgccagggctgccgccacggaaggggaaggatggaagggcaatttcgtcaaatcacccaccgaagaagcaaaaatgatttcgaaaatgcacaaaacggccaaaatggcaaagtggcggtgagcatgtgtttcatattggcattttaacgaaacacatttttggatgatattctaacgaaaccgtatttttttgaacatggccaaatgtccattttctcgcttccaatcaggccctctgcactaccagtctgttagcatcgtttatgtccatgttggaaaaagcgcttagaaagcgactctatggagaagcaagcagacttatttttctcttagggggtgtttggatccggaggtgtaaagttttaacgtgtcacatcggatattatatagggtgtcacatggggtgttcgggcactaataaaaaataattacagaatctaccaataaaccacgagacgaatttattaagcctaattaatccatcattagcaaatatttattgtagcaccacattatcaaatcatggagcaattaggtttaaaagatttgtatagcaaattagtcgcaatctgtgcaattagttgttttagcctatattttatactttatgcaggtgttcaaacgttcgatgtggtagggtgtaaagtttttgtatgggatctaaacaggcctttagtaacacagttgatataaaatatttattaaatgtttttcatagttgcgttgtctcatggttgctaatgactagcaggtagtgtttcacaactatattttgtctaactcttaattacatggcccacatgttataaactctattttttttgcctaactttattttagtttagtttatcattttgtttaccacaaaagtatgacaagactaagcttaaccaccttagtaaaaaatatgtggtaccatcagttatcaaccaaacatgcccaagttcaacgctgtccttttcaccttgttattttagttgccatgcctaatcttgtttcttgatttatttttttttcagaagactagtttgcagatctaaaaacggaaattaggtttgttctttgccttgtacgcgctgccaattaacatagcctatcaaaattttgcatactgtattgtctgcatcactgaaatttgcaattttgtgctatacactagctaggagttagatagtattaattctatcagtagtcttttcttaggaccaaataatccacttcaataattaaagtagtaattctgccagatggcacacatgtcattacacagttttgaccctgaacaaaaatcaaagaaagaagacgaaagatgagagcaggacgaacatgcattaggtaccctgacattctgttcttctccagatctgatctgatatgatgcaaatggcctgcacgaaaatgcgtattattgaggaagagaatggccctcatcttgccccagatgctggtacctgaccctggcggcgccggtggcctccgccacctccgccgacgagcaaatgctgggcaagaataagtaggcccgccgcccgcgccctccttcaacggcggccggaccttgctcctggtcctggggctccccacgctgccggtggcggcggcggcttgcttgcttgctgctgctgctcatgttcttgccgtggtcgtggctgacgacggcgacctccatccttcggaagtactcgacctcgcggcacaccagcgagccgatggtgccctgcgcgccgacctccaccggcgccgacgccgccatgcccggagggtagtggtactatgatgtcatcagatgggaagagagatctgagtggatgaggattgtacagggtttagaaaacaggacttcccatacgagaatcctgattcgcgcacccctggcccatacagcccacgcggcgcgcgagattttttcttcgctaaccatcgccgttttcttttttatcgctttccttttttttctgttttttccagattactttttaatcttccagcagcaagtgttttcaatttttttttgaaagtttttaaatcttgacttgaaagtttttaaatcttaatttaaaaatttttaaatatcgagttgaaagttttcaaatttcgagttgaaagttttcaaatccgagttgaaagtttcaaatcttgagttgaaagttttcaaatctgggttgaaagttttcaaagttgagttgaaagtttttcaaatttgacttaaaaaatttaaattttgagttgaaagttttcaaatctgggtttaaaattttgaaactgtgacttcatatgtagatttctttttaatttgttagttaaaaaaatctcacataaaaaataaaatcttatctactactacctacgccccaaaatatagcaattattagctatgaatctagacacctgtgtgtccagatttatagctacaaatgcttatattttgggacggagtaacatcattatcataaactgttattatctaatatactagtagattagtatttttttagagaagggtattttttacccggcctctacatccaactaatatactagtagattagtatttttttagagaatggtattttttttcccggcctctacatctaaccggatatatgcggtcattaaaattaggaacttagccccgcaaacaacccaatctaaaattcgctcatatgaaaatttgaactcaggaccttggggtactactcaggtgactgcaaccaccaggctacatgccctatcgtagtagtagattagtagaactacttaggccgaaaaaacgagcgacggcggcgcgtacgcgtcaggtagccccttcccctaaccgggcaaaaagaaacggttttgctaaaaaccgtcccaagaaaattagggaggaggacaatttcgaattttggaccgccggatatgcatcaatattcatgattaggagaggaagaaaatgtcacaagttttctctccatgcggacagcagtgttagaattcacgttgtcaacaatcaaacaagcacacacgaacacacggacacgaaagtgaagggcaatcaactttattgatgtttctctctctgttacaagtattactttgccctcaacctcactattgtatttatacccacaataggatgtcctatatggatacatacatatatatttggtataagcccacttcattaataaggaaacagaagaatagaaggaggaggtaccgtgatcctcatgatcacggtcctataaatccgactccttcgggagatcagtttcataacactcccccttgggtgaataccgtgctatacatatgcctcatcaaaactccttccaaaaacccagtgggagaaaaatgaataggagaaagagtacatagtacacgctacttatattgcactgttgcctcattaaaaacctaaatgtgagaaacttcaaacaaaactcactaaagggaaaaagagtacaaccataagctaatctactggataactctatcattcttcaaggataactctatcattcttcaagaatgatgtactgatctgcatgatcaatatcaacggaacacagtcagggaagtgctcccccgatttgtgcacatctctcatcctcctcataccgatgccatgcacaagcttctcaaaaacactaattggcaaagacttagtaaataaatctgtgagattttcactagtcttggtgagagtcaccttaatttcttctttcttttgcaattcatgcatatagaagaatttaggcgatatatgttttgtgagactcgtcttcacataacccgtttgtatttgtgcaacacaagctgaattatcttcaaaaataatggttggagttggtgtgatattcagcccacatgtattctgtacatgttgtatcaccctcctcaaccacatgcattccttgctcgcttcaaataatgctataatctccaagtgatttgttgatgtcgcgaccatcgtctgcttcgtcgacttccatgagatggctgtaccaccacagagaaacacatacccagtctgtgacaatgctttatgggggtctgacaaatatccagcatcagcatatcccaccatggtcaaatcttgattttttctaaagaataaaccgagatcttgtgtgccacgtaaataacggaagatttgcttaacgccattcaaatgccgtttggtaggagccaaactgaaccttgcaagtaggttaacagcaaatgcaatatcaggcctggtaccattcgcgagatacattaaagctccaatagcgcttaaatatggacattcaggtcccaataattcctcgttattttcctatggtctaaatgggtcactctctactgctagagatcttactaccatgggggttctcgtcggatataaatccttcatattaaatttctccattatcttctggatatatgcagactggtgtaacaataccccttcatgagtgtgctcaagctgcagacctaagcaatatttagtcttacctaattctttcatctcgaactccgtctttaggtaagaactagcttccttaatcacctgtgtggtcccgatgatattcagatcatccacatatacagaaataatacaaaatccatgttctgatttttttgataaacacacagggacagtcatcattcttgatgaatccttttccttctaggaattcactgagccggttgtaccacatcctaccggattgttttaacccatacaatgatctttgcaatttaacactgtatatgttgtgtttttttcttcaggaacttgaatcccatcaggaactttcatatagatttcaaaatccaatgacccatataaatatgcggtcactacatccatcaactgtatttctaagttcaaattgactgccatagatattaagaaccggaatgtaattccatccattacaggtgaattggtttcatcgaaatcgatgccaggtctctgcgtaaacccttatgctactaatcttgctttataccgaaccacctggttgttctcatcccgttttcggacgaacacccatttatatcctacagaggatatccctacgggggtacgatcaataggaccgaataattttcttttattgagcgagattaactctgcctttattgcttctttccatttgacccagtctgaacgcttttttgcattctgccatggactttggttctggatccagatcaatgatcttagcgatcttttcggcaaagtatatgtcgacaatagtagtctctctattgtatgtttcacctgtatccacataactggtggatatttcctctattctttcacattcctgatcttcattgtttcccgcaatgtttaagtcaggaatttccggtctcctagtgctagtagtaattgcgcgcgcattctcactgggttcattgccatccgggcatgtcactgcaggtggctcatctacctggtgagctccttcactattctctggtgctgtggtattctgtccaatctgttgtttcgtaggacgtctcctagaaactttagtttggttgtgtgcaaccggtggtctccccttcttcctagaagttggggtagatgtagaaattaatttgaaaaccagttcctctgcgtcaggaggtatttctactctttccggtgcattcacagcaggtatatgagatttcatgatcccctttaggttagtgaaggcttctggcagattatttgtaattctttgcgaatcaattatggtctaaacttcctggtcagattccttagtacgtggatctaaatgtaggagatttttagtttcccactcaatttcgcggcattcgaccttctgtaggtactttcctccccctaatgccgggaaatgatcttcattaaatatacaatcagcgtatcgacccatatgtaggtctcctgtcaatggttctaaaaatttaatgatagacggagattcaaatcttacatagattcccaattttctatgaggacccattgacgtacgcttaggtggcggtatagggacgtatacagcacatccaaatttgcgtagatgggaaatatttggtgcatatccacgtgtaagctacataggggatacaacattgtatgcagtaggtctgatttgaagtaacgccgctgcatgcaaaacagtgtgtccccaacatgtagttggtaggttgctatgcagtagcaatggcctagcgataagcttaatcctcttaattaatgattcggcgagaccattctgagtgtggacgtgtggtacagaatgttccactttaattcccaaagccatgcaatattcattaaataccttagaggtaaactccccggcattgtccattctaatggattgtatccggttacccgggaaactggctctcaactggattatttgggaaataagccgcgcaaaagcgtggtttctagtagaaagtaagcaaaaagtgctccatcgagttgatgcatcaattaataccataaaataccggaatgatccggacatgggattaattggtccacatatgtctccctgtatttgttgcaagaatactggtgattctgcgttcacctttagattagagggtctaacgattaatttccatgttgcacaatcagtgcaaacaaaatcttcttggtttgggaaatcgttaggtcgtaaattatagccatttgaagttgagatgattcttctcatcatccctagacctggatgtcctaacctatcatgccatattctgtatgactcgggatttttaaatattgttttcagtgcaacattttcgggttttatatgagtgtagtacaggccagatttcaaggaagggagtttttcaacaatagtcttacgatttccgtctaatttcgttatgagaagaaattcgagtttattctcatctttggtttctacatgataaccattagcacggatatctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41328 - DNA, 888 bp, Oryza sativa
ctatttaaaagatccatacctttagcctttaagcctttagcagttgcagttcaatatgaggcacctttagcctttagcatccatagttcaaagatcctgcacaaaggggtgctgtcatattcccatttatcattatttttcccataaattcataactatacatcgcattaatacggtgataggtggcgatgtcatcatttgatcctgatctatctcttgaggttttggatcatccaatactggatttcttttactatatggtaagtaccatcaaaagctcattgtccctaattctgccccttgtatattctaatacattatttcctgctacagttaacggagatactgccctctgctcttgtcctattcatcctccgtaagcttccaccgaaacgagtatcagcacagtaccaccctattcgttagaagggctggttttgtcgtcacaagcattccaaaaacttgtttcagagcgagaattgtgatatttgagctgagcttcaagtagttttgatgggtcatctatgtcatgcttctgatgtggaagaggtttttttgtcctctcctgacccatttttctgggctttatatttcttgagaccagaatattatcagatgatttatactttgttctgcctaacaaaacttaccgttgggagttaattacatcagtaacttataaatttgaataggtgatgttgataaaatcaggttgtgcgtgatctttcacaaacggatgagcattgttgtgatttaagtcggctcctacttaaatataggtcatatctccacccctatagaacgccaataaccgatgtcttgttgatccgtgtgctgaaagcagaaggtggttgtaatgcgttgtaattggtgggacgtgatcagatg

SEQ ID NO: 41329 - DNA, 873 bp, Oryza sativa
gcctcgtctcctcaagatcccttcgcttccgcgtcttgtgcgcggtaactcgctcgctagtgatgcaatgcagatggcctttaatttctttcattctttctttgcctgaatgttcaatgatgcaatgcaacgggcctttctttctttatctaaatgttaacgatacaatacaatgggcatttctttctctgtctgaatgttcaatgatgcaatgcaatggcctttctttctttgtctgaatgttaacgatgcaatgcaacgggcatttctttctttgtctgaatgttcaatgatgcaatgcaatgtgcctttctttctttgtctgaatgttaactatgcaatgcaatggggcatttctattgtgttgtctgaatgtttttctgaacctgacgagattttaggcgaaggcggagacggtggggaaggtgatgcagatagtgaagcagcagctggcgctgggggaggaggcgaagctggcgccggagtcgcagttcacggagctgggagcggactcgctggacacggtggagatcgtgatggcgctggaggaggagttcgggatcaccgtggaggaggacaacgcccagagcatcaccaccatccaggacgccgccgacctcatcgacaagctcgtcgccgtcggcggcggcaagcccccccccgccgcctgaatctgatcttcttcttcttcttcttcttgctctgaaaccatcgccacttctgtttgatgaagaagagacgtcagtctagctagctcgagtagcacatttgtcatcagagagaagttgattctttgcgcttctagtcatcgatcggtgtgtatttgcgtgtaatttcgaacaattttgtcacttaggttgctcgattgattgc

SEQ ID NO: 41330 - DNA, 1204 bp, Oryza sativa
  unsure (1)..(1204): unsure at all n locations
cgcataaaacaatcacaaatcagaatggagaaaccagaactaatattttctgttcaatcctagtacatgttagtgccacaaaatcctacacctaaactgaacaagcgcaatgcagaagcatggaatatgctagggagggaagccaaagaaggcgctcacccgacagaccagtgcggccgtggcgcgggcgcggtcaagcggggacgcgtacgcggcggcgaggcgcgcgccgcgggatcgcaggaacacggcgagcgcgcgggcctgcctctccccgcgcgccgtgagcgccgcggcgggccaccgcccgccgacgaggtcggggcgcatcgccgcggcgcactccccgtggctgaccaccaccacctccagcgcggcggcggcctcggccccggccccggcccgcgccgactgggactggtgcggcgacggcggggggaggagaacgtggcacgggtcccacaccttgatggtggggcccgcggcgagcaggcgcggcgtccccgcggcggagggctgcggcgagaacggcgagtcggcggcgcggcaggggagctcctcgggctcctgctcgagcaccttggacgcggacgccgggggagccggcgcgggcgccggaggggccggagccgcggcggacgcggccgatggctcgtcgtcgtcgtcctcgtccatgtcggcggccgtggacaccgaggagtgggaggagtgggcggagcccatggcggcggcggcggcggcgggcggcggcgggatctgagtgcgagatgggggagtgaagagctgaacaaacaaaagtctggtcggatttttctccggcgctgcgcacgttgagattggtgctggatcgatgaaggtacacgagaaataagttcaccgaggtcccttaacttatcgatgaatccgattttcaaccaagatacaacggatcccttgactgtccctcagcagtttggatggcggttttagctgacgtggcgtttaccagctaatttgactcggtcttggcattgacgtggtgcttacgcggcaattcggtatagaaaaataataaaccctgtgggacccacatgtcagtttcacaccaaaattaataaaaagaggcggggcccacgtgccattcccactccacctccccctnnnnnnnnnnnnnnnnnnnnnnnnnnnnnnnnnnnnnnnnnnnnnnnnnnnnnnnnnnnnnnnn

SEQ ID NO: 41331 - DNA, 900 bp, Oryza sativa
  unsure (1)..(900): unsure at all n locations
gtgaagtagatgttgatgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgggataggattaccacagcagcaacagcgttggaaaatggatgaaagtgtgtctcacaattctcgcgggagatcaaatccattctcattntataagaggaatgaagatgaagagtaggagtcatggaatagaaagaggaatagagcactaatttgtcatcaactagccatgaaccatcctcactacacaaccatcaaccaacaatcaattaggagtaattgatgtaagttaccaatggaataggaagaggaatagagcaactaattgtcatcaactagccatgaaccatcctccactacacaaccatcgaccatccatcaattaggactaattgatataagttaccaattccctaaacaaatggattaattctcaaaacttttcatcctattgatatcctataaaagaatgaatacacatgaattcctagcataatgaaccttggaatttatttgatttaattgatttaaatggatcaattacccaattaaatctaacagaatcaagtgaataaacaaattttcgtcgcaacacaaatgtcatatcttcccatgtctgacaagggtcatccacatgaagccaccatagcaaaacatctttatcaaatgtctcttctgcataatacatctttacgactgattgaaaaccacggccctcaaaaaaattctccatcgcatcttgccaatcaaaatactcacgaggacatgtttctagagatagctttggcatacatttcattttcttgagcaaaggaaaatgat

SEQ ID NO: 41332 - DNA, 875 bp, Oryza sativa
  unsure (1)..(875): unsure at all n locations
agtcagacgggagccactaacaagattcctgtcgatagaagggacatgctgcacgttctttagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtatattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgatgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcccgtttgactacagaacggttgtcagccatcttgtagtcatgaaactgnnnnnnnnnnnnnnnnnnnnnnnnnnnnnnnnnnnnnnnnnnnnnnnnnnnnnnnnnnnnnnnnnnnn

SEQ ID NO: 41333 - DNA, 1353 bp, Oryza sativa
  unsure (1)..(1353): unsure at all n locations
attgagtggtttcccataccacacaaatgaggctttaaggcctgacccttgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacataagtaaatatttcttatctttgtttgctttcattgtcaatgttcaattttgtaccatttaacccttgtcgatgctcactactatttcatcaccttctacttgtctaggtatgacagggtgagaacaaagaaggtgaaagactgggggctagagcataatagatacattgatgaatggagaacagccggaaggaacgataggtacatcgaaactatacaccaaaatcatcttttctcagagtaccttcgttggctgcataggacatatagactgttcctccgccctacttggacggaagccgacatagaggatgaccgcgactccgatgaggggcggaattcctatgatgtccggactagagttggatatcaaatggagcacgccccacttagagacagagtcgtaagttttcttgcatttatcaaagttacttacatttgcaccctagaccctaacatatatcttttcaagctttcagtcgagagagctcctcaggagtgtgaatgaaatggggcatgccctccaagctccgaggggtggtgaggacatggagaacacgctccgcaatgttttagaggtaaaatttatttagcactttgcattacttgagttattcctaacaaacttcttttttttttgaaatgcagaaagttcgtcaaaggtgccggaaacttgcagcaagattaggttgcaggtcggttggattggacgacgtgtaccaaccggggagactaccaccaccactacctcaatccgcgcgtccaagtactgctcgacactccatcaggatagaagagcgtgaaggagttggtggctcgtcgtcgtcacgcattaagcaagggaggggaaaggggaaggcgccggctccacctagcgacgacgatgacgatgaggacgaggaggatgaggactacgtcgcaccagacgccgaggagatagacatgtcacagcttcccgacgcgcctcaggggacgcaacccacgcaatacaacttgcgatccactcgggcagcgaaaaagaggtaaaatgagcttaccattctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41334 - DNA, 3839 bp, Oryza sativa
  unsure (1)..(3839): unsure at all n locations
attaaattgtgtttgttgtggggccagactctcacagagtcatcaatgatcaccgctgcagattccatccccaacaccccatcaagatctttactttttggcactcgctcatcactgtcaaaaggatcaccatcatcgcctcttgagataacacgcccagcaaacagggttccagtaggatcaagaaccttagccatctcagtagcataaaccttgttgcccattgtgtacagatgcaactcataaagtttacttgcctacagcataagtaccaaacaggacaatattcaactctacagtggaaagatgcttatggtcatttgagagatatccaagatagcaaaccttctcaagaaagttccatattccaggtctcagtttggtccacattcccatatgattaaaacagaagagatggcgctctgccctctctcgatcttgttcctctttctttcgtaaaatttccccgtgaatatggtccacttctataaactgaacaggaagcatgtagtgtgttaacaaagtttcaaaaagtaaagttataggatacaaaaccaaatacctttgcagaattgaggagcgtgtgatccaaatcaagcaccaagcaaagtttccgtgctgcaaacatcttgtgttgttccttgatccgccttgccctttccttctgaatgagagccttctgctgatcatcataaccatcaaggagatgatcaacatctccatatgggctagcaggcggcacagcatcaggtgctgttacaggaccagtacttgttgcagcatcatcattagattcattctgtccagcagctaatcttggatctgccttatttacactacttgaagtttgctttgtattgccatgaggaggcataagtgctgtagcagctaactgtgaatttgagacaggatttgcattcatggtgactggccgtgctgatgatgtaacaggtagagaaggcaatgcaatagcctgaagttgctctgccttttggtcttggttgagcaaatggtccttgctgctctgagagtctggcggagcagttccattgcttttggcttgctcaacaccaactggaggagctgtatcgttcttctgcactatgttcctatggagtatgcgacgaggatcacgtggtttcatacgtatagctccagtatcattttgtgagtgctacacaaaaaagcatttttaaacataatattagtacgagatcctaaatattataacaaaaggatttggaattggcattagtaacacggtggttcaccgtggtatgacgcacaagctaatacgacctactcataataaaaacttagttttacctcatttatgtcccttgatatgcatataatatatatacttctataaaaagagttggcaataatgcaatatgatcactgtctccacacaacaaattgagttggtggattctgttaatggatttttgcgtgggcatctcaaaagttctccatgactcattgacgagacaaaaactatgcatgcaagtgtttaatataaactttgtggatgcagttttttctaacttatggcatgtttatttgagatcttttgcaaacttgcaaagcacatgccattaacatcatatggtatataaaattgtatttgaacccattaggaagcaaacagataaattgtaagtacaaacagaaaacacaggtgcactagtaagagagttaccatgggagctgactgcattggaacttgtggtctaacagaagggactgctgcaacttctgtggtctttggagcattggcaagtggtaaaaccatgccaggagttacattactagtcatgccaacagaagcagttaccttctgctgaggttctgatgctgacatcttctgctgttccatttgaatccattgcatgagcattgttggattgacagcaatgtcttttaacatagcaggcaatgaaacagcaggagcagaactggtttgcggagctgaattagtttggggtgcttgtacaattccaggactagttccactattatttgtcgtattatttaagttactagcaagtgtactatctgtcctgatattatgatttccagttgtgttatttccaagtcttgtattttgatttggctgaaacccatcactagaatatgagctaatattacctccatctttagcccacccacctcgacctgtaggttgcatatctctcaggttgccaatgacacccctagatctttttaacgcgttctcatccaccataggttcatcaactgccttattcttacggctattgattgatactccaccacccatggtcctatctttagaaggatttggttctgcaaaattcacacgtcggtttgcatctgcaacaccaccagtatcacgatttaaaaacttaagccttggatctctacttttagctgtagcttttagcaggtggttggatcctgaaacagagttttcaatctgtttagcataacctggtggaccacctgcaaaactgtcactgttgctgctaactgtgctaggtcgagagggcatctgattcacaattggcaacgcaatcttgtttgaagcagaaaagctcgaaacttcaccaaatacatcaccccctttgtctccagatttatctccatcaccagaaggagttggacttggtagatcatcgcttgcaaagttagacttctgcccatgcttctgttggtaatagcaaacagccttcagtgcatcgttaaaggattgatacgaagaattcttcgcaggctcaactctttctagaaccgatggtctgtcaggtgccattggaagtgctccatatccaatgggctttggcacatcaaaaggtggtttactatctcgagttggtgagggtaagctgttttcgtcataatctgcatgaagatccaacaaggggctaaccattctattctttgctggtatttcaaccttgctaaatgaatttcctgctcctgattcaaatggtagtctctctgataaaacctgaccagatggagctgcagcattagttgaagtggcatttggaccatttgcattgtcttttccatcctcaaacactaactgcctcacacggctatccagctgacacaaagcaaaagaaaaataaatgagcatgctaccacagccaaaattaataatggcagactctaaaaccacaaagtacaaggtttacaaacctcatctcgttggtcaggtgttagcatgtctgaatatctgttttttatgtggaataacaacctacacattcagacgagaacattttagtttatgctgcaaagaacacatagcacattagttctcaatgtgattagaaaaggatgaacttatattacttaagaagcatgttcttggtctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41335 - DNA, 3203 bp, Oryza sativa
  unsure (1)..(3203): unsure at all n locations
gcgtcggtcatatgcatatacacctcgaccagacgattgccaagaacgctaagaatgcatcccacaaagagagtagtggcttcctcgaattgcttctgctgttcagcaataagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagaagaaaactagcatgaacgcatcattagatctatacatgtaaactacacagtataacatgaacagatcaaatatgcgcaacatattgaacacgtaccgagatgacggaaagaccggctgattggttgaaacttttcgcaggtgtctacgaaggcacgaaacacgcgagcgaagaggaaggcgagccgtcgcgaacaaacagggagcagtcgcgcgaagcgcttcccaaaaaccttattgccgccttctcccggtgcangacgtcgaaggcagaggtttcggagacctgctcttccgatcgccggtgcacgccagcgagcgggatggagtagtctacgagcgacggcgcagtacagagtaggaggcaaaccctagattgatttcgcatatgttgcgtgaagacggcagatcggtttatatagagaagggtcgcttgattagggcgcccgcacgatctctactgcgcgtaaccgaaccggataagtcgcgcgtaacttatccggactccacgccgtttgcacgcaccggatttttcggaacgtttccaaaacaaaaacgaatctgaatttgcagcaaaacaaaactgcaaaaggaggctgcatctgcgcaagggtgaggagccaattttttggaccattcgacgcgtacgtcgtgcacgcgcggcccggtccggcccggcccggcccggcgaggcgagcgagcgcgcgcgtgttttcccttttctttccaccacacatgctttaagtggctaggagggcatccttccttttaaggaggtccccctctcctagaataagcaaggtgggactaaactccacatgcatgccaccccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcggatggagcgtataagtcatactcctaggtctttagtaagcttcctagaagattcacccaaaatcttcatagactgcgaccaacagtcaagctcacaaaggtgagttctttcaagaatgctctgcaggacaacatcttcgctaattaaagccaacataactcattaagacatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaagcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattctagttgattcctagcaattctcttgttcttgcgaagcaacaagctaggatcataaggtgttggagaaggcttactatcaatgtagccaaaacgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacaaaataactccctcacccccaccatggcgatagtacacacatttatctgcctcattgactacaaagcctgcagatgtcaatgttttgtcaaatttctcatgccattgcttaggagcttgtttcagaccatacaaagacttcaacaatttgcacactttgccttcttgaccttcaactacaaacccatcaggttgatacatatagatctcctcatccagctctccattaagaaaagctgtcttaacgtccatttgatgaacgagaagaccatgtgaggctgctagggaaagtagcacacgaattgtggtcaatctagcaacaggtgagtaagtgttaaagaaatcttcgccttctttccgagtatagcccttagcaacaagccgagccttgtacttttcaatnnnnnnnnnnnnnnnnnnnnnnnnnnnnnnnnnnnnnnn

SEQ ID NO: 41336 - DNA, 3228 bp, Oryza sativa
  unsure (1)..(3228): unsure at all n locations
gctcggtaccccatgaagaaaatcgtttagaacaatgtttaagttaaatcttgggaatataaatcatgaataactcccaagttgttgagtttgaaaatgtaaaaactatatgtatagatttgtctcgaaaaatactttcataaaaacatacatatatcattttttaataaatatttttatagaaataagaagtcaaaaatgtgttttggagatcgtgtcgctgtcctaaacgactttcttttttacgagtatagagggagtacgtgtacgacactgaccagctacgtacgtacgtacgtactcctgcatgcatgcactccctgtcgtcgtcttctcgatctggtcctcgatcatgcgaggcggtacgcggtagaagaagctactagctgagcttattggcggccgtacctctcctaatcgacgcgcatgcatcttaataaactactctctcctgtatgacgtcgttgacttttttataaacgtttgacctatcatcttattcaaaaaatttatgtaattataatttattttattgtgacttgatttatcatcaaatgttctttaagcatgacattagtatttttatatttgcataaaattttttataagatgagtggtcaaatgttggttaaaaagtcaacggcgtcatacgagggagtaatttgtctccaacgtagggggacacgcacaagtacagtagtacgccttccagtctcgccgccgccgccgtagttctcggccggcgaggtcgtcgatgtgggggggggggggggtcgggctcgggcaccggcgcgcgtgtaggcgtacgtcaggccagcctagctcgtcgcgcgcgacgtcgccgtggcggacgatcgagcacgatgcggccggcgagcaggtggtggcgcggcgccatatacaggtcgtgacgagctccagcaaaggaagcgttgcgcctgcctgcggctgcgagagagctcgctgtcgtaggtgggacgccgcgagcagcagcggatgacgatcgaggagcgcgcggtggcgccgacggtcacctttgtcgcagcagctccagacgatatactccctccatctcaaaatatttgacgcgttgatttttttaaaaatatttgaccgttcgctttattcaagaaatttaagtagttattaattcttttcctatcatttgatttattgttaaatatagttttatgtatacatatagttttacacatttcacaaaagtttttaataagacgaacggtcaaacatgtttaaaaaagttaacgatgtcaaacatttagggaaggaggtagtatatacttcctccgtcactaaatattttaacgccgttgactttttcaaaaatgtttaaccgcttatcttattcaaaaaagattaagcttttcctattatttgattcattgttaaatatatttttatgtatacatatagttttacatattttacaaaagttattgaataaaacgaacagtcaaacatatttaaaaaagtcaacaacaacatcgaatatttacgagctgagggagtatatccgataggtagaaccctagctgtgaattggatcgatcgctggcctggccttatcgtagttgtaacaactgtaatttctttatttttaattgaacactcactgacacgtgggtcccacatttttttaaagtttaagtgccctgtccatgccacgtcagtcaaaaccaccatccaaactatcttgggtttctatttacgttggttttgggagtcgagggatgcattatagtatctgatattgtgattcagggataaagtttagactcggcgataattttcagggatctaaagtgatctttgatttggttggtttgtggtggggtgttgcggctgactggtttatgggcggtaaggccatctccagtgtgacgcggaaagaaaccatgaggagaaattaatcaagagaagatagtgacgacacttaacaaaaaggtagcgatgccaattaccagaataggaacacaaaattttattgtggagatggcaatgatacggttggtgattgttcaacctcacctacactggacattgttaaggcatctcctcaatatttgttgtaaaactaagtgctaggatggactgtgtcagataataataacagattagagagataataatatatgcatgtgcaaaatgggtaggtgggatccacctaaaagaaatctctaaacatgaaatctaaagtgataacaaagatgtatttaatgattattatctgcaattccactgcattatgaataccctaagtgaaccaaaccatgtagtagtagatggacaatgtccaggcctatcttccagcctgtctcacttacacttttgcttcgcttttcttgttttgttccttgccatcacaacacaatatgtccatggttaatattggaccaatgctaacaagaagataattaataaggtttggcatcgttccatacaccacagttagtttctaatttatttttaaatcggaacaaacactctcaactatcgcaaaattccaaattacatctttaacaactgaaggtaaccttagtctacaaaatgcgtacaattttcatatcttcccctaccatccactgtagattatctaccctcaagaagttttgatggaactaatccaaggacaatgcacaaaaaatgataaattaaaatgaaaacagagtgatcggcaaaaagaatgatacattaaaaatgtatccccccttacatggaaattacacttgaccaaataatttagctcaagaaaaaaagaataataacaaatacaatacaacactatcacagggccagatcttcctggcatttagatatgtcagtaaatacaaatgaaatacaatcagaagactcccacttccgatggccttggcatctgatctgaggaatatgatctgatagtttctgtacaatgcacaaagagatacattcctctcgaacagcgtagcacaacagcttgcttgcatttagagaagtctgagatgagcagtatcattcagcctctttatttgccatcctgtttttagtgaatgctcaagaactgtaatggaggaatcttcaatgcaaattctctgggatatcataggattgcaatccagcacgccagcaacgaggcatcggatgggagttgcgtgactgaaaattgcaatgnnnnnnnnnnnnnnnnnnnnnnnnnnnnnnnnnnnnnnnnnnnnnnnnnnnnnnnnn

SEQ ID NO: 41337 - DNA, 1774 bp, Oryza sativa
atgtacttctccactctgattggacccatattttgttgaggggcttaagaagatagtgaagtacccccttatactgttcagacctgtaaaaggaacttaaaggtaaggaatcactttttgttatataaagtaaagtcattaccaatactcctaaataagtgacatattttccttacaaaaaatgatcgctgacttctataatatcatgttaatggaaaatattaagaattgaacaatatcattctcatttaggcaacctaatatattatacgtgtatcaatagctgattgctaaatatgaccacactttttttagaaaatcatgtatttatgaatagagtaacaaaatatagcaaaatatcaaatgatgtcataccttaaacaggatgttacaacatcaaatgcttcacataaaatattatattctgcaagaagtagacagcccttaacttgatggcaaggtactgcaccattgttgcactgcatcatcaatgagaagactttacagaaagaatatgcttgacagcacattattataatgcatgttaaaaaagaaaaaaaatacccgcattcttgggtgaattatatcatcgaatttatttgacatgttagtactatcagtgtcatcttgatggatcaaactactgcaatcaaaactgctcaattcctcacgcctgaattttagaagatgctgcaaatggagaaaaaaataccacatattaatgcccactatatatttatgttcatatagttcctgcaatagacattttacacatacaaagcattattaataaaagagaacattcatatagacctgaagcatcctagcaccatgacgctggacctcaggagggaaatcattgctgaccaacagaagagatgcatccaccaacaagtcgacatagcctttctctctctcttttacctatccgtagggatcaaacaagatcagtagttatatatatagtttggtagatagaaggaaacaaccaaagaatgagcaaaattttgaagcgtgcaaatccaatacactagtagattcttaaaactgtgctagagaaccaggagatgcataatctagtgctgcataaccacattattttgcccagcgttaagcgcgagaaggcaagagagatacgaaccggctccggctccaattcaacagggtaggaattcctggcgcaagtattgacactgctacaagcccaagccgcggcgggaccagcggcgaccgaacaagtgttcatcttctcagttagctagctgagaattgggggagaaaaagggaaaaactaggttactagacctagttggcggcggcgcggggcggagacggaaagagagagagaggctccacctgcggcggcggaaggccggcgcgcgtccaggcggcggggagagcgccggcgcgggggcccggtgcgtgggggattcggggcgtggggttagggggaacgaactagtacaagtcgacggggttggctgttgcgtgcgcacctctctttatagtctcctcgcgtagttgcgtacatacgttatacaaatactctacaatggttgtacgtagatatacaaagtatatgtgtgtatttatatatatattttttatgtataccaaaataaattgacgtatacacaatatacatatatacaaagtactccctcaaatatgaaattagcatcatatgaaagtattttaaaatatgaatatatatatatatatatatatatatatatatatatatatatatatatatatatatatatatatatat

SEQ ID NO: 41338 - DNA, 1549 bp, Oryza sativa
gacgccaggagcccccgacccccgggacggccccgaggccactgggggaaccccgcccctgtcatcctccgaccccgaggtcatcagcacagaagacgagtgcgccccacgaggccgcttggacgaagagcgccccggggatgcagcccctagcgaagaggatcggccccaccgaaaggtgcagcggcctgtctactttgttagtgaggccctccgggatgccaagacccgataccctcgagcctagaaactgctttacgctattctgatggcctcgaggaaactgcgccattatttccaggcgcatcgggttacggtggttacgtcttaccccctcggtcaaatcttgcataatcgagagggtacaggacgggtggtgaaatgggcgatcgaactttctgagtttgatttgcactttgaaccgcgccacgctatcaagagccaggccctcgccgactttgtggcagagtggaccccggctcccgagcccgtctcaatccccgaggccaactcgggcccctcgcagttgcctcacaccgcccactgggtgatgcagttcgacggctccctgtctcttcagggcgccggtgcaggagtcacgttgacctcgccgagcggagacgtcctcaaatacctggttcgccttgactttcgggcaaccaataatatggcagagtacgagggactccttgcgggactcagggtggcagctggactggggatccgccgcctcctggtgttaggcgactcccagctggtcgttaaccaagtctgtaaggagtaccggtgctctgacccgcagatggacgcctacgtgcgccaagtacggcgcatggagcgccattttgacgggattgagcttcggcatgtgcccagacgggataacatgattgccgacgaactctcacggctcgcgtcctcgcgagcccagaccccaccgggcgcctttgaagaaaggcttgcccagtcgtcggcgcgacccgaccccttaggggagacggacgcgcctgaccggcccccgaggcccgtcggagtccaggcctcgggacccgaggggagcactcccagcacccttagattgattgcttggatcgctgagattcaagcatacctcacagataagactctacccgaggaccgcgaagggagtgaacgcgtccatcgcatctccaaacgctacgtgctggtagatgggaccctctatcggcgcgcggcttatggaatcctcctgaagtgcattcctcggaaacaaggcgttatgcttcttgccgatatccatgaaggcgaatgcggagcccactccgtctcgcgcaccttggttggtaaagcctttcgccagggtttctattggccgacagctcccaatgatgcggtcgacctggtccggcgatgtaaagcgtgtcaattccacgccaagcaaatccatcagccggcccaggtcctgcagaccataccactttcgtggccatttgctgtctgggggctcgatatcctgggaccgtttaggcgggccccaggcgggtttgagtatctgtatgtcgcgatcgac

SEQ ID NO: 41339 - DNA, 711 bp, Oryza sativa
ggtagggctagagctggaaccgtgtcaaataaaccctaaaaatagaagaactgtatcttggaaatgctcggctggctaaaaaagattaggttgaaattcagtatatttttgagccaaaaatatttattggcaattgcaaaattaccgctactttgaatcattattgcaagactgctactaaaaaattataaaaataccactcgaactgtcattccagtggtatccttacaaaattgaaaaaaccgttggcaaatttgcaaatgtccccaattccgaatctgctttgtctacgaataaggaagctaaatgggttggtttgataagacccttttttgctttgttgataaataataaaaaaagagttttttttctataacatgcttgttttattataacaagttctatatgaaaatgcctgctaaagagaaaatctatctgattgtcttttagccaatatccaattttagaattagaaagaaaatgtaagaagtctccccacttcaattagtccccgtgttcttcgaatggatctcttaattgttgagagggttgcccaaatgcggtatataaggcatacccagtaaagcttatgagtaaaccagatatggagatggcgactaaagttgttgtttccatttttatagaatttctagattacaatggatctaaaaaagactgtgtatttacaactacaacagtacccatgtccag

SEQ ID NO: 41340 - DNA, 3011 bp, Oryza sativa
atataagtgaaacattatcacacaactcttctttatcacaaggaacagcaagtaaatcaacttgtgacaaaggcaactcagcaattgattccactaatggttgctctactatagcatgaaaagtggacaagtgtagctcaccttgagaatactcaccttcatttctctcagcaccatttaatttaccttgcgaactttctttagacatcgcaggtgcttcatcctctttcttctcaagtataccattcaccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgcccaatatgattatatgtcacactatcaagcaaaacctgaatttcagaactaggcccattgaaaaatctacgcgttgtattttcattgcactctttgagaccactgtagatgatacagaccttaaattcatgaatgtactccctaacagttctgtcaccttgtttcagatgttctaatttctcccgaagagtacatttgtaataagatgtcacaaagcgttttctcatcatggttttcaattcatcccaagtttcaggtttattactaacataagtccaccaaaataaagcagaagaggtaaacttattactagcagccttaatcatttgagcatcagaaaaatcatatatatcaaattcattgtctactgctagctcccaatcaatatatgcaacagaatcatacttcccatcatagaatggtaacttagatgcaacttgttcaaaattatagtcatgtacctcatatgcataacgtggagaagtcgtcatatctcgtcgaaggtgtagaagttgatgttctcgtattcccttacgcaatccgggcatggttagtatgaaacaagaaacacacaaaaatatgcacgctcctatcaactactaggtagtggcagctcaaatatcacacacactcaagctcttacaagtttttaccaaagcaagcggaatggtgatgtacaccgacttaaccaagcaccccaatggaggttggatgtatcgatgccttggcaaacacttgttgtacggctgcaatcagatctgtggagctctgggtaggcttaaatatgtagccaagggatagcaaatgctcaaatcagagaatgcaaagttgaataatggttcaaagtcaagtaccgtgctggtcctaggctagaacgtactagagacgcgagcctagacacaaacgataccacaagatagcaatagtaacaactcatgcacaactctgatatatgaagttcagctcaaacataacagtattttctcttttctttctttattctttcttcttttctttttttttctttccttttcttttctgttgttttttttggggcggcttttcttttcttttcttctttttatgcacctttctgccttttttttctcactttttttcttgattttttttaacaaaaactgactcaaggaccttaatgtaaggttacagggactcaaatgtaaatataaaatttacagggactcaaatgtaaaagtctaaacctaaaattaaaattatacaaaaatggaatgctgaatttatgccggttccgtttttttcaaacagatctcgaaaccgacaccaaacgaaatttcaccaaggtgtttgacacaactcagaactgagataacgtgatttggagagggaggagggagtccgactgtcacggtggtggtgggtacggtaggtgggagggttcggcctggcccttcacaagtggaaaccaaatccaataaaaaaaaactttccttttcttttctttcctttttttttccttccaccccaccgaatccaaactgatctactatattcctttattcttcctcgcacacatgcacggcacagccaccgaacagaagctatgcaactcaagaactcaaaaactaaccgacaaaaacttctgaaaactacaaaaatagaatcgtggcagcgagctgattccgttttcgtaggtcccgacgacaacagagacacggaggcgacgacgcctgtagtataaaacgtgaccagaactcgaaactctaaacggactaaacgctaagaccagcaacacgactcgacgatgcaacacagattcaacaaagcaaaaactgaaaagaacaatgcaatggcacaatatggctaggtaaatgatacaatttttttgtctggctattttttggttataggtagaagaaaactcaccgagaaacgaaagctctgataccacgtgatgaaccctgagttccactcgtcactcaaggctattgttggcccgatctttcggtgagttgaaataactacgatttgtggaaaaacattgacgatccgactacaaccgtacgagacgttgtgttgtgccttagcgatcgatacacctctccgtgggttgttgatcttgccggtgaagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatttaacaaaacccaagaaaccctgaaggggtacctagctatataaataggggtgggaggacgacctaggggtgcctagggtagtgctccacctggctggggcacaccccacatgggccccacatgggccaggatcccaaatgaagttacaagcccataggcccattataggtgacgcagcaccttgtgcgtgtgattccggccacacgagatggaattcggagatgaggctggatccgttggaaagagggctccgaaagcttttcatcaagtactcacggg

SEQ ID NO: 41341 - DNA, 1026 bp, Oryza sativa
  unsure (1)..(1026): unsure at all n locations
nnnnnnnnnnnnnnnnnnnnnnnnnnnnnnnnnnnnnnnnnnnnncccccaccatggcgatagtacacacatttatctgcctcattgactacaaagcctgcagatgtcaatgttttgtcaaatttctcatgccattgcttaggagcttgtttcagaccatacaaagacttcaacaatttgcacactttgccttcttgaccttcaactacaaacccatcaggttgatacatatagatctcctcatccagctctccattaagaaaagctgtcttaacgtccatttgatgaacgagaagaccatgtgaggctgctagggaaagtagcacacgaattgtggtcaatctagcaacaggtgagtaagtgttaaagaaatcttcgccttctttccgagtatagcccttagcaacaagccgagccttgtacttttcaatagtaccgtcaggcctaagcttcttcttaaacacccacttgcaccccacaggtttacacccatagggtcgctctgtcacctcccaagtcccgttagcgataatggaatccatttcattacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaattgggaattatttcagagggttggttcgaaccactatgtgtatccttcattgggaaaaaactctcaaagaaggtagcatcacgagactccataattgtaccaacatgcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41342 - DNA, 1800 bp, Oryza sativa
tgccacatcatcatccactagcaattaatatctagagtattttagatctcatgcaaacatgatatatcatttgtaacttaatatacaagcaatgttaaatcatcatcttcatattatttaaatatatacatctaatatttttataatgtataacataaattcatccatatatctcgcagaaaaaaacaccactcaggattctagcatgacccaagtaggctctaattagcgcatagctggcccattacaggcatgtcagatccatattaattaaaatatagctaatcattattaataccggcaacatatagaaacatatattaaactatccggccacgatgcaaatctcaccattagcattagcattatgaacctcgtactagcacttgcatgcagcatttttggtcccaaaaatggctcatgtgaagtcgacctgaatgcaaccaatttggatatattttctttgcttcttttcttcccttttcttgtgaaaattaactcctcaaaaaaatatatatttgatgatagacaagcgctagtaaatttctccatatttttgccaaatttctcatcaaaataaatagctccaaattaaagaccagatgatattagagaattaccaactacaatatttaaattatcgctagtcatggatccatgaacatcttgacgagtcatgggctcatcatcctcccttccttgaaacaaagcgacggtttgacttatatttaacatcttctacattagcgtacctcactctatagtacagctttacaagctttgattgtagtctcggatagcatagtaaaatcatatttaatggtccaagcggaaacataaagatagttgccatcaatattcccataagtaccaataacatcctgaagtgcgagcaattgcattctcacatgagctctcataagcaataattttagatcgtacggtcacatcattctctccctcttgaagtaaaaccgtcctcgactttaaggtaggagcaataccctttttcttcgctttcaaagcagcaaacacttcagctttaagggcaagtactatgatgcttaatgtgttgcccctaagaatgtcatgtaggattgaatgatgaggtgtaagtaataattgaggaaagagaatgtgagcctcttctcatgcaaggggcaacctccacacaaaccccaagaaaaaggagatgaaagaaagaggggattgtacaaacaaatacaataaaattatatgggttataataagataggtggtgtagatgtggtgtattgtatatatcaccgcttatcttacatgaataaaattagatgtgacaactaccccgactatagaacttgccctaatagcagtatccggcatcggtttgagcacatgatatatgcccttgtacataaaagaaaaattattggaacgaccaccgtgagtagcatcgagatcaaactgccgaggtctacccaacaataaatgacaagcattcattggtgcaatatcacagtccactatatcaacataatttccaatggagaatttaactctcgccttatgagtaattttgagtgtaccactttgattcatccattggacattacgcggcattggaagcctccgcgtagacaaagacaaagcatgcacaatatttgaactaatagcatttgtgaaactaaccaccatcaataattactctgcataccttatcttgaattttgcacgcagtctgaaatatattagatcgctgccctttcacatcaacaggagtatcatcactgtgtacttcccatgccatcatagataaac

SEQ ID NO: 41343 - DNA, 1712 bp, Oryza sativa
agcccctgcgcctgcgcgtagggatggttttcatggtgctacgtacgtgccatggagctagacatggacatggtacggctgactcttgccccttttatatcagcttcttctagctcttggtgtggcttcctgcagctatcaatctgtgtatcagtgtgtgtagcctcttcaaattaaacttcgtgccgtttgtgcgttgtatacttgatgtaaattcaaatcatgtgtatacttgcaatttgacgaattgtgtcattggcattcgttttcatgtactaatcaagtaggcataaagtttgcccgtgcaatttctcatacaaggtgtctaggaagtatgtattggtatttccattattaggtacatatacatactaacgggggcggatctaggattgaatgggagggaggacatatcttcttcttgctccagccccctactcttcttccccattccctctctctttctctctatggggatctaatgtgggtaagtcccccctagcacccgtattgaatccggcctctgcatacaaaatttatgaccattttgatttagatctaatgcccataaatattaaaaaccatgtaggtacatttttaatagaaatttgttgatgttagaaatgtgatggtgttgatttgaacgtgtggtaggtagcagactcacctatatgtgcgtatgatatgtgtgcatagagatgtgcatgcttgtgaatctctcgtgtgtaattgagaaaagatatcgggacattttggattgctaccctatcgaattttaccctatcaaaattttggtacggtaggaaaaaccaaccatctttattaaaacaatacctttactaaaaaaaattggtttttggtgaacttatctcttatagacatattttggcttcaatccaaataaacatttttaactctccgtagacctgccaaagttttagtatggcgtcaatccaaacaggcctattgtttcttgggatgctacaagtaccaggctatcatgggtgtgattagttttttaggtgtaaagtttttgaagtatacggacacacatttgaagtattaaacgtagactaataacaaaacaaattacatattccgcctgtaaactgcgagatgaatttattaagcctaattaatccatcattagcaaatgtttactgtagcaccacattgtcaaattatggcgtaattagactcaaaagattcgtctcgcaatttacatgtaaactgtgcaattggttttttttgtccacatttaatgtttcatgtatgtgttcaaacatttaatgcgacgtttttggctaatacatttttggaatctaaacaaagcccatatctttctccctgtctaaagccccttatctgcaagcccaaatgttggcatattattgggtcaggccagggacttgggattccataattggaaaaagtataccgaaggtccctcaacttgtcatcgagttacaaaatcgtccccaaaacgcaagacgtcccttaacttataaaaccgtttacaggtccctcggtggttttgacgccggttttgtcccacgtggcagctgagtcagcgtgggatctacgtgtcagaatgccacgtcatcaccctccatgtctttcccctcctctcccttcctcctctctctccctctctcggttctctcctctcgggcaggctagccggcgggtggggatgaggtcgccgacaacgg

SEQ ID NO: 41344 - DNA, 1462 bp, Oryza sativa
atccctcaaagaacgcgttgtaggtcgaggcaatgttgtacccatcatccatccaacgctagatgaactcattttggatagagtcaggaagttctatactctatttcatagcgtaaggaattgggagagcatgcacacagtcagggcgctggggatgtcatatatcctagtattgccggctaggccagcaacaaccgaagtggagtcttgacgacgcacagggacgacaaggaacagatctggggcgatcagttgaatcaactgtctgtcgatccagttgtccaaccagaacaacgagcgacatccatctccgatgacgaccatgacagattgactgacgcatggaaaatctccgacacacactgcacttgtggtaggttaatgttggcctagcaggggtctctaatgcgctggagccaagtccatcgcattgcatttgcaggacccatcctatgatccgtaggttcatgatttccagggccccgagctacttgatctaatacatcttgggttaagcgacaaggcaactcctaccatagactgagtccaatccattccaaaggaaggattcctgccatttgtcaacggttttcaagacccattcggcaacccgatggcaagggagaggtgccccgggatggaggagaggacggacttggccatatggcccgaggcccaacggcccgacccaaggaacggccatttggcccggcccaagcatgacatggcccaacagtgggctgtgccggggccgatgccttgacacagtcggccggccggcatggcatgatcaaagaaaatagtagtgggatccaaaatagacttaatcaaccatataaggcaaggcccaaagagaagaggaatacaaaatagacatatttctagccatacaagacaccccaaagagttgagggatgaaaaagtagacttattctatggagaagcacaatatactgtcattccttcgggctggcccagcacgacccgaatcttattgggccgtgtgtgcagcccgttggttggcacagcacgacccgacatgtaggtcgggtcagggggccaatttggccacctataaacggactgcaccaacggctatttgcaactcgcaacttgaaaccttgaaacttgaaagcaagtaagctagtacagcagtgcacaatcacgtacgtcccactcatcaacacacactgacccacagattcataaggagtagagttgaacgggaagcctaggctcgacgaccacctggagcgggtacttgcgcgtggtcgacagcccaaacacctcgtccatgctcagctcctcctccttcatcccctccggcaacctccacgcgaacccgtgcagcaggttggccaagctcagctgcatcaccttgagcccgaggttgtagccggggcacatgcgccgcccggacccgaacggcagcagctcgaagtcctgccccttcacgtcgatc

SEQ ID NO: 41345 - DNA, 2633 bp, Oryza sativa
ccgcagccgtcgtcgccgttcaagtggcgggacatgctccaccacagccccgtgccgctgttccacagcccggcctcctcgccggcgtcacggagcccctcggcgtcctggctcgccggccgcgagcgcgagcggctcttctccagcttcgtgcgcaacgcgctcggctcctgcgtcgattacgcgccggtcgccgcgctgccgctcggcgtctcggctgctgtcggtgtcggtgccggcgagctcgcgttcgagctcgacgagcacctctccgaggcggagccgtcgtgcgagccgtacgctcgcgacctcctcgccggcgcccaggctcgccaccgcatcttccacgacgagctcgtcgtcaaggccttcttcgaggctgagagggcgcaccgaggccaggtggaatcccaattcccaagaacttggacgaaactccaatgttaacttcttgctttttcttttttgcaaggtgtaattatctatgtccttaaatctagtgccctttgtgctttgcctgtgtgatcagacgcgggcgagtggtgatccgtacttgcagcattgtgtggagaccgccgtgcttctagccaagataggcgcaaacgcgaccgtcgtctctgccggactcctgcatgacaccattgatgatagcttcatggattatgatcagattttccggatgtttggtgccggcgtggctgatctagttgaaggggtatgagttttgtttacttgatttttagatggatcataaattcataatagtttaggagctctcccagtttagtagatgaagggctggttccacggctatgattgaattatctatgttatcattgatgattattcaaagtcaacaggccatgtgctcatcttgcttaagctttcaaccatatggataacttcactactaaagctttcaatcatatggatagctttactgctaagtaaacgaaatgtttagctggctgaagtgcttgctcaggatgtcgcccacctcttttttggcatgctgcagatttgatctattacttgtagcaaccaattagtgacacaactttaaccatattttgtactcccctgtgtggtggtgttgtttcttctttgttttttaatactgtatatggccattcttgggaaatgttaaacaacagtggagtttggttgaactgcttatttcctgctctcatctgaaggaatttgattatgtctttaaatacatttccttgttgaaaaatgatttttttttggtagcaatgcattacctgaaccatcttctaactaattttgattacacctagtccaaatgtaaaagtctttgtattgcaatttatgctttattcaggtctccaagttaagccacttgagcaaacttgctcgggacaacaatactgcaagcagaaccgttgaagcagaccgcctgcatacaatgtttcttgcaatggctgatgcaagagcagttctgataaagctagcagatcgtctacacaacatgaagacaatagaagctttgcctttggtcaaacaacaaagattcgctaaggagactatggagatatttgtgccgttggctaatcggttaggaatcgctagctggaaagaccagctggaaaatatttgctttaagcatttgaacccagaggagcacaaggagctttcctccaaacttgtcatatcttttgacgaagcacttcttacatctactctggataaacttgataaaggtctaagagatgaaggtatttcgtatcacagtctttctgggaggcacaagagcctgtacagcatatactccaagatgataaagtatgtcgaattcttaatttaaattattgaaaactgaatattattgtcacaaatgggtatgcacagcaacttaccatgcaatgcatgtggccctccaggaagaacttaacgatggatgatgttcatgacattcatggtctacgtcttgtggttgatacagagcaggattgttaccaagctcttgacattgtccataagctctggccccgagttgctggacgatttaaggactatatcctgcatccaaaattgaatgggtatgtagaataatgtttgatcaatttgttaaaatctctacaagaatccctgctaatttactagttgcaggtatcggtcattgcacactgtcatcatgtgtgagggcatacacccatttgaagttcagatccgaacaaaagaaatgcatctacaagcagagtatggatttgctgcacactggagatacaaggaaggtggttgcaagcactcttttgtactccaaatggtggaatgggcaagatgggtgctcacatggcaatgcgaagcaatgagcaaagagcggtcctcaggtttaggccgctctgatgccattaggccaccatgtccatttccctcgcattcggaggactgcccttattcttacactcgccagtgcaaccacgatggacccatctttgtgattatgcttgaacatgataaggtatgcctctccttttgatttcttcccaacttgtcatgtcgaaaatagtaatattctgtgatgatataactggccatttcaattgtctgacaaaattatatttttgactttagatgtctgtccaagagcttcctgcgaactgggctgc

SEQ ID NO: 41346 - DNA, 1589 bp, Oryza sativa
tagccatctattcctagagaagacagcatgagctgggatctctgaaccctgaaggttgggccatccaagaaccttccaagttgcaatcatgtctaacgaacccacacacccagccaacgattttggaacgtgtggcacgcagactttgacagtcaaatctagacttgataacttgacaagtggtatcccatcaaaattttcagaaataagaagcgaaaaatggtctgaaagttagtaaaatttttcacggcagtttgaattttcgctctcaggacatggtagttttttttttcctttaacgactgaaatttctactgcactcgagtgaaatgactgcgaaaagtacacagtggaatcaagaacgggatggtgctcaccgagtcgaggaggatgttgaatgccttgaagtcacggtagatgaccggcgtgtcggcgtcgtgaaggaaggcgagccccttcgccgcgccgacggcggtctgcatcctcctcatccatggcatggcgccatcgagacctgcacggacaggaggacggttcagcgtcagctaaagtcttccccggaattttttcagagctgaaacttcagcgatggcgtaagcgcgctctaagcgcaaatgattcggttaaccactcgcgtataaacaccagtaatctcccggattctattgacgattgcgacgggggtaaaaaaaaagaagaaaagattcaacagttggtaattattctcgtgtgcttacttttgaagagatgcttctccaagctcccgttgctcatgtactcgtacaccagcatccggtgttcgtcctcgtagcagtagccgatcagcttgacgagattcttgtgcctcaactgaccaaggaagaacacctcagcctgcaagaaagaaaggttcgtagattaattagcacggtgagctaaagctcgagctagcccaacaatggcggaaggaacgcatgaggtggagagtgacgtaccagccactccctgtggccctgcgtgccgcagtcgaggtcgaggtacttgacggcgacggcctgcgcggcgaggccggggcggagcccgtcgtcggcgcggcccttgtacacggagccgaacccgccggagccgaggtagttggcgcgggagaagccgccggtgacggccctcatctcggcgtaggtgaaggcgtacaggttcgagcccgacagcgtcagcgacaggtcctccggcgtgagggtccccgtcgagctcaggctcgacagcgacaccctcgacgccgacgacgccgacgacgacgacgacagcagccgctggtggtgaccaccccctctgaccctcctcctctccggcggcacgtcgtcctcaacgccggccaccccgccgccgccgacgcagcagagcatcgacttccacgacgtccgcaactcagccatcgaatcgatcaaatccaagatgaacaagaagccaagaaaaaccaatcgcccacgaacacgaagcagcagagagccagagaccgaaatgcagagacggagacagcgagtaccagagcttgtaaagaagaagaagaagagaggacagagttgaggaagcgtctgcaccggcaatggcga

SEQ ID NO: 41347 - DNA, 4294 bp, Oryza sativa
taaagatgtacacctctgatcagagtataatctattcgaatagtcgcgccctcggttatgggcaagccgagcaatgtacccaagttagtgtttttaattcttaaaacctgcttaacaactaaaatgtggaatggttggcctgggttggcttgggacgagttaggacccagggttgggttgccagttcggtctgaatcatcgtgggccttgggttaaggcaggttcgtgtgggttcacggccttgattaataatcttgtatagctctaggaccgtgtttacaaagtagctttgagcaactaagtgacttttaatgctgtttactgcaaaccctaaccccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcatgtggtcgtcgccctagtcttccgctgtttcccatttgtctttgtgtgtgctgggccttcgccgcccatgtaataaagtaactatttacgcttccgcttgataaactctgaaatgtatcaacttttggtgtaccttgcctcctgggacaaggaataatacacgcacgtaaggaacgcccgttgggttatttccggtcgtgacatccactcatcccgttcggcccactcacgtgggtcgacccactcgctaagcccggcctcttcccccggctcggcctcctcacctaggaaggctcgctcgacaactacggcaatcccatcgccaccagtgccatggtttgctgcggtgcccacccgaccccggtcggtgcgcgtgcaaatcgctcctccaccgccctccactacggcaccgctcgtgatcaatgatcacaccatgaccacaagtggcaaagccggtctgcgcaagcctgtccagcgactgaaccttcatgcctcgatgctatctccagtcccacacacctaccgagctgccctcgccgacccatactggcaaacagccatggaagaggagttcactgctctcaccgccaaccgcacatgggacttggtgccccgaccatccagcgccaatgtcgtcaccggcaagtggatcttcaagcacaagttccaatttgacggcacacttgacagatacaaggctcggtgggttcttcgcggtttcattcagcgccccggcatctgtcacatcctgattttcgtttcaggatttataaattatttaataaattaataatagaatttatattaaatgatctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaatagttcagtaattatttgatcaataatgatttaattatatttgttaagagcttttcttatttaaaaatccttaaattataaattgttgtttaaaaggaattattagaaatgatcttaaaagcctaaaagagaagatctaattttaatttgtgaaatctcaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtctcttttggctttgggccgaaagtcggcccaaaacccctctctttctctctctctccggcccagtcggcccagccagtccgagctgccgctctcctctctctctcgctgtcgctgacaggtgggccccacctgtcggacttgtcttcctcctccggccgccgccgcccgaaccctagccgagccgcgtccgagccgccgccgtctccttccaaatccgatcgattctttccttctccggtgaaatcttttgaggggaaatgatcttctcgatctcctcttccttttctcttttggaaatcatcgctcaatcgctttggaagttcgtggattcgaggtcgaatcggatcggtttctttcctccgaaccccgagctttccatcccgtcgccggtcgccgtgggccttcgccgctgccttccaacccctttaaaaggatccccggtgtctcctctacccgccgcctccctcgccttcgtctctcgccgtcggaagcgccctagcgccgtgtgacctagcgccgccgtcgtcgccgccgcttcagccgtgcgccgccgccgttccggtcgtcgtcgtcgctcggggaggtcgccatcgtggtcgccggcgccatccgttgctcttccgccgttgttttggtcaccggtgagttcgccgcgtcgccctctacccgttggtgtcctccgtttgcatcgtcaccccgtcgttcgccggcgagcttgcgctcccgagccgccgccggtgctgacgtcatcgctgacgtcgttgctgacgttatcgttgctgttccccgtggcccggtcgtggaccgatcgatctcggccatccgttttggataagatcgatctcggccgtccgttcccgtgaaccgctgccgtgcacccggtccaccgcaaacccgacccgctgacgcaataattccctttttcttttcaaaaataattcattattgcgtcataattcaattaaaatctatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctcttcctttgttatggccaatttgcattgattactttattccttgataccttgggttattataattggactagttgagctttatatatattggttcaactagatattagatataattgcttagccatgcttagaaacattagcacactattgggataacttatgactcactattatttaatgatggcttaatgatagttcacgatggtcaatcgtgattggttaattaattacttgccaactaaaatatgattaatggtgggttgtgagcacatggttttgagagtcgtgctcatgacaattaaggaccggttcgcgagctactgttgtgaaacattaaccgtgccaaccacaagccagcatgggcaacggctttaccttttgtataacatagttcattgcggagcaccagactgagaagtggcggagataagcccacgggggtcgctggggagtccatgcctctggtttttgagggggtgattatgatccaggaatggtgcactgtggtgagttgtgttgtgcgaagggtattgtcacgatttccccctttgcagtgccgtggtggtacttcggggcatggcaacatgtgtgaaatcgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgtttagctcctggtttggagttagatctgtacagccgggtatggttgttcaggatggttgggcctgtacagcatgggtgtgctgttcagtgttgattaaaaattctgattaattactctactgttttactactcttaactctttgctaagtgctgctttcgcaaatgagcctatattatgccatcctttgttatccttgtgcacttgcatatttgctgtgtggcttgctgagtatgtcatatgctcaccttgcaataatcaatcaacc

SEQ ID NO: 41348 - DNA, 989 bp, Oryza sativa
actgttcgaacagccgtgcccacggtcatgggcggatgtgaggtggttcccgttgcgtagagttgtttgcctgtgctttgtgaaaagttgttgtggtgtgggaatcgtaaccagaatcagcctatgtgccagatggatgacctgagtggtcaagaaacgaatctgtgtgattcggaatgtctgcgggcatcatagactaggcttcccgagtggaagcggattgttgtgctgctaggcagctggactctgggagtccgagaaaatgaaaaaggctctgggagccgattaatcaagtggaatggctctgggagccgagaagtaatgatctgacccgggaggtcggtacattactaaatgagctgttgaaaaatatctcttaaagtcgaatcgagacgcaagtctcttttcggcccaaacttagaaagaaataaatcacttagtgatttcaaaatgtcttcaaataaaagatttgcaaaacaaccttgcccctcttcgaatcttgcaataaacacctaaattcccgtgacttgctgagtacgaaagtactcacccttgctctatataaatatatatatatatagttcctccgccctgaagttgaagatgaggtgaagtgaagattagggtttcgtcctggttcccagccgtcgcctgtggtgttgggtattagaccgttggttccgctgctgctgttgttgttggtgttcgcctcgtccgtgtcgtcggttgtattctcgggctgtctgagctgcaacctaagttaaggtaaataagtcctctatttattttaaagattgctacgattcatatttgtcaccgtgggtaccagcactatgtcctgggactggtaccgagatcgcggtttcgtaggaaccggttcgcgccgtttaccctacgacacgctcctgtcaggtgccgttgtacggcggtatcagattggggtgtgacaaatatccaaattgatagggctaaaattattccctcccatc

SEQ ID NO: 41349 - DNA, 1085 bp, Oryza sativa
ctgtctcctgtgaagtttcatacatgatgctgtatgcaaagagattcttccgttttctcgaatatgcgctctctgccttcgcgatgtcctttgcagagccacaagatgaaacagcttccttgagacacgcgaaagattttgattttccattgtagaatttggagatgctacgtctgttcatgaaaacatgtggatcttagagaggtgaaatatagaaaaatgtcatatcatgtctgcagtgtgaacatccacactgcaaaagctaataaaatgatgattgaaccaataagtgccatcactatagcccacataaagctaatattagttataaccaaacaattaaaaatggatagaatgaaacaaccaaaagatgcttaaggacattctacttgtatgattgtatcaggaaaacagcatgataacaaaacatcactgcatataaagaattaaaacactacgataaacatcacaacttctgtacccaggggagcaaaggagttgcttgtacaacctttgtccatgcttgttaaaaaattgcacttatatacttcactgtagtgatgatactggcaccaatgggtcctcaattagacaataattgatgttttgtacctgttaatccactgcagtccttctcatttgaaagttgcttcataacactggtcactaccacatgaagcaggtccttttcagttaatgaataattcaaccaaatatgccatgattgtttgacagcatgcatttctccatgctagaaattcctctagctttacatatcttaaagaagatatactagcttaattaatttcgatggtatgcattttaaattgaaaattttggtggataaagtgatcttaattaacggtaaactttgagacttttgacaaggtttaagtaaaaagtttaagtttcactagaactttcaacagctaccaactcctacaaaaaaaatatatatcacaatcacaatcgtctcttcttgaatcatgcatgaaaaggaagagcactcaacaaccacatgaatttaacacaaaacgaactgattttccattcgacatcgacttgtctttacttatccagaaaaa

SEQ ID NO: 41350 - DNA, 3413 bp, Oryza sativa
  unsure (1)..(3413): unsure at all n locations
nnnnnnnnnnnnnnnnnnnnnnnnnnnnnnnnnnnnnnnnnnnnnnnnnnnnnnnnnnnnnnnnnnnnnnnnnnnnnnncgtcgagggaatggaaaacctgccaccgaatagtagccctgctgtctatgttgcgaaccatcagagtttcttggatatctatacccttctaactctaggaaggtgtttcaagtttataagcaagacaagtatatttatgttcccaattattggatgggcaatgtatctcttaggagtaattcctttgcggcgtatggacagcaggagccagctggtatggctgtagtctcatccctgctttcttaagtagacatatatacatttacagtatttggtaaataaacaagattttatgaatcatatatgattttggggaaaacacaaaactctctttgttggctgccttgaacatagttctgttcacacagttatagcaccttctttaaaatgaagaactttgttgcatacacataaggccaaaccacataatgaattttgtttatttctatctttgaatgttagcatcgtttttgtttaatgcatgatcgccttcctatatatttgtagtatgtcaacattgtattccatgctgagcataacaaatggtttgttaaaattcaggactgtcttaaacggtgtgtggatttggtgaaaaaaggagcatctgtatttttctttccagaggggactagaagcaaagatggaaagctaggtgcatttaaggttcagtaaccaaacttaggttacattacatctaatgagatttttatattcagtatataatgttaaccttctcatggtgtactgacgtggttataaatgtccccagagaggtgcattcagtgtggctacaaagaccggtgctcctgtgatacctattactcttctcgggacagggaaactgatgccttctggaatggaaggcatccttaattcaggttcagtaaagctcattattcaccatccaattgaagggaatgatgctgagaaattatgttctgaagcaaggaaggtgatagctgacactcttattctaaacggttatggagtgcactaaagaaagatggtgtttttttttattatatggaacctattcaaaggcacagacaggctttcaaggctaagcttgttacaggtactgatactagttactaattactttcgtaatcagtataaataagcttgtgtagtgtaatggcattgtacatttctgcacttggtaaatttacagaagaggcaagtaatattttagaggattgagtttattcacccagtcatatagttgaagaggcaagtaacctgtaagagaggactgaacattaacacctcttgttcgattaaaaatgaccaaagagcatcaaacatgtattcgaggctgttactttagatatggcccattaatttgtttagttgtctatgtacatcctagttggtgtaaatgccagttaccatttctatgatctaaaacaatcaactcttttagtatattttcaaaaacgaaaattcagtacacatgtatgaatcttaatattcttctctagctcgttacaaaagcaacaaaggcaccgtgtcagctggttcacattagctagtttgtacttagcattatccactagcaccttattttcatgcatatcatgctaatttgcttgcccacgttgagtgggaatttttttcatgttttataatttatatatgttttagacttctagtccacaatttatgtacttcatgttcctgagcctctagtatggctgatagcagactaggtgctgagtgctgtccttttttgcagactgaagagagaagaaatacaagactgtccattgttagtcagatttgtaaaaatagactctgatgtagtttacttttgcccctattttatttttaacaatacaaatatataacaggtcctaagaacttatcttaatttaggaaaaggtggtcggttcattaaattaaattgtgaagtaaaaatgtgtgctcgagtctgtcaatgcaatcctgtgttcttgtttgaagatatggtgtagggcaggccaggattgaacactgaatggtaagactgcttctgcgttcagacgttattgctaaatttttagctacttgcagttagtgctgccacgccgattaagcagtagaacaaagtagttttgtcgtgcacaaatgagttatatttcattggaaatcgaagcgaaaacgaatcaaaagttagaagaaaaggggaaacttggtaattactccataaagagagtgcattttattggtaagatggtatccggaagctgtgagctccgggctgtatgtattctggcaaatttgatatgagatgctcgattattggcttaagttagcgatatcaaatttggggaagcaccaaaggaattattgtgaaggagttatgggtgcgtgacgttatctgctaggttcaaatccttgtggctatgaatatttatctgctaggttcaaatcctagtgactatgaatattaatgggtaaggtaagggatttattgttaattttagtttctttaagattgtgccatcggacgccattcggtaactgtaataatgctttgtattggattcacttgtgttacatgcacgcactaaacatgtgctttaccttttcatctgtttttgcgttctgggctagaaactcaaacgttgaattttccatggtctgctcaacttgacaattactgcgtgtcaagcgatcttatacgcatactatgcgcacaagtgattgtatacggatatgatgacagtataacgtgtgatattgatttttttaataaaaaaatgatgttcctttccttgatgaaggaacaaagactttttttaaaagaagggtattactaaaaacaaaaatgacaaaaacaaaatatcagtgcacatggcaagtgtgctcggcaattttttctctgtactttaaacaaaaatacttctatatgttcttttttataagggtggcacaaatcttttaaatgagccaaatatctacattggatttattaaaaactgtataaattataatttatactctgaaaggttgtgtgcatctctcttggagaaaatgtataagttgcaaacaaacattaatccacgttatgtaactttttttcgccggaaaggccgaaggaggcctgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaatacccnnnnnnnnnnnnnnnnnnnnnnnnnnnnnnnnnnnnnnnnnnnnnnnnnnnnnnnnnnnnnnnnnnnnnnnngg

SEQ ID NO: 41351 - DNA, 918 bp, Oryza sativa
cttgtcagaggtcacttccgctgtagactagccctcattgtaaaaagcatgtttcccttcttaggcagcgagaggcccatgtggtgacccctgaccagagaaaaaggaggcccaggcttagaaagagagaaaaaaaaggagaggggagttgggactctggcgaatgggttctagagcctgaactctctctcgctctccggctctctgtattccttcacatacagatccaccagaacacaggagtagggtgttacgcttctcagcggcccgaacctgtctacgtcgcccgtgtctcgtgcacttcctctctcgctgacgttcctcagatcgagggcgaagaacctcacttagcgcccccggccgaaccggcaaaggggggcctgcgcggtctcccggtgaggagccccacgctccgtcagtatgtatgggatggatgaaaaataaactcattttagaactaagtgagtataataacaacgtttgatttttaatgtatgaattaatagcgtcaaaaatattaaggatgatggtagtatatgcggtaaaaacgtaaagataattcacacaccacgaacgaaaccttctccaccttctgtccacgagttggacatgcaccagcagctagccagtacaaagaaaaaaaaacgtacagcaggtgcggcatccccatctgaccccgcgcgactcacctcacctcccccgtgagttgggatcctctcctgtaatgtatgtgcggtaagtgccaatgacatgtgggcccggaataggtgggacccacatgccagtgacacgtactgcaggtgcagtacagcagtggatttgcatcccccacctcacactcccaccaccgtcacgtggcccctctgctctctgcactgctgcggcgaggagctagctcgagccggccggaagccatgg

SEQ ID NO: 41352 - DNA, 955 bp, Oryza sativa
tttgttgtcatgggggagaaagattatgtctacaatttccctggcgtcgagtctgctatcaaagacggcactatggagaggcatgcaccagacatgaagatcacctatatccctgaagggagccattttgtgcaggagcaattccctgactatgtgaatgagctccttcttgcattcttgaaagatcatcccgtggataaatagatgttattgtagactcaattgtgcttcacccgtagtacaagttggcgatggaaacattgtgctatatcatgatatgaattgtcaacaaataaaggatatattatggatggtttgttactttcagtaatgcatgtttgagcttgtgttgcgtttagtttctcctgctaatgttgtcagcaatgcaaaggccaaaatgttattatattttaacctagtattgcacttataccatcattttagcaagccaatgatgtgaacttataccatgatgttagcaagtcaatgatgtaaaagatggagtacggagttatttcttatatgtgtttgtgatgagcccatttgtggccgtgatgaccaagacctctggtcgttgctaggatcggccgagtgtgaagtttaggacgatttttttgtgaagtcgtcaaggatcaatgatggattccctctttatcaccgaatccgtcagggaagtctaaatctagtgttggtagggaagtgataactcgaatttgcttttttttttgtgtcgtattaaaaaggggaaaatttggtaaggtataaacttattgtagtattgcaaaacataacctagtttcttggttagacttatccttcagagcctagcaacttaggttaatgagacaatccattatatgccactgagtttgtcatagctctacgatttaccactgtctttgtcacgtactataatataccatcgacttttacttaacttctatgatttaccatc

SEQ ID NO: 41353 - DNA, 1152 bp, Oryza sativa
  unsure (1)..(1152): unsure at all n locations
ctgtaaatactgtaaattccatacatggcatggttaatctgtggcatatcatgcctcatcctcatgcatgaataggttgtggtttacaaatagcttatcattcaaaaaggtttgcaacatcatttgcccatattaagtctatagccaaaaaaaggaaaacgagattagcaaattgaactgaaactgtggaccaggaaatcaaaagaacatgaaacacagtatacctggatgcttaaaagtagagctgggtcaacagtcattttgtcaggcccaatgctagataacatgtcactggaagcttgccacggttcaggtagcagagttgatggatttatcagggcagactcaattcccttgccaagcatatccagaagcaatcttgcttgcatgtccaacacaagtgctctgacatcttgagcatttgttccttccaacaatctacactttatcctatcaagattctgcaataagtaaaatagactaatcagtaacagaagaaagcaatagccttgcaacttcaagtcctcaaaatctgaagtaaaaggtaaacacacaattagaaaaacaaatcttgtccaactcacaaattacaatatattgcattatgaataaagtagcaaactacatactaccgtaaatggtctctgaccaatacatccagagatataatttatgttcatagaaaagtttggcaagcttcatgctaaaatgttcattcagaactgcaaagcagtgctagtgacttgtcacaagaatactaaaaaactatgtccaggaaagaaaaggaaaaaagtcatcttgattatattttgattcgtatccccctttcaactactggtggaataaagactggtgattggtgaatgtacaatctttaagaacccaaaaagatattgtgacatgcatgtcacatagtaatggcagtaggcagtagatgatgaaaaattgaaggcctgtgcttaaaactgcacataatgtactaaaagcacagcacacttacaggacagtgttgttgcctctgttgtatagttggaagacaatggaagtccgcgtccagcaaagctatcacactgttcagtgagactggaaggaaaagcaagagatttagtttatcatnnnnnnnnnnnnnnnnnnnnnnnnnnnnnnnnnnnn

SEQ ID NO: 41354 - DNA, 1659 bp, Oryza sativa
tttagtttatcatggacaaatataaatgttacaggtgctgaaatagtttaccaacccatatgtagaaaatgatgaaacttactgaaaagttctgtatcagcttaaaaagatgtattgcaactcacaccaggaaataatgttaacatattgagacatccaaatgggaaaaatgaagcaaaacacaattcatcatactgcagatgcacaatgctttcaaattgggagcataaatgtgcaatcagctctaaagtcttaacattataaacaaccaaacagagatttgcttggttacactgttcttaattactccctccgtttcacaatgtaagtcattctaacattttccacattcatattgatgttaatgaatctagacatatatatctatctagattcattaacatcaatatgaatgtggaaaaagctagaatgacttacattatgaaacggaggaagtatatactttaagaggttgagtgacagttgtggaaattctaccgtgtagcagataatccctacttttctaattgtgtggacagctagaacacaattgaaatgcaaatactatacacaaattttaaattgcatctgcataagcatccttaccaataccatcttcagcagcactttgtgtgcagccaacagcatcccaccaatccacaccagccaatagactccaccaaaatctgctaaaaagatcgcagttataaaaaaaaacattttcaacaaataaatcatttcaatcaacctctgttaacttgggtggatacctatctgctattgctcgttcccaaacagctgagctaacctttgtctgagcattaagaattgcaggaggaagcacacgtattatctttagtatggttcgatctttgagtgtgtcatgccatactgatgccaagcaacaaccactggaggagaaggctggtggagcaattgctgagccaacattgacatgatagctatcaacctgttcaaagtttggacctgaaaaaatgtgcacacctccacgcaggaatgcaactgcaacctcaccaccatgagcagaataaactatttgggccaattgtctgacatcatttggaagatcataagggtcaaagctaagtcggttcgccctgtcaacactgcactcagaagaactccgctcatctgaagttgttggcattggaacatatgattgagggttcttaaggtcctcagatggtgggatgcttttgttaactcttgtggaccaaacagtctgtgtaggtggctgtccaccaaagtttgcagggcttccaaatattggatgaagaacaacaggttggactgaagattcccagcactggactctccatccagtgatggaaggtccttcatcaggatcataaggagacatgtactgccctggaagtatgtggtttaacaattgtcagaaaaaataaataagcattagccaagagcctaagatcaaccgattcacttaataaatttcagagaccccaaaagtccttaaaagaatatgcatatagcatttacagacaagaacttttattaccatggcacaagctaccagagcaaatcaaagaaacaacaaaagcaactaaagggagctaaaacatgtataagcatgctctggacatacatagttagattaactctcctactattaaagct

SEQ ID NO: 41355 - DNA, 2334 bp, Oryza sativa
  unsure (1)..(2334): unsure at all n locations
nnnnnnnnnnnnnnnnnnnnnnnnnnnnnnnnnnnnnnnnnnnnnnnnnttgttgcatttatctttgcagttgcctgaataccattgccaaggcctggcatcacctcccaaaccactacagtagatggattaacaaggggaacaccagcaacatgtaatgctccagtttcagtaataatagcatcagcagccattatgccgcttggccctgctcctaaaagccctttgctagtagaaaaccatctaggttgtgctgagttttgagaaggccattgtgaccaatgaagctgaacagaacccgatgaaaaaactgaacagacacatagaatgtttggccacccagctgcagtaaacagcaatatgtcagagtagcgtaaagaagcatgcttgctttctcctccaaaaaaaatatatgctcagtaatatatgtgtttaaccaacccgaactttgaggctgctgggtaaggaacttttcctcaaaggttttcaagtttgatgaagtactagagtttgcaggaagccatctatactgcaaagtcaaagaaacaaaacaaatttagccgtggcaacagcttagtaattatattccttcgattctaagatccacttatttcaggccaaaagggtaatcaaacacaggtagtgtcatttgaaatagatcaaagtacttactcagacataaactgagccagaatcttttttacctaattgttgcaattgtttatgataaatgtccagtgaaaaaatcttagaacagtttaaactcaagtctattgtcactgctttataaaatattatattttaaaaaaataatgattaacaattgacactgaaaagtatataaatctcgaatgttaaattgtgaagcggactgtataaactgctgggtcaatcgtattgcatatttgcattccaagtgtaaagtgctaattatcaaaaacaagagaagcagactgtaagtttgcaaattggcaacaaaccggagaaattcctgacaaccacttagtcaccaccgaaagatcttgacgccattcgtgttcacattgccaggaactggcatcacgtacaagattagtaggacccttcaccatatcaagaaagaaacaagtattagagaaaaaacacaaaacagcatgatatgtatatagacttgaaatgaaaaaagaaaatcctgagtgtttcgcaaattaacaaagtaagttcaatggtactactaacaaaaaaaaatgatatgcataccgaaatttgcttaaggtagagatgtaccttagttggctgtgtccatatagtaatccttccatgaaaatttgccaccagtaatgcacgagggcatgatcgaggagaccattcaatgaattgaacaaagtcgcgtggagaatctgttcaaaattacagtgagttaggattggaggtagaaaaactcgtatataaacaaaagtgagtttgaatctcacccttcacctgactataaaatgcccaatggacagtgatttgcacatgcataacgtaatcacattaccaaaacaattgagatttagccatggattacctgctttcacattgaaaacagaacattctgttggtctctctggatttagaatgtgtatgggaatccaaaatggtgggcttgaattagagctgaaaatatacattagatcgttttacggcaaagaaaccttcataaccagaaactgtaagcaaacaattctaccaaatggttgaatatcccactaagacaagctaacagaacaaacttatttatggataactaaaggtcagaggaaagtaaattttcagggaaaggatggaaaaatgtataccttggtatgcgtgcacaagtctctgatgcgcatgcaattgcattgagcttcccgcaccaagcaactgcactgcaataaaaaaaaaaccatagataagatagttactagttgttcccgatatagtgtaggctaaagcagacaaggcaacctcatcctacaagatcaaagcagttttaaacaaaaaaaaataatgtggattttaaaaatggagttatcacgttcggtattttctaactggtgaacaaagtaaccagtttgacctgactaaacttagttatgtgaaataatgacactacatgttataactgtatttgatctagtatagtagaagcctgcacaggatacaatcattcaaagcaatcacaattccatgcccacgctatgcttctgcaagtttgagtcactagattgttcatcccaatcattgaaacgccacccaaatttgaagaagaaaaaaaaagtaaacccagatcgtttgatttagattattgagtggattattgcatggatatat

SEQ ID NO: 41356 - DNA, 3405 bp, Oryza sativa
  unsure (1)..(3405): unsure at all n locations
gtttcctcccctcctcgctttgctgctgcctcctgcgtgtgcgctgcgcaggcgtcgctttcaggttgggtggggaatgggatccgaccgtggaaaggggagacgacgacgacgaacgacgatgacgatgacgacgacggggagagagtcagagggagggggggaggggaaacgagtgggtttggtcttttggtggcgtttcgggagtggtgagctctgggtatgtacgaattccgttgaattttggatcgaaattgctagaaaacttttgcaagttccgtggagtttagttccaaacttttttaaaaaaatttttaactttccatcgcatcaaaactttcctacacatacaaacttctaacttttctgtcacatcgtttcaatttcaaccaaacttctaattttagcgtgaactaaacacaccctttttctctcaaaactttcagatttatggtcatcgggttactggagatttgtacattcaagagataacattgctacaaaaatatcatacatgttatgtgcaagatctcggtgctagtcagccaaaccacggttaaatacatgttttatataagttataccgtagttacaatacagttacagtacaactatacttcaattataatataatttaatctcgaagttttacacttaaaaaatctacggcagttttttacacactccaatattactcttgtatagtacctagatgtactaacttgtaacgaaataaagagtgttgtctgtctatttaaaattggatacacgaatttcattgaaattggcatggaggcgggtaatcttggtgttgtggtcttgcggtggattgtaacttgtaagaaaatggggatagtcgtctatttatttgaaactgggtacataaatttcgttaaatttggcaccaaggcagataaaatgagtgaatgtatgcctttttgggaatttgaatgaatctttcgtcagatttatagtttgacaatttcagttaaaatttatctccctcggttacaaatttcatcaattgtttatgtatcgaatctttaattaaattgtattattccatcattttactttaaatgatatctctctaggccacaactttcattacatcattgtctcgatttttatgtacatatagaaattgtagtgtgctagcacatatatgtacataaaaattgagattatgaacttggagctagaaacttgaaacttaaccctttcagattatcatcagccgactaatcacaagcgtcttataagaatctttataagaatctctagctctctatttaggttattatcattgttgtcgtgatcgtcgatagcccatcctaactacgcatgttttctttgtttatacaatataaatatgttttttttccaatagatgcagcagagtcatgacctatgaaattgatgatacggcacggtaagattttattcgcaacaaataagtcgataaaacaacaagcccatcttaaaaataaatccaaagaaacccaacccaaaagaagggaaggtcaggcgatgggcccaaacacgagccaaacaggcccatgagcccttgtacggcccatatgcaggtgatcagcccaccatggaacggcccacgtagcccaccgcctctcctcgccaccgactcaattcacccaaaggtcccaaaccgtcacaaaatagttaaaccaattccacgattccgtattcttcctcacgacctcaaaaacccaaaccaatctactccgccgccgccgccgcgatggtgttcgtccgcgcgccggacgggaggacccaccacgtcgacctcgacccctccaccgccacgctcgccgacctcacggcctccgcctcccgcgtctgcggcggcgtcccgccggagcagctgcggctctaccttgcccaccgccgcctcctcccggccgagccgtccccgctgctgtcctccctccgggtctcggcctcctcctccctgctactccacctccccctgctcggagggatgaccggcccgacgacgacccccggggcacccccgcccccgccgccgcggtgggcgcagccgcccgcccgccccgcgcgntacgacttcctcaactccaagccgcccccgaactacgtggccggtctggggcgtggcgccaccgggttcaccacccgttcggatatcgggccggcccgcgcggcgcccgatctgcctgaccggtccgccgccgccgccgccgcccccgccgtcgggcgcggccgtgggaagccacccggggacgacgacggcgacgacgatggcggcgacgaggagaaggggtacgacgagaaccagaagttcgacgagttcgagggcaacgacgccgggctgttctccaacgccgactacgacgacgacgaccgcgaggcggatgcggtctgggagagcatcgaccagaggatggactctcgccggaaggatcggcgggaggcgcggctgaagcaggagatcgagaagtaccgtgcttccaaccctaagatcaccgagcaattcgctgatttgaagcgtaagttggtcgatttgtcggcgcaggagtgggaaagcatacctgaaattggggactactcgctgcgcaacaagaagaagcgatttgagagcttcgttcccgtgccggacaccctgctcgagaaggctcggcaggagcaggagcatgtcacggcactggatcccaagagccgtgcagctggtggcaccgagacgccatgggcgcagactccggttaccgatctgacggctgtgggcgaaggtcgtggcaccgtgctctccttgaagctggacaggttgtcggattcggtatctggtcttactgttgttgatccaaagggttacttgacggacctgaaaagtatgaagattactagtgatgctgagatttctgacattaaaaaggcgcgattgttgcttaagtcagtgacacagacaaacccgaagcatccaccaggatggattgctgctgctaggcttgaagaggttgctggcaagcttcaggttgctcggcagcttatccagcgtggctgtgaggagtgccccacaaatgaggatgtttgggtcgaggcatgccggctggccagcccagacgaggcaaaggcagtgattgctaggggcgtgaaggcaattcccaattctgtgaagctgtggttgcaggcagcaaagttggaaactagtgatttgaataagagcagggttttgagaaaagggttggaacacattcctgattcagtcagactgtggaaagcagtagtagagcttgcaaatgaggaggatgcaagactgttgcttcacagggctgtggagtgctgcccactccatgtggaactgnnnnnnnnnnnnnnnnnnnnnnnnnnnnnnnnnnnnnnnnnnnnnnnnnnnnnnnnnnnnnnnnn

SEQ ID NO: 41357 - DNA, 995 bp, Oryza sativa
  unsure (1)..(995): unsure at all n locations
aaatcccccggtccagcatttcatggtatgtaccgtaagctttgtccagatccccctccttgaagaagccattgatgacagtggtatacgacaccacatcaggtgggcagtcacctccatcatcaggcatcatttggagcagctcgagagcttcttggcttctgttctcatcacacagccccttgagaagaatattgtaggagaagacatttggtatgcagccaagctgggtcattctgcggagcactatgtccattgcgtcgctcgtcctcttgtcagcacagaggcccttgagcagaggagtgaaggcgatggcgtccactctaaatcccttcttaatgacattgcccaaggccgcgaaaccgaggtccaagcggcccgcgcagcagcaggaaccgatgagaatgccgtaggtgcacaagttgggagttacctcgtcggcgccagctcgggccatgcggttgtagcgggacacggcggccgcggggctgtgacgcgcgacgtcggcgagggcgcggttcaagccgtagatcgaggcgcccctgccacgccggagcaattcgtcgaacacgtggcgtgcgtcctcggcgccactgccccccgcgcggcctcctcgcccttggatcgagccgtccgagcgaagggcgccaacagcgcgggaagcggcgcggcgcgccatgcccgccctagctgacaggtgcagcagcagcgccggcggaaaccaacgccgcaacgcagtttgtcttatacggagaggtgggcggcaccagtggaggatagaggggaggggaaggaggagatggcagggatggtgtaggagatcggcgacgagcagggcgtggagagaatgagagatcggccggcgacgtcggggcagggagatcgcgatcgatctcttctgcgcggcgctcttggggaaaaaaaagacagaaaaaaannnnnnnnnnnnnnnnnnnnnnnnnnnnnnnnnnnnnnnnnnnnnnnnnnnnnnnnnn

SEQ ID NO: 41358 - DNA, 2178 bp, Oryza sativa
agctgccccggcaagtcactggccatgacgaccgtgaccgcctggatggcaacgctgctgcacgagttcgagtggacgccggcgtccggcgccgtcgacttgtcggaggtgctccgcctgtcgtgcgagatggcagtgccgctcgaggtccgggtaagcgcacggcgaaatgtgtgaggctctgcacgtctgcagctaaaggcgtgatgcaccatgacttgatcgtgtagtttgtagccgtgaccctcgtgcttgccgatagtaaataagcagctgggagaaaatgtgcaccagctctgctctgaatttggttcagtttttaaacagtttttattgtgtgtgcgccatcagtgactgagtgagtataaggcttccaattgtgtaaaaatatgcaaaaatctatcaaagataatatgtgtgcagtattatgtaaactgtttgtcatgtctacactatacctgcacgtgcaaagggtcgccatctcatattggattactttttcatggaacttaaattctgaaagcaatatcatcatgtatatggtaggtggtctgtctctgctctatcaatttgaccatgaaaattgccgggcaaagcaaatgtacagatgtgtctgtaaatactggcaatattcaagacaagtaaaaagaaaggaggaaaggaacttgacaagaaaaattagaattggtaatttggaattcccttatcatcccagatccagcaccaagagcaaatttggtgtcaaactcttccatagtaaccccgggtcaaccccaaaaggataaagatagcaggagccttgcatcataggaggcggacagatttgctacggggtggaattacaccatccatctttattgcagaaagcccaatttattcagcgtcacgcaagaaaaggtacaattcatacgcacacctatccaacaaggcaataaggtctcacaattatatcaacaggtacataaagggtatttcaacccatatgcttgtcaaaggtataactagacgagcacaatgtacgatggcacagaccaaaatttcctctcaaataagcaccgcagacacttcaaacgagagctcatttctgattatggttgtagtatacttcagcgagcataagtaaaccgatgctaaaagggtcattgacagagaagtatggcagacttcacaccaagtcacaaccccagctccgaaagtagtttgcgccatctaggagtttcctcatcaaatatgtaggtcagctttgtcaccaagactccactgccaccaatctgcagttacaagttaatgagtacacattaaaacaattggatttatcaatggaactaagccatacacgttcaaaaaatatatagcaagggccatatatgttctgacaataagttctattatgagctcccatatcagatttatcttttgcgctgacagcagtgagaatagcacagaaacatcttttgataattactcatataagcacataaatataccttttactacaacattagaaaatttctaaagataagagacaattgcccacatgaaacagaaaaggaaaagggagaataaggggagataggcacacatttccgtttaaaagtattgaggtaaaatatcttacagatctcagctgttgaatggacttgtaaagagacttctgtggaactactacattaatcgcataatattccacagcaaccttcccatcacgtgagcggtagactggacttatggttgggccctgtttaaatcaaaatgagtgaatcaactcataagctttagtgattttccacatcagtatttcaaactacagtggttccagtcagataatcatgagcaaagcttttgctataagtttgaaatgcaaaactagttttatttcaaaggacctaaaagctttaaattgcccagattatgatgaagattaatcaggtctagatattagagcagctacaatacaattatatttccagttcaagattatagagtgctaatttatgaatgtggaaaataatattatttttaaagagatattttagcatctgccacataagtgcacatattcatggtcagtatataaaaaggtaaaatactactttggatacttttagtgatacctgtaatccacataacgatgtttggctgagaactctttccgccacttcttccgcactgttcccc

SEQ ID NO: 41359 - DNA, 864 bp, Oryza sativa
ccacgtggagcagctctgcgacgtctgcgtggtgcaaaccagcggcggctcccctttccccagcagacgagcttccgagccaagaaacaactcgggctcgtgcacggggacttgtgtgggacagtgacaccggccacaccaggagaacgacgttatttcctgctgctcgtcgacgacctctcccgctacatgtgggtgatggtcctcggcagcaagggagaggctgcggacgccatcaggcatgcgcaggctgcagcagaggcggagtgcggccgcaagctgcgcgtgctgcgcaccgacaacggcggcgaattcacggcggctgaattcgcgtcgtactgcgctgatgagggcattcagcgccactacaccgcgccgtacagcccacagcagaacggcgtcgtcgagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcctaccgcatcctcgacccggagacacagcgtgtgcgcattacgcgcgatgttgtgttcgacgaaaggcgagggtgggtatgggacaaggcggtggatgatggttcgactccgacgtacgacgacttcaccatcgagtacggtcacttcgagggagctggggga

SEQ ID NO: 41360 - DNA, 1796 bp, Oryza sativa
atgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatgcacaacccgagctaaaacattgagcattaattcccaaaatatacctgcccatattcactgactatgtcaaaaccaacaatgccaaggtcaagatccccagattgtagtttgcggacaatatctttgggcttctgaaaccaaacctccaagtttgggacctgcataaaggaaagaaaaaaatcaaaacatgtgatttaaatagcactgcgactttttaccttagctatctcctacaccgttatattccaatactaattttctaaacaggcagccacatttccacaaatagctgcagatcatgcagggacaaagtcataggaaggtaaagctgctaatgctacccatattaaatgaaataaattaactaaaatctctccaaactttaaaaccatatgcaagtgtggaaaaggtacaataactatgctaggtttcattaaaaatgactactgtttctaaaaggacatctccttgtattgtgaacacacaatgtgatcgatggggtattaaattgacaaggatgcttgaatcattttaagggacaaattttctgttgcttcatccatcagtgcaccagaagttcagacaaaattcgaattgttgaagggaagaaataaactaaaaatataatattgtataagatggcagtatttcactcatactgtcgaagggataaagtaactttagggtgtgtatagttccacgctaaaattggaggtttgattgaaattggaacgatgtgacggaaaagttggaaatttgtgtgtgtagaaaagttcaatgtgacgtttttggggttcaaactttggaactaaaccgggccttagtttggaattgctattgcgtatttattcaaccatcaaaagggcattcatactaacaatagtgcatatacaggaaatggtaaactgcaatgctttgaaaatggactagcccatacgtatacttatcaatgaatcagagagcctaagtggcctactaattcgatagtaggccaatttccagtacagaaatgacgaactgatagaagacaatgaatggagatggaaacctcacctgcgggatatctgcggtgtactgccgcgggttgaggtgcctgactgacaattggcaactctgcaccccgaggcatgaacagcataataacaacccaaagtcaacaaaatcaccacgtaaatacagaattcgatagatgcaagcaggaccggagacgatgtgcgagaccttaaggaggcttagggtttgctcggacatgcggcccttgctggggagcccgatacggacgaccgtgcggtccgcgtacagcggcgccaccgccgccggcttcgcggagacggcggaggccgccgaagcccccgcccgcggagcgagaaagcgcgtcctcgccatccccatccccacagccgccggcgcgcggaggccggacggcggcga

SEQ ID NO: 41361 - DNA, 868 bp, Oryza sativa
ctcatcagactatactcaacggtgcactgcaaagtcttctttattgccaatgattgtaactgaatcatctttgccaggagacaccggaggaggaatgacggaatgttcgctccaaaactcctataaatacagctccccgagctgcagctcagagcacacagaacttcacagcagcagcacagtgcaatattgcaaatggagagctcagcagctgagaactggtgggtgctgccactgaccttcctcccgcccatctcagggcaaaatgagagcgctgccacactgtcagccatggccacgagcttcgtctacctcgcgatctttgcatgccttgcatgggcaggcactgctctgctctactgggctcacccgggtggccctgcatggggcaagtaccggagggcgagggggcagagcccgaggtgttcgatcccagggccgaaagggctcccggtcgtcggaagcctcggcctcatgtccgggctggcgcactgctcgctggccgccgaggcggcgcgccggccgggtgccaagaggctcatggcgctgtcgctcggcccggtacgcgcggtcgtcacgtcgcacccggacgtggccaaggagatcctcgacaacccggcgttcgccgaccggccgttcaaccacgccgcgtacggcctcatgttccaccgctccatcggcttcgcggagcacggcccgtactggcgcgcgctccggcgcgtcgccgcgggcccctgttcggcccgaggcaggtggacgcgttcgccccgtaccgcgcgcgcgtcgcggggggcgtggtcgccgcgctgcgcggcgcgggcggggaggccgcggtgcaggtgcgcggcgtcctccggcgcgcgtcgct

SEQ ID NO: 41362 - DNA, 1026 bp, Oryza sativa
taacaagcatggcacaaatctcgaactatcaaatattggtgaacttagtaccatcgagtacaaatatccgaagaaaatatttttacctatatggcatctgtagcggatatctaaaaccagaattctcatagagggatgagtagacatcaagatcctcctcactaaaccactcgggaaggggtgtcgataagtctgcaagatccatgatctcttgattttccttagctatggggatctcgctcctagagaatagtatgtagatggtgcgcacaactctctttacatcatacttgccaaagtcagcttctgctcttcctggttgctgtaagatatatttttctttttcatggtcattataagcaaatagtgcactaaaaaaattatcatgacagtttcggagttaccgcccaacgtaaaatgtagaatccttctggcaatgtgtcaaaggacaaaccagcagtgcctaaggggatgcccagacacatcacaccacatgtgcggtttgggtgacggagagcaaagtcgtaagctggcattgccccaaaatcctttccaacaaggaatgcctaacccaaagaaacatataaattatcaagaagaaaccaaataggcattatttattttcaaatttataaggagctgatttctttattagggagaaattgatatccttatcttttagacagaaaaatggcactttctttaaaggtaggcggcaaaagcattgccgattatattagaatgaatagaaaaatggcaccttaatatgttgcactgaattttctgaccttcaatacactcttggttgttggtgctaccaacgtgggttttttaccagcttcaaatcaattcggtggaactgatagtagtatcaactgacgaaaataatagcagacaaattatcctctccaaatttctaccttacggatcacgacactgaaagtttatgcgttctacttacaaattatccaggattaaaaaaaaactacaaaaaaaatcgaaatcttgaacctttgttcacccaat

SEQ ID NO: 41363 - DNA, 727 bp, Oryza sativa
cacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagccccggaacatacccgcatgacgatcatgtataaggcaaacgttgggcctcatatgcaccactgcaatgtgcactctctctaggaaccagtaccagctttcagtgttctcactctctacaaatgcaaaaccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttcccacaaaagctgaagtgatgtt

SEQ ID NO: 41364 - DNA, 942 bp, Oryza sativa
ttttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaaaatttgataactattgatatttataaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggagggcgatttttaaaaatcgccatcccagagggcggtaggcgaccacttctgtcaattttcaaaatgaaaaattatttttgtaaaacttttaataaaaaaaaataaaaataaaaaaaattctctggcgacgaggcatttacgtgcacgggcccgatgccccgatgaaggcggtggcagggcgagattccccggcgtctcgctcgcatttacctcccctgcgtgcaaccgcaaccgcacgggcatctctcatcaatgcacgggcatggcatgcacgaaccatattccagtcccggcttgggcctgccccaaccaacaccccgccttgtctcttttgtctcgccgtttgggcctcattcaacgccaacaccacgccaccaacacacaacactctcctctcgcccattcaatgcaactcggactcgccctctcctctcgtcctgtatgtactcctcattcatatacgtgctagtactactactagtactacactacagtcatg

SEQ ID NO: 41365 - DNA, 727 bp, Oryza sativa
acaatcgggacgtgaaggagaaacaaaataattcttgattaatatttgtatccaagatgctaggaatatctaagattaatggggtagaaagagaaaataatactactggaaatgtaaaagtatgcaggtcacgctaaacttatatttggcattaataatttgggtatcttgagttttttatggctaacctcttaagattatacagcattgatatcatggaactttggccttccaattatcatgggcataccacaacctgttgattcccttcaaggagcaacctctatctgaaaccaaatgcttccattcagttcaagaaaccagcagagatgtataaaagcatagaggctaactgtacctaccttgaaccagaagtgattagatcatgcactggagaaaacagagttgcctcccaacagctcagtatctttcaataaactttaataaatttgacagtgtcatataccatccaagtgctgaactgggtcatgttgctttggtagacgaaagctcttgagtaatttgataagttcatacgtccttgcatgatgacccaaccggaggcataactccaaaggggtaaatccatcctgaagtaagcatataaaccaaatcatactctcatttgacagaagcctttatttaagagaaatgcaggaataagtagtgctcatgcatgtctcttaaataccatctgaaattatggcactggaaatgcatcacaaac

SEQ ID NO: 41366 - DNA, 1176 bp, Oryza sativa
tctcgtttagtaccacctcgataactcgaggcgatggaggcgggatggtggatctaagtggagtgtgactgtgtgagggagaggtgctggacatggatgccggcacggtgcggtgcgcggcgaaccacgcgccgctgacgccgatcagcttcatccagcgcgccgcggccgtctacggcgaccgcgccgcggtggtgtgcggggagaggcggtacacgtggagggaggcgcggggccggtgcgtccgcttggccgccgcgctcgccgcccgcggcgatgtggtgagtggaacaccaatgctgctagctcttttagcttatcgtgtgcgcgagcatttgctacttagatgtttcttcttttgaaccaacaaggtaggaagtggcggatgcagcttagatcgatggcccgaaagtttttggtagaaaacttgttaagtatgctaaacatatagtttacgagtaatatttccgctaatctttgccatgagcccatgaatagttgaagctagataacctcacgtcctcgcggatcttctcctatcagtactcttgatattaatgttctctctatgcatcagcatgtaaacagcttgattttttgttttgagaataaacagcttgattcagttagcgataaagcttctgcattgccgcgtatacttcttcagttagtgggataattttaccttgctgctaatatcctcgtgcattgccgctatttatatttttgcaacgccagttataaatctgagtctacagtctactgacaccgagtaatagtagcgaagtcatgaaaactctcgatcatgcgaatggccttctctgcagtttagatctttcacttttatactttcagtatgaactgcgaagtaatgtggcttccatgcaaattattggttattcggagatccataggaattctggagaaaatggtaaggattttaggtcccactcacagtccactccacctcttcatgttccttggtcaggccactcaacgatcgaaataatttcgacctgatttaatcatgggtcagtctgaaaactaggcccaggcgtatgacccacattgtcgtgtgtcccatgttcaggttgctgtcctgagcccaaacgtgccggctatgtacgagctgcacttcgccgtgccgatggccggcgcggtcctgtgcacgttcaa

SEQ ID NO: 41367 - DNA, 4654 bp, Oryza sativa
acccaaaccgaggcacacgcatgcctaaccttgtccttgatccggagcgcggcgcggaggagcctttcggagaggctggagtaagggagcgacagcaagccgcggccgccgtcgggggcctcggcgacgaagtccgggaggtcgttggggaagtagcggtccgccatgcccgccacgcggtgacgcttggtggcgcgcgaggaggaggacgacgacgtcgacggcaactcgccgcgcgggggggtctcgagcggcggcgacggcgagtctctcctccccttcttgttcccaccaccaccgtttcccatggccgccgcggctggggctttgtataaaaaatgctcgcgaatttgctggagtcgccgcggcgctgggcgatgacacggtggcacgcgcacgtgtactatatgtcagagttgagagctacacgtaacacatggagttcgtagcctcaacggctactgttttcttgtacacttccttttttactaaataattttacgaaaattttaagtttgtcagttggatgataagtttttttttcagaagtcaaaataaagttcaagtatccaaaccccaaatcccaaaaaaacaaatacggctgtgtgcagtgtgcttaccgtgatgaaacttgctggctcgttggattcgatggcggacgctcgaggaatcacggccagatctttgctctagccacactacttactcctcttcaccagcctactccatgactcaagccctgacgaaaggaacaaattaattagaatctggatttgaaggaaaggaaggaacatatggatctaaataagatgaaggggatggagatgatttaggaaaaaaacagattgctccatggcttgagcactcatcagtgaaacagattacttgtgtgatttaaagaaaaaaaagaggatctgaaagggatggagcagaagatgaaaaaagctaatggaataaagaggggaatagttgcctgttgcttggagctgcacgggagaatgaattggagagagaaaagaggaacaagagaggataataaacatgggagcctcggagataccgagcttcgcgcgtttttttccagattgttcgcgccaaaacgtcaaatgtttcgcgctattcacaaaaggattttcacgccgttcttcacgaaggtgagtgtagcgcgctctctctccgcacgcaacagtcgtgccgcaagcgtggcgaataatttgctcgccgcgtctttgcccaaaaaaccaatggcaaagcaactgagttgtggcagactatttgtagcagccaaaaatctggtctctaaacaaacggtaggctaagcaggtgtggcatgcctaatatgtggcttggcaggttgaggcaaccatccaaacagcccctacttcctccgtttcagaatataagtcattctaccattttccacattcatattgatgttaatgaatctagacattttccacattcatattgatgttaatgaatctagacatatacatcaatatgaatgtagaaaatgctagaatgacttacattgtgaaacagagggagtacctctgaaaccaaactttctagcattgccacattcatatagtagatgctaatgaatctaagcacacatatatatctagattcattaatatatatatatatatatatatatatatatatatatatatatatatggacaatgttagaaagttttataatatgaaacggaagaagtagattgctatattttaggatagatggagtactaccagatctctgcaggaattgcacatattactttttaggaaaaaattacacatattattcagactatttttgtcaatgagtccatcaggcattatatcatgaatttcattacgactttaggagggcaattattatttatacattcgacacatccatcgctttgaaacgatcattgttcataagcaaagcgatgatcattgttcataagcctaagaagttagtgtacaacatgttggttacagctaaaaaaaattgtaatgcttctctatggaaaaattgaagtcctcaacatgcgccaaaaatgaccgcttttcttttctttctttaagcaacaacatcgacaaatttgaattcgtgagtaacctgcaaagagttgaaaataaatataaatcaaacaaattttaaatgaatcagaagggttgatcacagacatttgaattgcgtgaagaaaaaaaccaagtgaacagacagtgctacgtggaggaaattgcagagcagctcactcgtacctctgaatctctagtttctgatgtctatatcttgtactcatgaacacgcatccactttgtcgatgaccatttgttaccttttatcactggacatccacctagaggaagttgaaggtaaatagaaatgtcatcatgttgtggcataaccattcactacaaaacaatttgacattgtaccaaagtattggaatctcaccatgaaggcttgtggcatccaaagacccatcaggcctcatgctccagaaaagcaaagcatctcccatcttgggtttgacagccaaacccttcttagcacattcagacagctcattataaaatggtgatgagctgctgttagctttagaagaggggaaaatagtctcaccaccctcttcaacatcagaactaataaatttcaaataagacaaaaacaaatgtcaaatgaatcagcggcgttgcattatataagaattaccaatattatagtacatacagatacataagaagagttgctatacgctgccccccgtttttggtgttgaattcatcatggaagtaatcgaagtgaggttcatacttctgtccaacttcatagtggaggacttgaagaccctctccgttctctgcgaaattatgagtatgaacagaaaggaacaacaacaacatttgcaacaaacttgaaataaaaaaataatgtgatttctatgataaaaaatttgttgcacttgatgatagttgaatatatttaggaattattaggactatccatcagatttggttgtaataataatattattattcctgactgcaaaaaagaaaaaaaaaatcaataccggccatgtacattgcatcttgttggttgtgtaccttactgactatttattgaagtgcgccagtgtcaaaccacccacgtttaataactcaaaaggtatatgtaatgtttgaaaagcctaaagaaatttgagtacataataagtacaggacatttcagaaattggtgtgtagatctttctgggtttctgttcaagtatgcactggcccttttttgtaaatatgagaagtttgactttcacatgtactacaacatgctcattatgtaccattgtacttgcaaaggccttgtgttattggtcacaaatgtcagctgccgaacagaattcaaggaatgacagggctcaggggtaataaaaaaatctgataacagagactttctagctctaatatgctctcaatatagggtgtgtttagttcacaccaaaattggaagtttgattgaaattggaacgatgtgatggaaaagttggaagtttgtgtgtgtaggaaagttttgatgtgatggaaaagttgggaactaaaccaggccatagtaactcagtaaatctggattattgtgcttattgtgtttttcttggtggttctgcttattgatctggatttataaaacaatagttaaagtgttaaaccattactggcaagtgatctggatttaacatttctctatgggcgttgctctgctaatatcagatcaaaaggagagagcaagagcagtacaattgcactctgtaaaggcaatgctttttcatatttggttccacagcaggtagctaagtgttcaaatgcatcactataaagtgtaagttttggtgattcagtgacataaggtattgcaagataaagaaagattcaaaaccttgcactgtttcatgatatagggatatcaattatctgtattagggccaaggaacgaagtttaaatgtatggtttctacaatgactaaagttctgcactttagcaaaaggaaaactgcactacttattctatttttcaggaggtcgataagttgactgtgttaaaggtgccatacctacaggtatgaaggtgtagtctgatatccttttctcgatcgtacggataattttgtcctgccctcttccaaggaacattcctgaactcgttcgaaccctgaacatgtgacatgccattaagcctaaacgagttgtaattgaggtaacatgttttcaagagaataatctacgatatccaaacctgctatctttactccctccagttgatgcatcaacaacagtagatttcttcatgtgaggctttgccaatgaaatcagatactcacattcttccttcgactgagaaggaagagaagttagtcatttcttgatcagtaataaaccaaacaagagtatatgagtagttgcagtaaaacaaaagttgggctccacgcaagctcatcaacaatcaacatgaacttcaattttattgcttgaaacttaaaaaaacaaagattgaaactgactaagaatgccagtgagtattgctacaagaatactctctaacctcaaaaagaaataaatagaagacgacaaattattcggcgcagctcaaacatcgagac

SEQ ID NO: 41368 - DNA, 1971 bp, Oryza sativa
tatactgcctatctagatctagatcgagattacatagtggaattatctgtttataacaaaattacaaggtatcaattgataatttaaggttataaccgtacaaacttcagtgatttgctggtttcacattggttagatttgtttcaactaatttggtacttctgtagccttgtaatttacgaatctagtattaatattttcttaagtattagcctgttccttgatattatgctgttgagaaagtatgcaatagataacaaaaacaagtaggtgtgttgaggatgctcaagagtaatacagccacttcaataattctgatattatcaggacatcatcaataattctgcgcctacaaatcttcaaagaaaattttaatataatgcgtatgattttttaaatacgaatattgattgctatttaaagatatttatattatatggtaattattatttgaaggtttataataaaggtatttctacagtatagttatataagtattcaccagttttccatgaatattttggcatgtgattacaaagaagattatttgagaaaatccatgcttttatttcatcattttgtttgaagttgaactttaatttatggtgtaatttcagttattattgctagcagctcgtactctttaatggtataacttcacttgtgcttattctccaatatctcccttcttgttgttcaggttcaagaaaatcatttgttggattcagaatctggtgtccattttcttcttaaattattaaatcctccagtgaatcttgttgattccaaagcaccatcgataggttccaaacttcttggaatcagtaaagttcaaatgcttaatggatcaaataaggattctgactgcatttcagaggaaatcctttcaaaagttgaagagattctcttaagctgtcaagtgatcaagtcgctcgacaaagatgacaagaaaacaacaaggccagaactgtgtccaaagtggcttgctttgttgacaatggaaaatgcatgcttgtctgctgtttcagtagagggtaagttttaatcaaatttcttggtcatgatttccctttatgaccattatatttatttatatgagccaaataagcagttgtcaacttgtcataagttacatagcacctatttgcaatattcatgggtggtttgcttagcccttttcttcacctgcttttgattgatgacttccatctgtgttgcagaattgaattggagtagtggactgcactagaagcacctatggccattgtcatactaggaaggttttcccttatcaaatatttgattgttacagagacttctgacacagtgtccagagttggaggaaattttaaagagacattaagggagatgggaggtcttgatagtatttttgacgttatggtggattttcattcaacattggaggtgagatctcgctaacatcgcatattttacatttcctttgttcaactctaatggattgtgcaggcttgttccttttcgccattttagctttaatgtgcttgaagccacatgaaagtaatgcttgtccagatacatagccaaaggttgttatattttggggcatggaaaatgcttgaggtagtaactattttcatcaggacatggaaaattggctgcaacacaaattatgttgttttatgttgcaaaaatagttttttaatacttttttattctgcatgtggtgttagtatcttacagttcctctgatgattatatcccccacgataataacacttgaaacgataataacacttgacatatctacaccaagtgaacattattcatttggatgttacttttccagctatacttgctgttcttgcatgtgtaagcaagtttggagtaaattgcgcattaatttaaatgcttggtgttcctatctgtgtactttttattccccaactaataatgcaatcatattacgctgataaactgaataaataaatt

SEQ ID NO: 41369 - DNA, 819 bp, Oryza sativa
  unsure (1)..(819): unsure at all n locations
nnnnnnnnnnnnnnnnnnnnnnnnnnnnnnnnnnnnnnnnnnnnnnnnnnnnnnnnnnattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatattgaagcttatgtcgatgacttggttgtaaagacgcgcaaccaggaaacgttactcatagatctagcggaaacttttgagagtctccgctccgcccgcataaaattaaaccccgataagtgtgtgttcggtgtacctgcgggcaagcttctcgggttcttggtctctgcccggggcattgaggccaaccccgagaagatacgggctatagagcggatgcgcccccccagcaaacttagggatgtgcaatacgtcaccggttgcatggccgccctaagtcggttcatatcgaggctgggagagaaggcgttacccttatttaagcttctcaaacgctccggaccgtttacctggacgaaggaagctgaaaatgccctcacccagttgaaggggtatctaagctctcccccaggtctggtcggcccggagccagacgagcccttgctactctacttagcgggcgaccccgcaagtagttagtggcgcattggttggggagcgcgatgaggacaatttcatttcgcgcttccccaccctgtgcc

SEQ ID NO: 41370 - DNA, 811 bp, Oryza sativa
ttcatcatgactacagaaatgaacaatgttgctacatcttgtaataatttgtggttttcaattgaacaaaacatccatcaaatgatatctacagcaatatattttgcacttctgagcacacaataggtttgagtgtattcgagtcatggtcattgatttaagctttttatttcactacataaccattgatttgagtgtatctaaggagttctgtttccacaagtactttatgttaatggtgtctccttatgctttggccatccaaactcattactgttgtttaatatttttagtggttagtggtgtccaaatctttctttgtgtacatcatactatgtttttgtagtctattaaacttccatcctatcatctgacttgttatattccaggatgcttgtatacgaatatgtgaataacgggaacttagaacagtggcttcatggtgccatgcgccaacatggtgttcttacctgggaagcccgaatgaaagttgttcttggaattgctaaagcgtaagaaacaaaccatcgtccccgtcaaaaagaaaagaattgttcttcactttagctcttttatatgtatatgtttagttgcataacccattttccataactgaattggtatacaggcttgcttatttacatgaagcaatagagccaaaagttgtacaccgggatatcaaatcaagcaacatactaatcgatgaagaattcaatggcaaactttctgattttggcttggctaagatgctgggtgcagggaagagccatatcacaactcgagttatgggaacttttgggtatgttgatat

SEQ ID NO: 41371 - DNA, 3899 bp, Oryza sativa
  unsure (1)..(3899): unsure at all n locations
tcgggtaattaagtccagcaatatgacatttcgtggattaaatgctaagctgacattgtatcaatgatgctggcttatatataggttgttgagaagtgaaaatgtcgacaggtgaaaccctgcgtgcagagctatcatccaggacgccgcctttcggtttgaggctatggattgtgattggaatcagtatttgggtggtgatcttctttatactaggtttcatgtgcctctggtccatataccgaaggaagccgaagaagtcctttgataagattccagtatctcaaatcccggatgtttccaaggagattgcagtagatgaagttcgtgagcatgctgttgtcgaaaacttccgtgtgcaagaaagccacgcgatatcggtgcaggagaaacattacgagaaagattcagggaaaatgctggcacacttggttaggagtaaatcgagtgatgccgataatttgagccaatgcagctcggtgtaccaatgtgatagggctggtagctcgtattctggtgatgaaggcagctcgggcaatgctaggaggcacttttctcaatatgcaactgtctcagcatcccctctggttggtctcccagaattctctcatctgggctggggtcattggtttactctgagagatttggagcatgcaacaaatcggttttccaaggagaatgtcattggagagggtggatatggggtagtttaccgtggtcgactcataaatggaactgacgtcgcaataaagaagcttcttaataatatgtaagagatcctgaaatctattctgcgttttacagaacttgtgactccttctgatgccatcatattaattttcttttgatatggtgctgcaggggccaggcagaaaaggagttcagggttgaagttgaggctattggccacgtcaggcataagaatcttgtccgccttctaggatattgtgttgagggaatcnnnnnnnnnnnnnnnnnnnnnatcacctttgctgatggatggctagcttttgtttctactggcacattatttacttgcatagggatgtaggattgctcttggtctatgtccacctactcaccagattatctcaaggatagggttattcctgactgcactccttatgctatcgattttttcccttccaaatctgatggtgggattcagcatgcccagtgacagattatgctcagtccacagaaaccttctttggaccaccattcttttaccatgaaaatgtggccatagctctgaaagctaggattcactagaagcgcacaactgcttattggtttgttagttggctataacaaggtcttactgaaatgtacttccatagttcattactttgtgaatgcctgttcttgttcttcacgtttcttctcatgcatgttcaattctaaatttgtattcatgatatgtccaagctactgtattctccaaagaaaatcagaagtccattcacctatgtattttccagttttccgccattttggatactgctctagaaacaagttaataatatagatatttatatggtttggccagtgctgcttaagtgaccatcgagatagaaattgcttaagaaatatactaagatgttgagtgtcaggtgttttcggataatctagttaccaacaaataggtcctatgaatataatggtgtctgcttcacgtaattcaaaatccacactcagccaaaataatctgcaatagggtgttgaaaatatgattatgtttctcccttgttttcatcatgactacagaaatgaacaatgttgctacatcttgtaataatttgtggttttcaattgaacaaaacatccatcaaatgatatctacagcaatatattttgcacttctgagcacacaataggtttgagtgtattcgagtcatggtcattgatttaagctttttatttcactacataaccattgatttgagtgtatctaaggagttctgtttccacaagtactttatgttaatggtgtctccttatgctttggccatccaaactcattactgttgtttaatatttttagtggttagtggtgtccaaatctttctttgtgtacatcatactatgtttttgtagtctattaaacttccatcctatcatctgacttgttatattccaggatgcttgtatacgaatatgtgaataacgggaacttagaacagtggcttcatggtgccatgcgccaacatggtgttcttacctgggaagcccgaatgaaagttgttcttggaattgctaaagcgtaagaaacaaaccatcgtccccgtcaaaaagaaaagaattgttcttcactttagctcttttatatgtatatgtttagttgcataacccattttccataactgaattggtatacaggcttgcttatttacatgaagcaatagagccaaaagttgtacaccgggatatcaaatcaagcaacatactaatcgatgaagaattcaatggcaaactttctgattttggcttggctaagatgctgggtgcagggaagagccatatcacaactcgagttatgggaacttttgggtatgttgatatttttttggagttagtattaatctttcctatgcttagcttttactgttggaatgtgcagtacttcgcttattcatacaatataaaattttacatgctgcgaactttgtccttcgtatattataacaggtagctttctcattgctatcattgattcatttcaggtatgtggcccctgagtatgccaacacaggtctgttaaacgagaagagtgatgtctacagttttggtgtgctattactggaagcagtgactggtagagatccagttgattatggccggcctgctaatgaggtgagcatatatcctacaatctcatgcgtattatgtatgttacaaaagtccgtactattggaaattattttacggcaaaataacgtctatactaggagagacgaatttgcttcaggtgtatggctgtctggcagttgtctactgtctagttacccttgtctcacttttacagtctattgttttatttttcaggagctgactagctgtataccttgtcatatataacaacattgtaacgtggatgccttgcaggtgcatctagtggagtggctcaaaatgatggttggcacaagaagatctgaagaggtagttgaccctgacatggaggtcaaaccgaccattcgggctcttaagcgtgctctcctagtggcactgaggtgcgtcgacccagactctgagaaaagacctactatgggtcatgttgttcggatgctcgaggcagaagatgtcccatcccgtgaggtggtaacgctttctcctttcctgcaataacattcatcatattatatcattgcaataaatctgaagcttttgctgtaatcctactgaaggaccggaggagccggaggggcaacactgccaatgcagataccgagtccaagacaagctcaagcgaattcgagataagtggcgatagaagggactcagggccatcagcaaggtttcaaccctaagaagacggtgatcatagtcaagaacaatggcttcaaaactctatgcagtaacatggtggttggcagagaaaaaggggtatttctggagggcattgcattttgtattgtaggtctgcatggcggtagagactggagagagcacagtgtctgatgatggatacccggagacctgtaattcccattcagtattctgtttgctagtcaagcagcttgtacagatcgttgtctgttccattttttcattcttctggtttttttgtttaggaggctcttggattaccagtacgaaccgctgtctcttttctagaatcaccaacatggaacctatcaatatttactactagtactacgacttgctttcttcttgctggg

SEQ ID NO: 41372 - DNA, 5746 bp, Oryza sativa
  unsure (1)..(5746): unsure at all n locations
ccattttttcattcttctgggttttttggttaaggaggtcttggattaccagtacgaaccgctgtctcttttctagaatcaccaacatggaacctatcaatatttactactagtactacgacttgctttcttcttgctgagatctatcatgtactgtacataactgacgtgttcagctgcacttggacaagtagatgctcgttctgtatgtcgaatttacttgatgaggtcgagcattaagtaccatggctgcagccggcttctgtttagttgtgctgacatgcggcggcgacctcacgctgtgtggcccattcttgatcttgggccgaaactgtagcaacgggcgtacggcccatctatatcgggattgttcggcccgttgtagatgggccggatcgggattgcgacttacgtgcgacccatttcggttgggccggtggtccgctacttcatctagcagtggtcggcggcagggttcacaattccaatagaatccaaacattattggattgagttaaaaacacaaaccaatcggctttttgtcaggttcagaaaattttaaactgaattttaattttttgacaaaaatctatttagatttcgtctgtgtttttaggtttgtcaacggattcagcgaaatccgatgatatcgctcgtgagtggatttttgatccggtatcgagattgtgaacccttgtcgcgcattgcctgacaaagacaaccagtgaagcgccgtgcgcgccgcgtgcgcgccgcgtgacgcgaagatgcgcaggaaggaacaagctggcaagcggcgcgcccatgacggcggcggcgacgacgacccgcgcgcgtgcgtgcgtcaacgcacgcgaccggccgagatccgtcggtggccgcggctatatataatacatcgtcgcctcacaccccccacacaccgagtcatcgctcgccggagttagagttcgtagcggcgaaggatatagccatatattatagatggcgattggtgttggtggctgctgcgccgtgctgctcgcggcggcgctgctcttctcctctccggccaccacatgtaagcacgcccatcttcttcttcttctttttttctttctttgtttttttttggaaatgagccgcagctgacaaaaagatcactcacacatggatacactgtcgtgacactaaccaatgcctaagccattttgttttcttgttttggatttttctttttatgtgtatcacttttgcttgttgctcttgcagatgcttatgattccctggatccaaacggcaacatcacgataaaatgggatgtgatgcaatggactcctgatggctatgctgtaagtagcggtggcagtacaccaacatctctacctttattttcgtctcaacctgtacatttacactatcttgttctactacctctaataaaaaaatatatttgatgttttaaaatctattaagttctagagattaggaaagctacacatggttttatgttttgatactattaagtagtatattttataagttatattgaaggctggggtttcaaaagtttgactacactagatcttattcaaagcgtctaatgattactgaacggaggaagtatgaacttatagacttgaagttaaacagcatagccacatctcttcatgtatacttcatccgtttcatcttataagattttctagcattatccacattcatatatatgttaatgaatctagacatatatgtacgtctagatttattaatatctatatgaattgggcaatgctataaaatcttataacctgaaaaacggagggagtatgtcgcaaacaacaacaacaataacaacgagcaaaatctatatcgaatccggtttccctcttgtaactgtatcaaagatctgtcctctgaaacgtcccctgttcatcaggccgttgtcacactgtccaactaccagcaattccggcacatccagccaccggggtggcagctggggtggacatggcagcagaaggaggtgatctggtccatgtacggcgcgcaggccatcgagcagggcgactgctccatgtccaaggagggcagcaatgtcccccacagctgcaagaagcatcccaccgtcgtcgacctcctcccgggcgccccaatcgacctgcagatcgccaactgctgcaaggctggatcactgagcgcattcagccaggacccggcaaattctgccgcgtcgtttcagatcattgtaggccattctgggaacagcaatgagactgttagggtgccgaagaacttcagtcttatggcgcctggtccggggtatacctgtagccgtgctatgattgtgaagcctagtaggtttttaagtccggatgggaggagggcgactcaagttctgagtaagtagtccatctgttgttctttttctgaattgctgcttgatgcccaattgcttgtatgtcatgtggaaatgcattaggaacatagactcagttgtgatttcttaatgctaagttggattaggcataggtttagtgaggaagggacaggagttggtcacctaagactggttgatctgatattagttgaaaacaagttacagcatgctaggctttacaaggctgagcctacttaacaaatgttgtcatcttttttttaatcaattttgttatctagcaactaatacatgtcaaattcagacagacatccccatgattacatataggacttgttgtttgttttgagttctatagtagaaaaaattcctatattcagtactactagtagtacttcttaacaaaaaggaaatctctattcacagtgacatggaatgtgatctgcacatactcccaatttcttgcacaaaaggttccatcctgctgtgtttctctctcgtcgttcgacaatgacaaaactgttgactgcccaacatgctcttgtggctgccgaaatgaaaaatctactacaggaaaatgtgtaaagtgagttaatataactgttactgatcttaactacaatttccactgggatcctagcttcttgttttcaccaaaaaattgtaacaatttcctttgcatttgacaggaagaatgcacctgatttgcaatccatcattcacggccctggcagatggacctggcagcctcttctccagtgcacttcacacatgtgcccagtgaaaattaactggcacttgatgctcaaagacaaggaacactacagagtgaaaatcactgtcactaacttgaactaccgcatgaatttcaccgaatggaacctggttgttcagtatcatcccatcctcgatatcacccagatatctggcttcaattacaagtcaatccaagtcggcaaaataagtaagtcaatctggaaccatccttttttgataaaaaaaaatgcatgtgtatgtgtgtgtatatatacttctgacctatgtctagattcgtagccaaaatttattttttttaaggacagaaggtgtatataccatctctctatcttttgctcacgaagttttttttttctccttgtatgttagatgatactacgatgctatggggagtaaagccctactatgatttgctcatgcaagctggtccgcttggaaatgtgcaaggagaactgattgtgagaaaggatttcagggcttcttccactactaacaataacaagggaagggccttcccagtccgtgtgtacttcaacggtgataactgtgtgatgccgcctccggatgcatatccagttagtattacggcttagaggcgatcgtcaagatgattgtatcgcattactatatttatggggtcatgaataaagtgtattgtcttgcctattgaagattagaagtaactataattaaattgaatctccaactagtattaagattgtcagaggtctgttattttgcttgtagataaaattctgcctatgttaacttcgatggtgtcaaagatatcaaatccatagcagattcgtggcaggggccaaaaaaaaaaaaaggaaacgacagtgtaagaccgacagaatatgtaactcgaaaattagagaaacaacctaactaatccctctgtttttttaatgtttaccgccgttgattttgaagacattcgtctctaattttaaacaaacaacatgattcatatttttccatgcttgaagtttttttgaataaagcgaaggacataaaaagaaaccccgaaggagtacagcggaaagtacagtttagcaaattgattttgcaaattcatgcaagaacaaatgtttttgctttgaagtctgaaccaagcttcatgggagtgggactgatgctgctactctgaactctaagcattcagggatcagtttttcagaggacaaaatgtactaccatccataatacccataagatgaaaaacatacagtggcttgaaataaatacacacaaaatgaaaaacccgcaaaaaaataatgtaggtcatggacttatggttcgcctttaactgttggttttgttggtcagttgcagctcgaagcaagccccagcttgaagctcagtattcagcaacctcaccaccttccaaatgtatcagatcaaacaatgatttctgaaaagaaaaaaaaatcaatatgcttggtcgtcggtctccaaaaaaaaaaaaatatctgcttggtcaggcctgtcctgcacggcgaaaatttggcattgaagcatgtgactgaagatttggcagctaacacatgaaccttctttggtttttatttgggacaatttatactactttctccgtttcacaatgtaagtcgtctagcatttcccacattcatattgatgttaatgaatatagacaatatctatctagattcattaatattaatatgaatgtgagaaatggtagaacgacttatattgtgaaacagagagagtatataagtacactaagactttttcatataatactccgttagcttctctttaaatatgacgctgtagcattcagtggtcagtactgtaatgtactccctccgtacttataaaggaagtataaaggaagtcgttttggacagtgacacggtttccaaaacacaactttgatttcttatttctataaaaatatttattgaaaagtgatatgtgtatacttttatgaaaattatttttcaaaacaaatatatttcatataatttttatattttcaaactcaacaacataagagttatttatgatttatattctcaatgtttgacttaaacattatcctaaacgatctcctttacgagtacaaaggagtacagaggaagtacatgataattaaacgaagcagaaggctaaacattttcttgcttcgaaggtcagcacttccatcgttgatcacacaacgaaactaataaaggattccttttcattagtatttatattaaaaaagttactgctaccgttcaagttttagacttggctcaatgctcacatctataactaatcattgattcggcatactcattgacaacgagtcatttataatgattctgacaatcccaacatatgccggcccaatctcacgagagtttattgggataggatacgtctatgtgcatttgcataggtgaatgtgtagcgttgtttttttctaaaaaatatttcccaaggtaaaaagttaaaagaaaaatcaaaaaacgaatttgctagaaaatttccacaagtcttttttgcctccaaaactttcagatttatgaccatcggatnnnnnnnnnnnnnnnnnnnnnnnnnnnnnnnnnnnnnnnn

SEQ ID NO: 41373 - DNA, 905 bp, Oryza sativa
  unsure (1)..(905): unsure at all n locations
tcatcaggccctgccatgacgcctgtgttaggtcagccggtggctccgagaggccatagcctgggaaatcaagtgcaatagcacggaacccggctgctgctgctgcaatcatctggtgcctccatgagtaccacacctcagggaagccatgaacgaagagcagagttgcagcttcacctggaataaccaaatcaagaagctgagctgcattctttcggaagagcaaaaaaaagcagagagatgctgatgtcaacaaaaatgaggtaagattcagaccttttccaatgtgagctatgtgaagcttcaggcctctgatgggcaggtaggagtgctcaatcctctgatccattgatatgttctctccaacgtcagtctgatttgcttgagattatataggattatagcaatttatgggccgaacttttggtcaggctagtaacggatggatggcacaaagatgcgcacactttgtgtgaagcatcttctgctgatgtcttctgctgtttttgtcagtttgtggtagccagagacaagatgctgatgtcttctgctgtctgtattttaatactccaagcaacgctgcaaaatgttaactgaaaaagattccctctgtacgttcatcagtcaaataacgttactgaattttcatggtctatattactcgattttgactattacttgttcaaatacagtcattaaattgatttatgttatctttcacatgtgctgaagctttggtttgaagcaattgtttgcataaagaaaccagcagtaacaaatagcaaacagttcgttttactatctgcttcattctgataaagtagggctgtcaaaaaagctcgaagctnnnnnnnnnnnnnnnnnnnnnnnnnnnnnnnnnnnnnnnnnnnnnnnnnnnnnnnnnt

SEQ ID NO: 41374 - DNA, 1496 bp, Oryza sativa
  unsure (1)..(1496): unsure at all n locations
nnnnnnnnnnnnnnnnnnnnnnnnnnnnnnnnnnnnnnnnattcaattattatctaaatttacaaatttagatgcaatgattacttaaaaaataaatttattttggaatgaatggaagaagtcaaaatatgaacttaatatcacacgggagagtagttcatttactaatttttccataatagaaaacggtgcattaaatagatcggcagatagctggcaggaagctagccctggttggtgctcaccatctttcttcttccttaattgagatatatttggctccatcgattcatattataactcgattcaaatttttcttatcaaacattatataaatttatccaaatttataaaaaagaatatggtaacacctataacactaaataagtttccttaaatttaacaacctataacactaaataagtttccttaaatttaacattgaacttgatagttttttcgaaaatattactatatttttctgcaaagttagttaaatctaaagaagtttaacccaaaaaaattaaaatgacttacaatataaaatagaggtagtactaattttaaactttaaaattattaaattacaaattattcccacggtcacattcactcccactattacacgtggattataaattgtgtgcgagtacaatacttgatcccaatattacactttgcttctagacgtccctattttattacgttaagatagtctatcttgtaagttacgtgactttattactaacatgtgagtgagtccagtaaactctagattcacatgtcagtgataaacgcgtgatcacttcgaaggtagagagaggatctcaatcggcggcaaccgggtgctcggtgaagaagccgaggaggagccggttgacctgctccgggagctgctcctgcgcgaagtggctcccctccgggaggaactcgatcttcagctccggcgcgaacctctccatggcgccgccccgcacggcggcctcgaaccccgggaacttgaacgcgtagtccttctccccaatcaccatcagcaccggcacctcgaacctcgcgtccttccggcttggcctcctatgtaccgccctgcacgtacgatccatccatggagacatgcaacgatcagcaatggccagtgacgatctcatgttcaacatcccggggtcataggatccatgtaaattatccaatactccctccgttttattttaaatgtaaccatgagtctgtataaaacataaatagttgtttatgtgtgacttatgtttttaatttttttttcaaaaattttttaaataagaaggatgataaaatcatggctgcacttaaaatggaacgaagggacaagggagtactaactaaattgcataatagtaattactactccctctgtttctaaatatttaacatcgttgatttttttaaatatgtttgactgctcgttttattaaataaatttaagtaattattaattcttttcctaacatttgatcatt

SEQ ID NO: 41375 - DNA, 2304 bp, Oryza sativa
agacttaatatgggcaaatgatgttgcaaacctttttgaatgataagctatttgtaaaccacaacctattcatgcatgaggatgaggcatgatatgccacagattaaccatgccatgtatggaatttacagtatttacagcagtattttgctgtttttatgttccaaaccgactacgattcaaacagcctccagatagctttcatcataagctttgctcctaggtgtgcaggaattatgctcagcccatcaactgcctccaatgccttagcaatttgtgcacacatttcagcataagcggtctgcatatgaactttcatgttactattttgtggatttaatttttttttgaacatggactgcaggggtacgttgatgctgttctagatttagcgtcacattttatcacacgcttgcgacgctatgcgagcttctgccgaactttggctagccatgcagttggagcatcttctggttcaggcaattctaggaatatggttacaagtccaaccaacagttctccttcaccttcaactaaccaaggttaattttgattccgtctatcttgctaaagcttgtgcttttttttttggtgctaaataaaaccacctatgaattatttgtttctttatttaattttttggaaaatgacaagttgctggcacatttcaaacttagcaatgatgctaatgtttcaggtaatcaaggtggagtagcgtctacaacagggagctcacaaatgcaagagtgggtccaaggtgccattgctaagattagtaacaatactgatggtgctgcaaatgctgcaccaaatccaattagcgggaggtcatcattcatgcctattagcataaatacgggaacattccctggcacaccagctgttagacttattggggactgccatttccttcatagattatgtcagctgttgctattttgtttgctttttcggagaaggcaatctccaaggatacctgcaaatgcacaaaaaagttctgattctagcatgcagaaacaacacttgatgaacagtaagacagaggataatactttggcagtcagatctggtctaggtgctgccaaattggaagatggcacaacttcacgtgcacagatggttggagcaaagggtgctgaagaaaatccagtgggcaacaaatctgctaggataggttctggcaatgctggccaaggttatacttcagacgaggtaacaaacaaataacccataaatatggattttctcagcctgaattgttcaataagaaaacttttttcaatctgaaaatagtgatagttatacatataacagtatttttgtatgtgcgcttcgacatcaatatctagcctgtattgtttctgaatcaacatttagattagagctgttatatagtgtggttatatgtctgcatatcatatatcatgtgtgtgtctaaattgtttgcaagtgccatatgattaagggtaattagacatgattggataatttacctagtataatctttgatcggtgatttgcccgacatgtttctcccgattttattagttgcctttctgaaagtattatttgtgtagcactgtaatacatctagtttctgaattatttgtttcatgcttgcaggtgaaagtcctttttctcatattagttgacctatgtaaacggactgcaaccttgcaacatccgttgccttcttctcaggttggttcgagcaatattattataaggctgcattacatcgatggcaattacactgtgctccctgaggtagtggaagcatctcttggccctcatatgcaggtacaatacagatttattgtggaagtttatttctgtattctctgtgtactcattagagcattcaatgttctcttctcagcaatacattatagtaattctcaattgtgttggagaaatagagatatagtattttgcaagttctactctacttacctgggttaacgatggattgatccagcaaaagaatattgttgtccaagttaattatggaaattttcatttatacaagcacacgtgcataattggtttttatgatttcttttgttcatacgttctccatctgcctatataatttattactcatggcctcagcgccctcttgtcaccatttaggagttctcattttcatcagcatgtacatctttggtaagagtagtgagcatgtacatgtccaacaagagctgtgtacacgcatttctgtcgagaatttataccaatgttgcccatttgttccaatatttattgcagaatatgccttgtccacgtggagctgatgctgctggc

SEQ ID NO: 41376 - DNA, 1918 bp, Oryza sativa
caggccctccctggtatggtatcatagtttacctgcagcagtcagagcagattgcaccagcagctgtgtaaaacggtaggaaaaaacaggattaggacatgcccaaacactgtcagagtcagcagttgtgttgtgcgatccttttgtacataaatgtagtgtactaatttgcaacattggaaaagaaactccgttagatactgcttgatgtcaataatatttgctggtgattgaaaagaccatgtatgtaatagcatgttcaattgggtgtttctctcataagctatgctatgttcaacttgtggctttagatcatcgttcaacgtggtcgacaaaataaagacgaaatttgaatttctgttcgaatcttttcgaagggtagaaagtattcaaactgcgcttggttctgatatttacagagctacctgtaatactgtcatcctagaacacttgcaaaaatttacaagtgcttaaaaatattatcgagtgtacagaatttgcttaaacttaacaaaatatattctcgaaatatacacactacaaaatttgctaaaattgggaagtatcagcggtgtggtggtctaatatttaaatcttatacccacgaatattatgtacgcgtaatttgggtttcaatataaatatcgtgaaaataggatttgccgctagtttctaattgtgttagagaagcatttgcgagtgtgcaagtgtggtgttgtatgcgtagtgctgtgcgttcgtgcatatggttcagtcgtgtaataaagaaatgctaagggtgtgttggatgctagtgacctagaacttgtccctttcacgcaaaacagagcaacaaattagcgcatagctaataaatatattagtaaataatttaaagaaataaattgatatgattatttaaatcaactttcctactttttaataaaagacagactatttagtacttgtcgacgtttgatgtcgcgattccggtatttgcatagtatggagatcgttggtactaggatatacgcgagaccgaggtaaaagagacgaagacagagatttttatacaggttcgggcccctgaattgtcaggtaataaccctacatcctgttggccgaagcggtcgttgctcttattcaccataatcacaccagtataatatttggagtagcatatctaattgttgtcgacatggcggtctgaagatctgactcatagtcgacgacagggtagtcttcctcctcgaatccatgcccggcgagatcagaaacagcgctagatccctacggccggcctctgtaggtatcggatagggtcgatccagaggacgccgaggtcgtcggtaaggacgtgggaggagccgaggaatagagagagagggatagagagaagggaggaaggagggaggattatgacgtggcgaccctgacatgtggggtccacgtgggttccacgctgattcaaccgccacataggataaaaccggagttaaaaccgtcgagggacctaatttgcactggttttgtaaattgggggatgcattgtatccggttttgcggttcaaggatgattttgtaattcgacgacaagttgagggaccttcggtgtaccttttcctttgtttttagccataacccagttcaatacctccccacgctcggcctatatctttttggcccaacacacaaacaggcccaagccacaagcataagtggagtcataggcccaacttacatagcctactgcgatcttcaaccttcggaagatatcctatgcatgcatgatgccggagccggtcctcgtcatcaaatccaaccaatctttcttgatttggttgagggcttttgatccactcgatctcttctccccgtttccccaatatcagagagaattcacaaaaaaacgggacaaaaaggcaaagctgggtcagcc

SEQ ID NO: 41377 - DNA, 4791 bp, Oryza sativa
  unsure (1)..(4791): unsure at all n locations
nnnnnnnnnnnnnnnnnnnnnnnnnnnnnnnnnnnnnnnnnnnnnnnnnnaaccatctcggggaagccttgtttcccctccaaagtggtcgtttaaccgaccccctcgcaggttcgtctctcacccatcgtggctgtattcattctctcaacgcgagttttcactcacccatcttgttcgtcttctggtcttttcttctgtttcagcgagatcccgtcgcgtccctcccgccattccaagtccggccagtctgaggccgaggatccggcggccgcagaggcccggaggcgggaatctgaccggcgagaggccgcggatcgcctacgggaagccgaggaggccgcccaggaggccgcccgggctcgccagggcgaggaaaccgctcgggaggaggccgcccgggcccgccaggccgaggaagccgctcgggaggaggccgcccgagcccaccaggccgaggaagccgctcgggagaaagccggatttcgcaaggacgaggcaatggcgacttccgaggcagctcgcgatgaggtcgcgggcgcgtcgcttgagcccgcttcctcgggcgacgctcaggcgacaacttccggggcagctggcgacgaggctgggggcgcgtcgcttgggcccactccctcaggcgacgcccaggaccaaccaggtctgagggacatccccgagtccggcacttccatcggcggcccgagccgcgtggcatcctctccaaggcggctcttccccacgccttctatcgccccgctgagcgcagagccccttctgcaggccttggccgccgcaaacatcgcggtgttggacgggcttagtgcccaggtggaggccctgcaagcagagtgggcggagctcgacgccgcgtgggcgcgtgtcgaggaggggcggcgctcagtggaggccatggtggaggtgggccgcaaggcacaccgccggcatgtctcggagcttgaagcccgtaagaaggtgttggcggaaatcgccaaggaagtggaggaggagcggggggctgccctcattgccaccagcgtgatgaacgaggcgcaggacaccctccgccttcaatacgggagctgggaggcggagctagggaaaaagctcgacgccgcccagggggtgcttgacgttgccgctgcccgagaacagcgggcgggggagaccgaagcggcgtcccgacggcgcgaagagacccttgaggcgcgcgccatggcgctggaagagcgcgcctgcgtcgtggagagggatctggcggaccgcgaggccgccgtcactatccgggaggcaacactggcggcgcacgagtccgcctgtgccgaagaggagtccgcactccgcctccacgaggacgcgctcaccgagcgggagcgagctctcgaggaggccgaggccgcggcgcaacggctggcggacagcctgtccctccgcgaggcagcgcaggaggagcaggcgcgccgcactctggaatgtgtccgcgccgagaggaccgcactaaaccagcgggccgctgacctcgaggcgcgggagaaggagctggacgcgagggcgcgcagcggcggggcggctgcgggcgaaaacgacttagccgcccgcctcgctgctgccgaacataccatcgccgatctgcagggcacgctaaactcgtccgccggggaggtcgaggccctccgcttggcaggcgaggtagggcccggcatgctttgggacgccgtctcccgcctagatcgcgccggtcggcaggtgggcctctggagagggcggaccgtaaagtacgccgccaaccatggaggcctcgcccagcgcctctcgaagatggccggggctctccaacggctccccgaggagctcgagaagacaattaagtcatcctcgagggacctcgcccaaggagcggtggagctcgtactggcgagttaccaggccagggaccccaatttctccatggatggcgctggatgagttccctcctgggaccgaggacagcgcgcgcgcaggtccgggatgccgccgaccatatcgtccacagcttcgagggctcagcccctcggctcgcgttcgcccccaactccgacgaggaggacaatgccggtggtgcagacgacagtgacgatgaggccggcgacccgggcgtatcggattgatcccccaagcccccgccattcttcagttttttcttcttttccttcttctaaggccttcgggcctcttttttgtatagatcaacttaatctgtaatcaaaaatgaagaaatttttgtgtcaatttcatcttgctgtgtgtatgagatgaggatgatctgtgacgtggtccttttgcgtcttagcttgattaagggctcgtgcccaggtcccagtcctcaaaaggcgtgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgaaggcaggattgagcacgagtgacctatttcaagtcaagattcttcaaaaggaaaaaaaaacacagatacagcctttaggaaattgaaactgcttttattgaaatactgaaataagagaaataagaatgtgcatgtgtggcagcccccggccaaccctgcacgcccgagggggtgcggggttggcccaggcccgaaacctgacacccgacccccccctcaggggtagaagcgacgaaggtgttcgatgttccacgggttaggcagctcaatgccgtcgcccgtggccagccgtatggagcccggccgggggacgccgaccactcgatacggaccctcccacattggtgagagcttgctcaatccacacgcgtttggacgcggcgtaggacgaggtcgtcgacgcagagtgatcgggcccggacgtgacgctgatggtagcgccgcaggctctgctggtagcgcgcggctctgagggccgcgcgtcgccttcgctcttccaagtagtcgaggtcatctctgcgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttctgaatgggcgcgctccacttggccattgctttttgggtgggcaggtgaggcgaaacaaagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtaaagtcttatctgtgaggtatgcttggatctcggcaatccaagcaatcaatctaagggagctgggagcgctcccctcgggtcccgaggcctggacttcaacgggcctcgggggccggtcaggcgcgtccgtctcccctaaggggtcgggtcgcgccgacggctgggcaagcctttcttcaaaggcgcccggtggggtctgggctcgcgtggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattgttggtcgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggattgagacgggctcgggagccggggtccactctgccacaaaatcggcgagagcctggctcttgataggtggcgtggttcaaagtccaaatgaactcagaaagttcgattgcccatttcaccacccgtcctggaccgtttcgattatgcaagatttgaccgagggggtaagacgtaaccacagtgacccgatgc

SEQ ID NO: 41378 - DNA, 3502 bp, Oryza sativa
ggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccacagtggctttggggcccgcctgggggtcaagggctcctggcgtcgtcggacaagcgggcaaagggccaactccggtcgtcaggggccttaagcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggcctcgggccaccgttcggctcgggggcctctcctccctgctctctcccgggccaagtcggcacagggtggggaagcgcgaaatgagaattgtcctcatcgcgctccacaaccaatgccgcactaactacttgcggggtcgccgctaagtagagtagcaagggctcgtctggctccggggcgaccagaactgggggagagcttagatacgccttcaactgggtgagggcattttcagcttccttcgtccaggtaaacggtccggagcgtttgagaagcttaaataagggtaacgccttctctcccagcctcgatatgaaccgacttagggcggccatgcaaccggtgacgtattgcacatccctaagtttgctgggggggcgcatccgctctatagcccgtatcttctcggggttggcctcaatgccccgggcagagaccaagaacccgagaagcttgcccgcaggtacaccgaacacacacttatcggggtttaattttatgcgggcggagcggagactctcaaaagtttccgctagatctatgagtaacgtttcctggttgcgcgtctttacaaccaagtcatcgacataagcttcaatattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgctagccactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggcagcacttcggtcattacgccggcgctcgatgctggtgcgggcgtccggccccccacgcagatctttctgggtcgaaggagtcaacgaaggagtggcggccgaatggcgaacagcggctgccgctcgtcgtgccctccgtcttgacgaccggagccggtggtagcagcaccagaggccttggtggcggaggaccgcccaccagcatctaggcgctgccgtaccgtcatgactaatttggccacgtcgtccagccatcgttgggctggagactccgggtcagggacgacaggcgggtgacgtaagagcgcgcccgcagcttggagcgcgccctggggcgtgctgccgtcgccgtagacgaggaggcgacgctccccatctcgccgttcttctccatcgcccgcgatcggtgaagtcgcggatctttcgaccctctcgagcgcctccccccgcttaggactttggcgtggagggagcggtggagtacgagctcgacggcgtgggttcggctccccgtcgtcgccactcacactcggagagaggtcgtgcgcctttgcttgctcggccatcaggctgaacaggaaaagcttggcgcacacggaagagtacgagagctcagaaaaacacacactgagtcccctacctggcgcgccagatgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttggggggatctgtgtatgaaggagctacaaagtatgagccagcctctcccttgttctgggttccgaatctggaaaagtccagtccagtccccccctctaagtgggcaaggtcctccttttatatcttaaggggataccacatgcaccatctccctcctttctgtggggacttaccctaccttttcataaatggacggagatttgtatagttgccgtccgaatgaccttctgataggacggcccatacctacctccacttccgccgaaagcaggtgcgacgtgggattatggctgtctgctgacgacatgaccagtgtcagactggtcacaaattgctcattcctgtccaccacgcgtcagtttagcaatctacatgttggcccttcttcacacaacatcttgcctgtaatggttaggatgaagcctggcatatatctaaccaggactaacgtgccatctctaggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcacttcgttacatgccgcgtgacacgctcagccaaaccgcaataaatgtggttaggtgagccccgctgtgctcacctaacccatacacgcggagcaaaaacccacgaggggtcggggcgcctcggccctcggggccgaggcgggtgcggtccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcaatggtaactctac

SEQ ID NO: 41379 - DNA, 1991 bp, Oryza sativa
  unsure (1)..(1991): unsure at all n locations
actatagggcgaattcgagctcggtacccatcaatggcttcttcaaggagggggatctggacaaaatgcttgaccagaggatttcgccaaatgttgtgacctacaactctattattgctgcgctatgcaaggctcaaactgtggacaaggccatggaggtacttaccaccatggttaagagtggtgtcatgcctgattgcatgacatataatagtattgtgcatgggttttgctcttcagggcagccgaaagaggctattgtatttctcaaaaagatgcgcagtgatggtgtcgaaccagatgttgttacttataactcgctcatggattatctttgcaagaacggaagatgcacggaagcaagaaagatttttgattctatgaccaagaggggcctaaagcctgatattactacctatggtaccctgcttcaggggtatgctaccaaaggagcccttgttgagatgcatggtctcttggatttgatggtacgaaacggtatccaccctaatcattatgttttcagcattctagtatgtgcatacgctaaacaagggaaagtagatcaggcaatgcttgtgttcagcaaaatgaggcagcaaggattgaatccggatacagtgacctatggaacagttataggcatactttgcaagtcaggcagagtagaagatgctatgcgttattttgagcagatgatcgatgaaagactaagccctgacaacattgtttataactccctaattcatagtctctgtatctttgacaaatgggacaaggctaaagagttaattcttgaaatggtggatcgaggcatctgtctggacactattttctttaattcaataattgacagtcattgcaaagaagggagggttatagaatctgaaaaactctttgacctgatggtacgtattggtgtgaagcccgatatcattacgtacagtactctcatcgatggatattgcttggcaggtaagatggatgaagcaacgaagttacttgccagcatggtctcagttggaatgaaacctgattgtgttacatataatactttgattaatggctactgtaaaattagcaggatggaagatgcgttagttctttttagggagatggagagcagtggtgttagtcctgatattattacgtataatataattctgcaaggtttatttcaaaccagaagaactgctgctgcaaaagaactctatgtcgggattaccgaaagtggaacgcagcttgaacttagcacatacaacataatccttcatgggctttgcaaaaacaatctcactgacgaggcacttcgaatgtttcagaacctatgtttgacggatttacagctggagactaggacttttaacattatgattggtgcattgcttaaagttggcagaaatgatgaagccaaggatttgtttgcagctctctcggctaacggtttagtgccagatgttaggacctacagtttaatggcagaaaatcttatagagcaggggttgctagaagaattggatgatctatttctttcaatggaggagaatggctgtactgccaactcccgcatgctaaattccattgttaggaaactgttacagaggggtgatataaccagggctggcacttacctgttcatgattgatgagaagcacttctccctcgaagcatccactgcttccttgtttttagatcttttgtctgggggaaaatatcaagaatatcataggtttctccctgaaaaatataagtcctttatagaatctttgagctgctgaagccttttgcagctttgaaattctgtgttggagttcttttctcctacagttgtattagaggagggatcttctctttatgtgtaaatagcgaggtatgtatgtcacctctccgaattatttttactctggttcctagacggtaaacaagcaattnnnnnnnnnnnnnnnnnnnnnnnnnnnnnnnnnnnnnnnnnnnnnnnnnnnnnnnnnnnn

SEQ ID NO: 41380 - DNA, 1164 bp, Oryza sativa
acattatgattggtgcattgcttaaagttggcagaaatgatgagccaaggatttgtttgcagctttctcggctaacggtttagtgccagatgttaggacctacagtttaatggcagaaaatcttatagagcaggggttgctagaagaattggatgatctatttctttcaatggaggagaatggctgtactgccaactcccgcatgctaaattccattgttaggaaactgttacagaggggtgatataaccagggctggcacttacctgttcatgattgatgagaagcacttctccctcgaagcatccactgcttccttgtttttagatcttttgtctgggggaaaatatcaagaatatcataggtttctccctgaaaaatataagtcctttatagaatctttgagctgctgaagccttttgcagctttgaaattctgtgttggagttcttttctcctacagttgtattagaggagggatcttctctttatgtgtaaatagcgaggtatgtatgtcacctctccgaattatttttactctggttcctagacggtaaacaagcaattatgttctgcctttgatgccagaaaaaacacaaaagtttgtcgttatctctactaacggatcataaaggaatttgtaactggagtttcaaacttaatttgtctaggcagtagttttggcattagatccaacattgtgtaggattcatttgtgtgtatcaatctatagggtttcattaaatttcgttaatgtgtactgtttaggtgttgaatagtttgacttgttttttaactgaacaaaagatactgaaatcgttccattcaacaaacacatgttccgttaatgaaattattgtacgttaccttttgttttcttactcacaagtgtcctcttttcttatatcctatagattggtacaacaaattattgattcaattttggttttgaacattgatgatcctccctgcactattggtgcagctgctcttctattcattttgtgaagtgatgtgagtacctctcaatcccatccttatgcttctgtgcatgcttcattccaattttttacgcatatcgattgttttcttttatataacagtccataaagataatcacatcatgacaaagttatttatttcgacagtatagttatataagtatt

SEQ ID NO: 41381 - DNA, 2757 bp, Oryza sativa
  unsure (1)..(2757): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttttttgggggnggaaaaaagggggggnccggaaattttcccgggngggttggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgagggaatggagaacctgccaccgaatagtagccctgctgtctatgttgcgaaccatcagagtttcttggatatctatacccttctaactctaggaaggtgtttcaagtttataagcaagacaagtatatttatgttcccaattattggatgggcaatgtatctcttaggagtaattcctttgcggcgtatggacagcaggagccagctggtatggctgtagtctcatccctgctttcttaagtagacatatatgcatttacagaatttggtaaacaaacaagattttatgaatcatatatgattttggggaaaacacaaaactctctttgttggctgccttgaacatagttctattcacacagttatagcaccttctttaaaatgaagaactttgttgcatacacataaggccaaaccacataatgaattttgtttatttctatctttgaatgttagcaccttattttcatgcatatcatgctaatttgcttgcccacgttgagtgggaatttttttccatgttttataatttatatatgttctagacttctagtccacaatttatctacttcatgttcctgagcctctagtatggctggtagcagactaggtgctgagtgctgtccatttttgcagactgaagagaggagaaatacaggactgtccgttgttagtcagatttgtaaaaatagactctgatgtagtttattttagcccctattttatatttaacaatacaaatatataacgtatcctaagaacttatcgtaatttaggagaagttgctcgtttcattaaattaaactgtgaagtaaaaatgtgtgctcgagtctgtcaatgcaatcctgtgttcttgtttgaagatatggtgtagggcaggctaggatcgaacactgaatggtaagactgcttctgccttcatttgtgcacttggtgctgccacgccgattaagcagtagaacaaagtaattttgtcgtgcacaaatgagttatatttcattgaaaatcgaagtgaaaatgaaccaaaagatagaagaaaaggggaaacttggtaattatatactccacaaatttattggtaagatttgatattagacgctcgattacttggcttaagttaaggatatcaaatttggggaagcaccaaaggaattattgtgaaggagttgtgggtgcataacgttatctactaggttcaaatcctagtgactatgaatattaatgagtaaggtaagggatttattgttaattttagtttctttaagattgtgtccgggtacaccattcggtaagtgtaataatgttttgtattggattcacttgtgttacgtgcatgtgatttaccttttcatttgtttctgcgttctgggtatgaatttgacgagattccatggtcagctcaacatatcagttactgcgtgtcaagcgatcttatatggtatgcgcacaagcgattgtatacggatatgacagtataacgtgtgatattgatacgatgttcctttcctttataaaggaacaaagacttttttaaaaaaaagaaggggtattactaaaaaccaaaatgtcaaaaacaaaatatcagtgcacatggcaagtgtgcacgagcaatagcttgcccttacgttcattatttagcatgtactactactaactacgcaaaaatcaattcaccgattattaaactgttaacatcattttagcacgttaacatatgtttcattcaacacaccggttttggcacatttacaaacttgcaaagttgcaatactcccttcgttacatagcataagagattttaggtgaatgtgacacatctatccaaattcattatactagaatgtatcaccgcctccacgccgggagggagagcgccgccggtggagaaagggggagggagtggtcgaggggaaccagtagggtgccctccccgtcgccgcctccccgtggccgcgccggcgagacaggaggaagagggggatatggagcggcgccgccggtgagggcgcgcgcgcgggggggagcggcgacgccggtgaggaagggaaggggagtggtggctttgagagagataggggggaggaaaaatgattttagagttagggtttgggctgctgagtttttatatagatcgggatcaatcaggaccgtccatcagatcggacaactacggcttctcccgcgtggccgggtgccactctaggttgcccacactattgggccacatgtacgct

SEQ ID NO: 41382 - DNA, 2958 bp, Oryza sativa
  unsure (1)..(2958): unsure at all n locations
nnnnnnnnnnnnnnnnnnnnnnnnnnnnnnnnnnnnnnnnnnnnnnnnnnnnnnnnnnnnncctaaaaccagtgcaaatctttaatttttagttcacccattgcaactcacgggcatatttgctagtgacatataatatgaaacgaaggatgtagcagactatagaatttaaactgtgctttcattttagagcatcactaactgttatttagatttttatttaaataaatgctgaaatgatgtttttattatgaaaattagcaataaagctcccaaaatttcaaaaaaaaattaaaagagatttattaatcatggttaatttaattaaaaattaaatctaaccatatcatattatttcacggtccgtgatgaggaaatggcagctgctatcacttacggtgggagagaaggggcattgtttatttttataactatctcttataactcccatgaaactataaaataaatataatcattatcataacattagttttttttccattgcaacgcaagggtaatttttcagtacaataaaaaaaataaaagtgggccattctgaacggaaatttctggttttttttcccaagagcgccgcacacaactgcgcaagagatcgatcgcgatcaccctgctcgtcgccgatctcctacaccatccctgccatctccttcccctccactggctgctgctgcacctgtcagctagggcgggcatggcgcgccgcgccgcttcccgcgctgctggcgcccttcgctcggagggctcgatccaagggcgagggggccgcgcggggggcagtggcggtggcgcggaagacgcacgccacgtgttcgacgaattgctccgtcgtggcataccagatgtcttctcctacaatattcttctcaacgggctgtgtgatgagaacagaagccaagaagctctcgagttactgcacataatggctgatgatggaggtgactgcccacctgatgtggtgtcgtacagcaccgtcatcaatggcttcttcaaggagggggatctggacaaaatgcttgaccagaggatttcgccaaatgttgtgacctacaactctattattgctgcgctatgcaaggctcaaactgtggacaaggccatggaggtacttaccaccatggttaagagtggtgtcatgcctgattgcatgacatataatagtattgtgcatgggttttgctcttcagggcagccgaaagaggctattgtatttctcaaaaagatgcgcagtgatggtgtcgaaccagatgttgttacttataactcgctcatggattatctttgcaagaacggaagatgcacggaagcaagaaagatttttgattctatgaccaagaggggcctaaagcctgatattactacctatggtaccctgcttcaggggtatgctaccaaaggagcccttgttgagatgcatggtctcttggatttgatggtacgaaacggtatccaccctaatcattatgttttcagcattctagtatgtgcatacgctaaacaagagaaagtagaagaggcaatgcttgtattcagcaaaatgaggcagcaaggattgaatccgaatgcagtgacctatggaacagttatagatgtactttgcaagtcaggtagagtagaagatgctatgctttattttgagcagatgatcgatgaaggactaagacctgacagcattgtttataactccctaattcatagtctctgtatctttgacaaatgggagaaggctgaagagttatttcttgaaatgttggatcgaggcatctgtcttagcactattttctttaattcaataattgacagtcattgcaaagaagggagggttatagaatctggaaaactctttgacttgatggtacgaattggtgtgaagcccgatatcattacccttggcaggtaagatggatgaagcaatgaagttactttctggcatggtctcagttgggttgaaacctaatactgttacttatagcactttgattaatggctactgcaaaattagtaggatggaagacgcgttagttctttttaaggagatggagagcagtggtgttagtcctgatattattacgtataacataattctgcaaggtttatttcaaaccagaagaactgctgctgcaaaagaactctatgtcaggattaccgaaagtggaatgcagattgaactttgttagatttaattggataattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattaatcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggannnnnnnnnnnnnnnnnnnnnnnnnnnnnnnnnnnnnn

SEQ ID NO: 41383 - DNA, 3236 bp, Oryza sativa
  unsure (1)..(3236): unsure at all n locations
nnnnnnnnnnnnnnnnnnnnnnnnnnnnnnnnnnnnnnnnnacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaaacttagcacatacaacataatccttcatggactttgcaaaaacaaactcactgatgatgcacttcgaatgtttcagaacctatgtttgatggatttgaagcttgaggctaggactttcaacattatgattgatgcattgcttaaagttggcagaaatgatgaagccaaggatttgtttgttgctttctcgtctaacggtttagtgccgaattattggacgtacagattgatggctgaaaatattataggacaggggttgctagaagaattggatcaactctttctttcaatggaggacaatggctgtactgttgactctggcatgctaaatttcattgttagggaactgttgcagagaggtgagataaccagggctggcacttacctttccatgattgatgagaagcacttttccctcgaagcatccactgcttccttgtttatagatcttttgtctgggggaaaatatcaagaatatcatatatttctccctgaaaaatacaagtcctttatagaatctttgagctgctgaagcattttgcagctttgaaattctgtgttggaattcttttctcctacagtccgattagaggagggatcttctctgtatgtgtaaatagcgaggtatgtatgtcacctctccgaattattttgactgtggttcctggactgtaaacaagctattatcttctggtgttgatgccagaaaaaacacaaaagtttgtcgttatctctactaacggatcataaaggggtttgtaactggagtttcaaacttaaggtatctaggcagtaggtatatattgatcctacatcttatgatcttaagatgatatccttctcattatcctctgctgaaactttagcttgaaccgtcatctacaccacaatttgagccccttagcacagagcacaacgagcaatagcttgcccttacgttcattatttagcatgcactactactaactacccaataatcaatacatcggttattaaactgtttgtacagtttaataatgtcattttatcacgttaacatatgtttcattcaacaccacaccggttttggcacagttgcaaacttgcaataacatttttactacttctccgccccataatataacaatctcgttccatactatattgctatattacgggacggatgaagtacttctttccttccaaaatataagaatctagtactagattagatattatttggattcacgaatttgattaggctatctagatttgtagtcgtatgtaatgtctaattcggtaataggttattacctctttggatggagggagtagtttttatttcgtactccctctgtttcatattataagttgttttgacttttttcttagtcaaattttattgagtttgactaaatttatagaaaaaaaattagcaacatttaagcaccacattagtttcattaaatgtagcatggaatatatttttataatatgtttgtttttttattaaaatgctactatatttttctataaatgtagccaaatttaaagaagtttgattacgaaaaaaaatcaaaatgacatataatatgaaactgaggatgtagcagactatagcaaatttaaactatgcttttattttagagcatcaccaaaagagatagcctaaatcttatcttaactaattaaaatattcataattttcctttcgtcacattaaattttcgtccgtaaatccgattgaaatccaactagacaatccaaaaaatagagaaaaagaacagaaaaaataataaaaagcacacaaatcttatctcaatcccgcgggaagctgccgatgccgccgaatccgctcgagcgccgccgccgccgctcacggggaacgatgtcgctgctatcgcacgtggtatgggagggcgccgccgccgctgcttgggagataggatatggagagagaaggaaatgtgagggagggttaggtttttccccattcgtatcttcagcgacacggaggcgatccaagctgtccatcagatcagacggctcagaacgcctccatcttcaggccgcgcatgcttgatgggccgagggaaggccggagggtcgaacaaacgtagtcagaggaggagttggaggaggtaaagtagaatttatttgcgggctgagatagtaaatggactgaaaatggcccatagagaaattgggaattttatttaaataaatgttgaaaaggtgtttatattatcaaaattagaaattaagctccgaaaattttaaaaaatattcaaagagcattattaatcatgattaatttaataaaaattaaatccaaccatatcatattatttcacggcgcgcagtaggaaaatgcgcagctgttgtcgcttacggtgggagagaagggacattgtttattttcagaactatcttttataactcccatggaactttaaaataaatataatcattattatagcattagtttttttctgtcttttttttccccaagagcgccgcgcagaagagatcgatcgcgatctccctgccccgacgtcgccggccgatctctcattctctccacgccctgctcgtcgccgatctcctacaccatccctgccatctcctccttcccctcccctctatcctccactggtgccgcccacctctccgtataagacaaactgcgtcgcggcgtt

SEQ ID NO: 41384 - DNA, 5618 bp, Oryza sativa
  unsure (1)..(5618): unsure at all n locations
ccgacgaggtaactcccgacttgtgcacctacggcattctcatcggttgctgctggcgcgcgggccgcttggaccttcggtttcgcggcctggggcaatgtcattaagaagggatttagagtggaagccatcaccttcactcctctgctcaagggcctctgtgccgacaagaggacgagcgacgcaatggacatagtgctccgcagaatgaccgagctcggttgcataccaaatgtcttctcctacaataatcttctcaacgggctgtgtgatgagaacagaagccaagaagctctcgagttgctgcacatgatggctgatgatcgaggaggaggtagcccacctgatgtggtgtcgtataccactgtcatcaatggcttcttcaaagagggggattcagacaaagcttacagtacataccatgaaatgctggaccgggggattttacctgatgttgtgacctacagctctattattgctgcgttatgcaagggtcaagctatggacaagccatggaggtacttaccacgatggttaagaatggtgtcatgcctgattgcatgacatataatagttatttcttgaaatgttggatcgaggcatttgtctggacactattttctttaattcaataattgacagtcattgcaaagaagggagggttatagaatctgaaaaactctttgacctgatggtacgtattggtgtgaagcctgatatcattacatacagtacactcatcgatggatattgcttggcaggtaagatggatgaagcaatgaagttactttctggcatggtctcagttgggttgaaacctaatactgttacttatagcactttgattaatggctactgcaaaattagtaggatggaagacgcgttagttctttttaaggagatggagagcagtggtgttagtcctgatattattacgtataacataattctgcaaggtttatttcaaaccagaagaactgctgctgcaaaagaactctatgtcaggattaccgaaagtggaacgcagattgaacttagcacatacaacataatccttcatggactttgcaaaaacaaactcactgatgatgcacttcagatgtttcagaacctatgtttgatggatttgaagcttgaggctaggactttcaacattatgattgatgcattgcttaaagttggcagaaatgatgaagccaaggatttgtttgttgctttctcgtctaacggtttagtgccgaattattggacgtacaggttgatggctgaaaatattataggacaggggttgctagaagaattggatcaactctttctttcaatggaggacaatggctgtactgttgactctggcatgctaaatttcattgttagggaactgttgcagagaggtgagataaccagggctggcacttacctttccatgattgatgagaagcacttttccctcgaagcatccactgcttccttgtttatagatcttttgtctgggggaaaatatcaagaatattataggtttctccctgaaaaatacaagtcctttatagaatctttgagctgctgaagcattttgcagctttgaaattctgtgttggaattcttttctcctacagtcctattagaggagggatcttctctgtatgtgtaaatagcgaggtatgtatgccacctctccgaattatttttactgtggttcctagactgtaaacaagcaattatgttatgctgttgatgccagaaaaaacataaaagtttgtcgttatctctactaacggatcataaagggatttgtgactggagtttcaaacttaatgtgtctaggcagtaattttgacattagatccaaaacaatttatagggtttcattaaatttcatctatgtgtactgtttaggtgttgaatagtttgacttgttttttaactgaacaaaagatatgtctgaagctttgttctttaccaaatgcagtactgatcatcacaatatattttttatggaacaagattggattgtatagaatggtttccgatctgattatcttatctcaacgtattattatgcacatgtactaatcatgaaatatctgatggaatgatgtttctatttacctgtgtgaggcagcaaggagtgagatggataacaccacatactccctctatcctagaatataagaagttttagagttggacacgattattaagaaagtaggtagaagtgagtagtggagggttgtgattgcatgagtagtggaggtaggtgggaaaagtgaatggtggagggttgtgattggttgggaagagaatgttggtagagaagttgttatattttggggagtacattattattctagaacaatactgttgtgctcaagaagcgttccaaagatgtttcacaacctgtgctcgatgggttttgagcttaatcctgggacattcagtatcatgatctgtctcattcttaaacatggaataaaggatgacagcatgatttctttgtctctataatcttttggctacccacagataatagctgtaaatctatactactttaaaaggagtagtggtggtggtnannnnnnaatntnnnnnnnnnnnnnnnnnantntnannntnntnacntnttnaatcantgtnaatnccttttccaatacatntttaatcactntcaatcccttctccaaaccaattgtatgatagaacagtggaaatcacggacagaccatggagctctcaaccataatcatccttgcgagttaataacaaatggagcgtaaacttggcaagcaaaaaactcaaattaattctaaaattaagctctaggattcaaaatagatttcctctctgcattgtgctgttatgatttttaattccgtaacaacgcaaatgcattttgctagtcttataaagaagggttaatgcaaatattctgattaaatgattgtatctatgaagtttgaatgctagtggaagctcctttgaccatgttttgttgtgcgagcatttaagagagtgaagagaatgcttctttggtgctgttctggtatggaaggatccacagataaaattcaggttctactgcttctctgcttgtaattttcatgaagctgcagtgaataccttgttgaccacttgatctgttgctttgaaggagaatatagtagtggccaaggttggtgacggtgatggtggcatgtgatcccccagatcttcagtgacccagagaggaggggacggcgcgtggtgagctacaaggcatactcagtggagggcaagatcaaggcctcccgtccgtaggggactccgctgcatcaaggccaactgctccgaactgatcaatttctggtacggatcacttctcctttccttttttttttcaccttaagcactctcttgattcttcgctgctacctcccttaatttctttcaatatattgtggcacttgatcatggcggagacccaccttccagtgtgaatggattttgtcaaagaactaaatttattccattagcttattttctgattacatggaagacattcttttctggaataaatacagaactaaatcctgtttcctgaataaaagttgttagtgtgtggcatggtgcatttccgcgcttctaaattttataaaacctgttcattcaatttgaacctgcatccaatccaatattttaggtgcagacaggtgcttgcggtcaggttaaagaagttggcaaaaatgcttctgaagaaaggttaattgttgtttcatctcaggaggtaatatgcagatgattattccaattggcattgccttgccatttttatcacgagtctttacaattttatatcctcctacatattctttccagattccagatgatccagtgtctccaacaattgaggcgcttattttgctccatagtaaagcaagtacacttgctgagaaccaccagttgacaacacggcttgttgtaccatcaaacaaagttggttgtattcttggggaaggtggaaaggtaattactgaaatgagaagacggactggggctgaaatccgagtctactcaaaagcagataaacctaagtacctgtcttttgatgaggagcttgtgcaggtaatttatttggccatacctacaccagagatccatatattacttttataactgcagtttttacttgttaacatttcattgtgcttttacatttgttccaagctttcaggttgctgggcttccagctattgaaagaggagccctgacagagattgcttcgaggctttgaactaggacactcagagatggaagttcttccaataatccgacaccttttgcccctgttgatggtcctcctgttgatatcttgcctaacaaggaattcatgctatatggacgatctgctaatagtcccccatatggagggcctgctaatgatccaccatatggaagacctgccattgatccaccatatggaagaccaatatccacaatatggaagacctgccaatgatccaccatatagaagacctgtcaatgatacatcatattgagggttggacaatgatgggcctcgtgatcaggcccggtcctgaggggggtcgaatggggcgatcgctccgggcccccgattcccagggcccccacctatctgtgcaacgagtagtagcgatcttccagcgcgcaacgtgaggcgatgtttctccgtgatttcgccggcctgcaactgcgagatcgcgagtataacgatcagccgatcgatctcatctgccgactgccatgctgatgccacacgcaagcgcagcatatcagccttatcttggttgatcggcatgctggacgagcacatctgttgtcgcatcaactgctgactgctatatatgtgctggtgctgaatcgatcgattgtcgtcgcggaagtgaagaacaaccacggcactgctgcctgctgggctctagccgccatcagtaagtacgctatactgcctatctagatctagatcgagattacatagtggaattatctgtttataacaaaattacaaggtatcaattgataatttaaggttataaccgtacaaacttcagtgatttgctggtttcacattggttagatttgtttcaactaatttggtacttctgtagccttgtaatttacgaatctagtattaatattttcttaagtattagcctgttccttgatattatgctgttgagaaagtatgcaatagataacaaaaacaagtaggtgtgttgaggatgctcaagagtaatacagccacttcaataattctgatattatcaggacatcatcaataattctgcgcctacaaatcttcaaagaaaattttaatataatgcgtatgattttttaaatacgaatattgattgctatttaaagatatttatattatatggtaattattatttgaaggtttataataaaggcctccgtttttagtttcacgctgggccttcagaatctcaggaccggccctgctcatgatccttacaccgtgtatcctgtagagtacttctctaaaagagagtaccctagtggaagtagcaaagctgcaccatctgcttcannnnnnnnnnnnnnnnnnnnnnnnnnnnnnnnnnnnnnnnnnnnnnnnnnnnnnn

SEQ ID NO: 41385 - DNA, 2961 bp, Oryza sativa
gttccttgatactatgctgttgagaaagtatgcaatagatacacatacaagtaggtgtgttgaggatgctcaacagtaatacacccacttcaataattctgatattatcaggacatcatcgataattctgcgcatacaaatcttcaaagaaaattttaatataatgcgtatgattttttaaatacgaatattgattgctatttaaagatatttatattatatggtaattattatttgaaggtttataataaaggcctccgtttttagtttcacgctgggcgttcagaatctcaggaccggccctgctcatgatccttacaccgtgtatcctgtagagtacttctctaaaagagagtaccctagtggaagtagcaaagttgcaccatctgcttcatacgaaagatatgcagcaactactcgcttgcctaatggagaactgccctcatctattagtcctggtgccgattatatgtcctgccgttcttatcttgaccaagtacctactgataggtactctaatagggttacactacaattaggcctctcgagagccgggaatagtaatgtgcaacaattaggaatcaccagagctggaaattccaatgcttatgattatactgaggtacatttccaatgcgttagcttgcctcttctttgcaaatggccctcgcctgatatgtttccattagaaacatgaaaccatatatttgactgttgcattatgtctattttcttccatgatggttcagacgtctgaaaaaaggacaaaaatattctagaatatgtcatggtgatccaaatatatccttctgtcttgtgcccactctaatatctatcattggtaacactattcaattgttacgatgttgttgcaaaccctagattcagttattcagctgttctctgctgctgttgcttaccagttttcttagttgggtgttgatcttttctcattttttatttccttgtttcctggttcacctgatgcctctctgatgcatctgaatgtatatttttgttctcttcagtgcttaatagatttgaatttcattcttttcaggctgctgagcagatccatggacgtgaggattaccgaagactgtcaggtctcactgggtatggcttacgcagactgaatttttacaggacacaaacatgaattttgtcctcataatcattgagtgatgatctctttgcaggtatccaggtggctcttcgaattgtggattccaaatagttaactggagtctgtcattggtgttggtggtgtcaatctagctgagatccgtctggtatagcgtaagagaaacattatgcactatccccagtcataaccatgccccaatggccaccaatagttttcctcgtgaaaatctccccttgatcccagatctctggtgcgagagtgaagttgcacgaagcccatcctggttcttccgagtccattgtggagatccagggcattccggatcaagtgaaagccgcacagagccttctgcaaggcttcatcggcgcaagcagcaacagcaggcaggcgccccagtcctctcgcatggcccattatttttagtaagctggaggacattcgcaacaggggggtcagtggtcactgcaaagctgagtttgttcttcagttcaactgcagaaaattgcagatcggttgccgtagttgctagaacggtacatagttgccacctaactgtagcgagtggcataacttattgtgtgttactgcccaatgttgtctctccttgtgttcatggattcagacttgtgattgtagtatttctggatcagactggagtaaaagaaaaaaaaaaggaagacatgggtttaacagtaagctcaaaacgttgacagtagtaaaataaaaggggtttgttcactttatttccaatatcaaccttaccaacatttggcgttgaatcatttataccacatcgcttgtgcagctgaatttggggctgtttaaaagatggtctcttggattgctaattgcctcgcggcaagcgtggtaccttgtacaatataaatataattataactatttaatttcataattaaacatgttgttacaaatctctactattataaaaattgaagatgttttttgccggtattttggtacgtcatccgtgtatgaatccgtttttaagttcgtttgcttttggaaatacatatctgtatttgattcagtttataagatcgttcacttttggtaatacagaaggaatcatataagaattctgtttaaaaacactcgtatagtaacttgagacgatcagacgcctaactacagctcatgattttctaaatatatatatatatatatatatactagaaaaaatatatgtgtgttaaaagctatcttaatcttattattgttatatattttagttaacaagaaatctattgtgggaacttgtttggatatatattttttttaaaaaaatcatgagctgcaattaggaatccaatcgtctcaagttagcaggagggcgagtttttttaaagatatttcttatacgatttcttctatatttctaaaagcaaacgaacttaaaaaccgactcaaacatggatctgtatttccaaaaacgaataaacttaaaaaccgactcatgcacagatgattaatttttataatagtagagataaacgaactcccacagtgaattttattttaactgaaccatataacaataataagattaaaatagacttcacccgttgcaatgcacgggcattttttctagttaaagaagaaataaaaaaacacaaaaaattataaaatgtaaaaaagaaaaatattataattttgttagaattattattataatatagaaaaatagttgccaaaatttctcaatgaatgtcgaataaactcaacaatgtcatatatttaaatatgatggtaatatttgttcgcaaaactttaatcttcaatccttgaacaacata

SEQ ID NO: 41386 - DNA, 1876 bp, Oryza sativa
  unsure (1)..(1876): unsure at all n locations
tttctctcactctaccggctaactggcaatgttgagtacctgtaccgggctaaggcttttgcttgctttctgcttgaaaaagctgatcagttgattgctgatggggccatgcatgggggtgatcacccattttcattgtttgaagggagggctgggatggcttacctccttctaaacatggttagcccatcaaaatcaaagttcccggcctatgagctttgaagggcatcataaatatatgtatcctgttaggatcaaatgctcagtgatccatccatccaaagtagctgtattgtgttttcttgcgtacccagtaatgtgtgcattgtaatttgtgtctttgtaaagttcagtatccacatggtgcaagcttgaacctttgtaaaatacatgtttaaggaagttccttaaaatataataatatttatgttgattattacctctatttgtttactaaataaaatatagtttgccttcatgggatagttcancanacaccaaatttttgcatgctaaagtcatgagattaannaggagttgtattttcttagcaagtcagtatatggttgatgtttcagtatggtgtttagctgaaaacaatagatgtacatacatgccagagcaggctcacccaggttattagaacctttcatgtatatctagcatggcacaccaattagtttttagtagtttgtggttgaagtttccaggtttttgattttcttttgccccatgcgttgacataatgtacaagagagttattctactggaagttgaaatagctcttgcatcacatcttggtaggtggtacaaatttgtagtattaaatctgaaaaaaagaggataattttcttcagttgcacatttatttatacaacactaaaatagtttgcgataccatcatgagcacgacgttacaacgtcaactctttagtggtgcacatcagtgaacgcagtgctcaactgttaccttttgcagtctggggatttgtcaaattgcaccttgtttttgttgctatctcatgcatgtttactgacgaagtctatcacaagctgattcaccaggtcagggaattgctcctgaacaaaatgggatccttctgggatgtaagtgatcccgtagtctggagcaatttctttcagtttttcacttgacatatattccttcagtgctggaaacttgaggatgtagtctttctgacccataatcacaaacattggcatttcaaaccttggattagcaccttctgcttttgcagccttggtcctattaaatcaacacaagtgttagtaacatccttaggtttgtacaagtatcaaagtaattgtaatagcatcatatcaggacactgagaattgcttgtcatattttgttgtgttttttgcatgtgctcacctatatggaatttggatagcagtcatgagacctgatttctcatacaggtcggtgtaagctgagaggtcttcttcggtgaaccactgaggcatcggtgttgattcatctgcaaggtccatgatctcttgtccttgcttggcaactggaatctcactcctggagaagaggatgtagattgtgcgcaagatcctcctcgtgtcgaatcggccaaaatccgcctctgctctcccaggttcctactcaggtaacatagttgcatcacaacatcaatcagaattgcaaaacctatgttcagtataaatgtattgactgtaaactgtgtttaccaaatagtcagaaagaataaaaacttgatcgatgagtgtttaattaatttaccctccatctgtgtatgtaaaatccctcaggaagtnnnnnnnnnnnnnnnnnnnnnnnnnnnnnnnnnnnnnnnnnnnnnnnnnnnnnnnnnnnnnnnnnnnn

SEQ ID NO: 41387 - DNA, 1230 bp, Oryza sativa
  unsure (1)..(1230): unsure at all n locations
tgttgtacaaggcccaaaaatctccaatgtctggagcaagagtaacagctctattcaaccaacttctagctttatcaaccttcctatcatgccagaaaagtttggccacagctgcaatgacatggggatcatggtcacatcgttttatagcatctgagctctttgctttacgctggggacgtggcaccatctctatagctgcagcccacaaaataccacttgtcgggcattcctgtaatgccttggctagtagagcatcagcttccttcttgttcccatgtctcaattcagccctaactgctgcaagccagagttcaggtgtagctgggttcttctttcttgccatggtgaggacagcacgtgacttgctcaagccatttatcttctcctctagattagctagagagagccaaagagggatgcaactcgggcagtgcttcagtgcattctcgtaaacctcctttgccttggatccatggccaagccggtcttccatttgtccaagcattaaccacagcttgaagaatgaggggaataacttcagaccttcctccaacagcttcctttcttcgtctacattccctaactccctttcaacaatcgcagatttcatccagaccctctcagtgcctcctctttccctggcctttgacaaaagaattcttgctctctctggttcattgttctcaaactcaagcttgaaggcagctagccagatctcctctgaattggggagagaagcataagcttcctgaagaatggctcgggcagccgggacatctccagccagccatttctcctttgcactcataagccataaaacttctgcacgtggattgtaggtaacagcctttctgaggagattataaagagactccttggttccatggctcttctcaagctgagccgctttcagccaaatactcttcttggaaacgaagacactgagtgcatgcgcatagatggcacgggctgtctcaattgaaccacgcttcttgcattcctcagcatcggcaacccatgtgcgttttctgtcttcctcatcaacaccaatgccaatagtgctcttaacaatagcctggcaagtcaatacagatccagcacgctcagcagcttctgcttcctttagccatgcctccctgtcaatatccaatcctctctctctgtaaagttttnnnnnnnnnnnnnnnnnnnnnnnnnnnnnnnnnnnnnnnnnnnnnnnnnnnnnnn

SEQ ID NO: 41388 - DNA, 3341 bp, Oryza sativa
cacaaatcccaaactatcaaacactgataaacttagtgttatgagtgctgacaactgatgaattgatgtttacctatatggcatctgtagcggatatcgaaaaccagacttctcatagagggatgagtagacatcaagatcctcctcactaaaccactcggggaggggtgtcgataagtctgcaagatccatgatctcttgatcttccttagctatggggatctcgttcctagagaagagtatgtagatagtgcgcacgactctcctgatatcatacttgccaaagtcagcttctgctcttcctggttgctgcaagacgagttcttccactgtcactataagcgaatcttgcacacaatattttggcatgatagttagagaattaccgcccaacgtaaaatgtagaatccttctggtaaggtgtttaaggatgaactattaacgccgaaagggatgcccaaacacatcacaccacatgtacgatttggatgacagagagcaaaactataagctggcatggccccaaagtccttcccaacaagaaaggcctgacagaagaaacatataaactatcagggagcaaacaacaaactaaaggatttttttactgaaggcaagacatttataagcagctggtttcattatggagaaattgaaacccttatcttttatcttttactcagaaaaagggcaccttaatatcttgcactcatttttcatgcctctaacatactcttgaatcttgattgttggtggcttggtgcttaccgacgtggtaccaactgaatactagactacagtactagttaacgacagaaaacaaattatcctctccaaatatctcccttgctgtgtatgacagtggaagtttatatgtttcgttacaaattgctaaccaggatgcacacaagaagtgaaaaattctgttttgaattatgccttccgtttgcaagttttatagcaagaaggccttacacagcttcacagtctgcatgcacgagtaggactcaaaactggaaacctgctaaaaaaattcgtaaaaggatcgattaaactgaggagcttacgtaccttgggcacggcgagggcgtcgaggatggcgaggagatcctcgacgaggtcgtcgtactccgccgcctccggctccggcggctggtcggagagcccgtacccccgccagtccggcgcgacggcgcggtacccggcggcggcgacggcgagcatctggtggcgccacgagtaccatatctccgggaacccgtgcaggaacaccaccgtcccgagctcgcctgcaacgaccagcagccgaacaatcgttcacccgacgatcgccggcggcggcgaggcgcgcgcgcaggcaacgcaaattgaggcggccaaacctttgccggcttgcgcgacgtggagggtgagccccgcacggggaggtggacgtgctcgatctgctgctgctgctccgccgtggccatggcttccgggcggctcgagctccctcctcgccgcagaagttcagattgcagaggcgacgtcgtgacagtgcgagtgtgaggtggggatgcgtcatctctacgggttgataataattgtcgttttggataaggatacggtctaaaaaaacaactttgaccattattttttattataatatatatatatatatatatatatatatataaatgttaacaaatatatgattttattaatctatagtgatatttgaaaaacaaatactttaaaaataattctaatcaactattctaaagtttgacctcacccttatctaaaacaacaagtattatcagtctggagagagtacgtttttgtactgctacatatcgaactagtgcacgccaggtagagaaggttttccttctacctggcactcttagttatctactccttccgttttaggttataagatattttttactttagtcaaagtcaaactattttaagtttgattaagtttataggaaaaagtagtaacattttcaactcaagacaaatttattatgaaaatatattcaattattgatttgatgaaactaatttagtattataaatatcactatatttatctataaacttagttaaacttgaaacagtttgagtttgaccaaatgtcaaaacgtcttataacctgaaacagagggagtagatgacatttcagaattgcctttatatgtttacaccaaaacaatatgatttttttaattatttgttctttttgtgtctaattatattttgcccttatctggattcgagataatccatgattatttttgtattcgagctattcgtactcattttagtatttaacagaaaaaaagaaaacgaatatgagtactcattttagtatttaaaaaaagattcaaccacggcccccaacccccaccaccactcccccgcacacgcacaagcacgcgcacacacaaaatttttgggttaaagtagacttaagtctatatttatttatttattgggttgatgaggctgaaagagggatgacagtttgagttattgtgtttggtacaaggatgaggaagggaggaagcacggccaccggaataatatttctctaatataagaggattaggtcaaaatttctctaatatgagataggtgatctacaaacatttctctaaaactaaatcaatcataaaagataagtacttattacagtgattgttaattttttaattttttatataattatgattaatcatccgtatacatagtaactacgtactccgtcttttacagtaagactttctaaaatcatggtataagttcacatcattggcttgcaaaagtcatggtagaagtatagcaatgggtttagtctttacattgctagtaacaccagcaggacaacctagatacaacaagctcaaataggcattactgaaagtaacaaactagccatagctgatccttagtttgttgacaaattcataccatgatatagcacaacgttttctaagccaacttgaactacgggtgaagcacaactgaggctacaatagcatttatataaccacaggatgatctttcaagaagccaaaaaggagctcattcacatagtcacggaactgctcctgcacaaaatgccctccttcagggatgtaggtgatctttatgtttggtgcatgcttctccatagttccgtctttcatagcagactcgataccagggaacttaaagacataatctttttctcccatgacaataaacactgtaacttagaattttgcatctccaattggttttctctgatgcagagacctaacaagcatggcacaaatctcgaactatcaaatattgctgaacttattaccatc

SEQ ID NO: 41389 - DNA, 5483 bp, Oryza sativa
  unsure (1)..(5483): unsure at all n locations
cgatctgaccggtctgtgaccggtcacacaccgcgaccggtcacggaccggataagcgtgcgctgcgctgcattaaatgcggcgtgacgcgctcgtccaacctgctataaatgcggtgctcacctaacccacacacgtggcgccaaaaccacagggggtcggggcgccccagccctcggggccgaaacgggagcggcccgacccctcggggagacagagggaggggtggccacgtcaccctcgggcccgacccccccgagggggtcaggccacgtgggtgaccgcggctacccaagcctctagtcacgatacccccggccccatgtcaccgacacataccaatgcgaaataaaaagataaaataccctatttatcaaatcccaaagcaactattctctattttatctactccgaattcaattattatctaaatttacaaatttagatgcaatgattacttaaaaaataaatttattttggaatgaatggaagaagtcaaaatatgaacttaatatcacacgggagagtagttcatttactaatttttccataatagaaaacggtgcattaaatagatcggcagatagctggcaggaagctagccctggttggtgctcaccatctttcttcttccttaattgagatatatttgtctccatcgattcatattataactcgtttcaaatttttcttatcaaacattatataaatttatccaaatttataaaaaagaatatggtaacacctataacactaaataagtttccttaaatttaacaacctataacactaaataagtttccttaaatttaacattgaacttgatagttttttcgaaaatattactatatttttctgcaaagttagttaaatctaaagaagtttaacccaaaaaaattaaaatgacttacaatataaaatagaggtagtactaattttaaactttaaaattattaaattacaaattattcccacggtcacattcactcccactattacacgtggattataaattgtgtgcgagtacaatacttgatcccaatattacactttgcttctagacgtccctattttattacgttaagatagtctatcttgtaagttacgtgactttattactaacatgtgagtgagtccagtaaactctagattcacatgtcagtgataaacgcgtgatcacttcgaaggtagagagaggatctcaatcggcggcaaccgggtgctcggtgaagaagccgaggaggagccggttgacctgctccgggagctgctcctgcgcgaagtggctcccctccgggaggaactcgatcttcagctccggcgcgaacctctccatggcgccgccccgcacggcggcctcgaaccccgggaacttgaacgcgtagtccttctccccaatcaccatcagcaccggcacctcgaacctcgcgtccttccggcttggcctcctatgtaccgccctgcacgtacgatccatccatggagacatgcaacgatcagcaatggccagtgacgatctcatgttcaacatcccggggtcataggatccatgtaaattatccaatactccctccgttttattttaaatgtaaccatgagtctgtataaaacataaatagttgtttatgtgtgacttatgtttttaatttttttttcaaaaattttttaaataagaaggatgataaaatcatggctgcacttaaaatggaacgaagggacaagggagtactaactaaattgcataatagtaattactactccctctgtttctaaatatttaacatcgttgatttttttaaatatgtttgactgctcgttttattaaataaatttaagtaattattaattcttttcctaacatttgattcattgttaaatatacttacaatcacaaaagtttttaaataagacgaatggttaaacatgtgctagaaagttaacggtgtcaaatatttagaaacgaatggagtaatatataagtcaataattaaataattactatctattggagccaggtaatttttttcgaggttcgtcgctgacaatggtggacacggtggctgcgccgccgcggcggcggcggcggcggcttgtgtacctgtaaggcatctggagggggaagcggaagccggagttctcgtagagcgaggcgtagacgtcgaggtcggcctcggtgagccacggcggcagcggcgtggaggcgtcggcgaggtccatgatctcctgcccttccttggcgacggggatgtcggcgccggagaaaaggatgtagatggtgcgcaccacccgccgcacatcgtgccgcccgaagtccgcctccgccctccccgcctcctgccaccacacacacatcgcgttcgcgtcagcagcaagaacagacggcgacggcggcaatggcggcggcggcggcgagcacgtacgcgccagcggaggacgtagaagccctcgggcatggcgtcgaaggaggccggggcggggctgaaggggacgccgaggcacgccacgccgcgggtgcgcgccgggtggcggagcgcgaagtcgtaggcgggcatggcgccgaagtccttgcccaccaggaacgccccgggcacggcgagcgcgtcgaggatggcaagcacgtcggcgacgaggtcgtcccatgtcgcctcctcctgctccggcggctgccccgacagcccgtacccgcgccagtccggcgcgacggcgcggtacccggcggccgccgcggcgagcatctggtggcgccacgagtaccatatctccgggaacccgtgcaagaacaccaccgtcccgagctcatctgcatccagaaaaaaaaaagaatcaaaatcaaaattcaccacccaaaacgcaaaatctcacctaaaatttgtgaagaacacatggaacagttcaatgtccgtagatacacaaggagatctcgcctttgccgacttgagcgatgtggaggttgaggccacggatggggaggtggaggtgctcgatctgatccgccattgttgctccttcgagctcgggaggagagtgatcacttcggttttataggagaattttctgtttcttggaggtgatgaaaacaaaccaagatttagtgtctcttctgcattggcaccttctgatttgtctgaaggtcagggattcaggacaaacggtttatgaactggaatccaagaagtagcctggaactgatacctttataaataaaatcatcaaggtttggcaccttgcaagttgggattcagtagaacctgctcaatcttctagagaaactcataaaaatatccagacttctaaacatgacctatatcatcatatttatggattaacttttttttttcaaaacacaaatacatacgcctacacatacgtgcacactcactcctataaacaagctacccctacgaacacctccgaaaaccgagccggcgtatcttaaaattgatgaaatcaccacaagcgacttgttgtcgatggttacgttaccttggttggcacttgtcgagttaggtttcagttgaacttgctcaatcttctgcagaaactcataaaagtatctagcctttcgaacatgacctatatcatatttatggattaacttttttttttcgaaacacaaacgcatacgcctatatgcacgtgcacatttactcctataaacgcgctacccctataaacacctttgaaaacagagccgacatatcttaagattgatgaaatcaccacatgcgacttgttgttgatgattacgttgcctgagttggcacttggcaagttaggttttagttgaacctgctcagtcttctacagaaactcataaaaatatccagccttctaaacatgacctatgtgatgtactgatgttcatggattgactttgctgcaaagtggagtgaaatgcttatctttgcctgttacatgttgctgcttccatcttctttatcctcatttgtgactattggacgctgtgattagtgactataaccatgggtaattatagcttaaaataacttagcatatgtggttgaagattattgcgtttgataataattagatgtatttaggactaaccatcatattttgctgtaacgttattgtttttccggtctgcaaaaaattgaattatagacccgtcatgtgcattaaaatcttctactagttggttatgtacttacataccacaccggctatttattgaaatgcactgaatgtcaaactgccaacatttaggtggtgtttacatccagggacttaacttaagtccctgtctttagacactaatttagagtattaaatatatactgcttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggccttaattaaaacaacatatgtcatactcgaaaagcctaactcaaacttccgtacaaactcgcaataaaaaacccaccttctaagcatggcctaaaccatattcattgattgacattgatgaactgtaacattagagcgaaaatgacattaggggcctgtaacctgttgacattctacagctgcttccatcttcgatcgtcatttgtgatgactggattccgacattttgaaattgtgattagctattacttttcaattctaagggcagtccaaacccatagtattcataagcagtgtctatagtgccatgtcaataagacatcacaatagaaactacactctacaacccatggattcttaaagtatgccattaataaatacatcatctcttttctctaccaatcatatttattcttcatctattatgaagacactattctctccaaatgtaaaacttgatagtgtctagtgcataggttctcgtgttgaagctgtgtcttgcatgagacccagtttcttcctctctccactctctctctcttaattaatatagtgtcacataaactaaaagtcctacatgacaatgtagttaatgtcatagacaccattctaggtggagggttagaaatgccctaaatatagtaaactaatcagattaaagacaacgctcaatcccctatacaaaaattcactcggtcgtgtctcatttattactcggtttctattttaagataatggtaattacatctttaaaatagtcaaggtgaggatcacgaatgccttctccccttcttttattgcaaatgtcttgatttgtttgcaaccatcaactgtcagtcaatcaaaatttnnnnnnnnnnnnnnnnnnnnnnnnnnnnnnnnnnnnnnnnnnnnnnnnnnnnnnnnnnnnnnnnnnnnnnnnnn

SEQ ID NO: 41390 - DNA, 982 bp, Oryza sativa
attcaaacgactttcacccatgtcccaccgcacattgggcaagcatgggtccatcggctgatccaccatgcctcaagctcattcgacgtgttcggagctagagcaccaggctgagcaaatgcacaggtttgcctcaaacatcgtatgcactgcaaaagatagcatgtctcggtgtcacggcaaatggtgaattggatagagtgcgtcgataattaattctgaaagaatactgaagttagagactactactatcaagtatgcttaccttgtaccattcaccttcgaggcctgttttccacacagctgtaataacatctctccgagaacccatcacacctagaaaagatcccagccccacggatgttttcagaccaaatgctgcatctctttcagacaaccggcgctttcttggccaaagattttgaatcccaaaggagctgtcgccatcctcttccatgtccgataagtggcgattggtagagccattgatttttagctgtcgcgtattatccaatggaccaagatcatctggttctgaccatggcccaccaaacatgttgcgtctatgccattcttcagcagggggctgcagttctaattctcgaagtagaaggccagcagcatcagctccacgtggacgaggcatattctgcaataaatattggaacaaatgggcaacattggtataaattctcgacagaaatgcgtgtacacagctcttgttggacatgtacatgctcactactcttaccaaagatgtacatgctgatgaaaatgagaactcctaaatggtgacaagagggcgctgaggccatgagtaataaattatataggcagatggagaacgtatgaacaaaagaaatcataaaaaccaattatgcacgtgtgcttgtataaatgaaaatttccataattaacttggacaacaatattcttttgctggatcaatccatcgttaacccaggtaagtagagtagaactt

SEQ ID NO: 41391 - DNA, 890 bp, Oryza sativa
catctttcacgaaaaagacttgcgttacatcattggcaaggacaaaaggttggtccgagtatccaaccttgttaaggtcacccgttgtcatcccaatgtcatcaatcattactcctccaccagtcaacttaacccattggcactggaacagagggactttgagaggaccatagtcaggttcccatatgtcctcgatggcaccgtaatacgagccagttgttccatcgtgtcccatggcatcgacacgaacaacgctgtttgggttcgtgctcatcatgtcttgggctctcgtgtagaatgtatacccattgatctcatatccctggaatgtcgtgatcgacccagacggtcccctcgccaagaagacaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtatggagctaccaatgaagagtgttgtagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgtgtcattatattgaaaaatgaaggtggaaatatcaactca

SEQ ID NO: 41392 - DNA, 933 bp, Oryza sativa
  unsure (1)..(933): unsure at all n locations
nnnnnnnnnnnnnnnnnnnnnnnnnnnnnnnnnnnnnnnnnnnnnnnnnnnnnnnnnnnnnagaacaaaaattaccggggatgcttgatatgtttataggtttatttttgagtaatataatgcttaatatgacctaaaacacgtgcgtggacaccgggtagatacacataggtacgcccctgcccacatgttatagacaacgattgataaatcattagttaacttatcttaaaagtgacaaacaattaaatgtcccaaatacatatacaaaaattgctcaaacttaaccggcaaactgaactacaactagtctcgattaaatgtcccaaatacatatacaaaaattgctcaaacttaaccggcaaactgaactacaactagtctcgactcgactgcccgcgagagcgagccccccagatctccctcgttctccggcgatggcgtcgccctacaccggcgcgcagccgccgtatccggcgggggcgcaccagccgccgccgccggcgcaggcgctgctgcagcagaaccactcgctggcgttccgcgtgatgcggctgtcccgcccctcgctgcagcccgaccaggccgccgcgctccgcttcgacccgcgcgacgtcttcctccccgaggacgccctcacggggcccgacccctccgcctcctccgccgccgacgccgccgccttcctccagggcctcctccacccgctcgactcgccggccaccaccgtccccggcgacttcaccttccgcgaccgcttcctcctccgcgaccccgtcgacgccctcgcgctccccggcctcctcgtcctcccgcaatccttcgggttcgtctctctctctctctcgcttccattccagtagtagattgcagcgaatgattgtgttgatgtgatcgtgcggggacgcatcgatagggtaccgagctcgaatt

SEQ ID NO: 41393 - DNA, 3590 bp, Oryza sativa
  unsure (1)..(3590): unsure at all n locations
nnnnnnnnnnnnnnnnnnnnnnnnnnnnnnnnnnnnnnnnnnnnnnnnnnnnnnnnnnnnnacgccgccgccttccgccagggcctcctccacccgctcgactcgccggccaccaccgtccccggcgacttcaccttccgcgaccgcttcctcctccgcgaccccgtcgacgccctcgcgctcccggctcctcgtcctcccgcaatccttcgggttcgtctctctctctctctcgcttccattccagtagtagattgcaccgaatgattgtgttgatgtgatcgtgcggggacgcatcgatagggcgatctatttgggggagaccttctgcagctacatcagcatcaacaatagctccagcttcgaggccagggacgtcgccattaaggttctcgaaccatcgcatgattaccatcctcttctattatatcgcattagttggaaaacattatttgaaattctggatcgtttaccataaaatattattctggatgttttctggagaacggtattattgcacccagtttgtcattgatgctgttgtttcagtgcatctggttagagtgtgctaggttgatgtttttctcttcttctttttttcagtgttagaatctcacatcaccaagttcttattgttgcagtcatgaactgatgttaaattcgattactcgattgactctctgctgtggaattactggaatagttgcttgttcatctttttttacatttgttgaccaatgtggtgtgttcagtgattagaccaattctattagagcctcattaagaaaaaaatgtaacaaggtgttattaaggcatgcaagaaattatgaggtattataagctaataagtagctttgatgcaaataattataattgaccttgactttatctgtagttcttattggctagttctgtcgatgggttgcatgttgctctatgacaaatttgatactttagacacccctttggtggcatgcatgcaggacttagctgtccttgaagccttcatttcttcatattatgtcataagttttaaccggaagtttatttacattaggcagaaatacaaaccgagagacagaggatacttcttttggatacatctaaggcccctgttgagtcaatcagatctgggggtagatatgatttcattgtggaacatgatgtcaaagaactgggagcacatacgtacactatcctcttttttattttatttacaaattggttgcattagacattagtgaagcacaccttattgttgatttgctcatgtggtgattgaatccaggcttgtctgcactgctttatataatgatggtgatggggagcgtaaatatcttcctcaattctttaagttcactgtttcaaatccattgtctgttagaacgaaggtacttatttctctcattttttatatggctaatctatactccatatgtataatctctatgtccctctatcttagaatgtaatcccagcatattcggattacagagtaggtcacataaataatctgtgttcaccttttgtttcaggttcgcaccatcaaggtatgtaccctcttgtttcacaaatgcaaacaatattgtaagtcttgtaactaaatgttggtttcttttgtggaaacctttaaaactttacgctgtcacatttgcattttttttagaatatgttctgtcatcgcagcagttaccagttagccatttctttctttacttgccattctatctgtgcagaatcatccttttggttccataagaagtttatcagcgtcttgaattccccaaaaataaaatttggggaacctcattatactttatccttggtttattccaaactggttgaacaaacttctatgtaaatgtggttggccttgtttccttcgatattatagtatatattctactgtactactgtttgttataatgttatttatccctttactgtgcatttatttattcatcatggcagtcttgaactctatatagctagtccactttgacaggataccacttatctggaagcctgcatagagaatcatacaaaatctaatctttatatggaccaagttgattttgaaccttcccaacaatgggcagctacaagattagaagccgatgaacatccgtcaacagtgaagtctataatcgggtaagttgagctctgataacaaaccctatttggagaatggaacatagtgtctcgatgcaaggatgttgatatatcatgtcgatgcaaaaggattgctaatgtgagttctatttttcatatagggacttgtgcaagcaaccgattctcatcagagctggaggaggaatatacaattacctatatcaactcagaccatcgtctggtgagtctggtcaaacaaaggcagagggaagcagcatactcgggaaatttcagatcacatggcggacaaatctcggggagcctggccgtttgcaaactcaaaacatacatagcactgtcagtaaagttcctgacttatggtttgaactattttatatgaagtgtcgagggctatacctgttaagttactctatatataagtgttagctataactttggcaactctttcttttgagcagcccactgcaagcaaagatgttgatcttcgtgctgtgaaagttccacctgtgatatttctggaaagaccatttatggtaggtgattcgttggtgaacatctggctcggatatttagcaagaaatttgttcatgttctttttccacaatattttgatgtttatgcttctgtattgtttaacttgtaagataaaatatgttcctgctttggtatctatctgatatttcccttcaatagtttagctaagggaatctctttattagtatctttggacaaaaatgggtcagtcttgcagacttttttgtcaggtcctatggatcccttgtatagtctctgaatatttcaaaaaagaaaaatgcattaaagcattacactagggttatgccctattgttcccataaaaaacgaggttctggctgttcaaaactgttatgctccaggctctctagaatttcctccccatatcactcacccctttcaatttgttaacatgttatgtgtttaactttccacgaagcatgttgtgcaccaagctttcaaaagttcccttcctatatcattctacccctttcaattcattaccacaggagacatgcagtactgagtaaatttgcaggaatcatggtaatacatctcgcatgctttattagtgtcttttcttcatacagtttcatgacttgttgtcaatcgctatgcactaatgcttttcgttgaaccatgcacttagtgcattactgcattgcaaatattaacaacagctgctcttcacattactatcgatatttgattagatttatatcctcaggttaatttatgccttacaaaccaatcagacaagcagttggcccttttgaagtatttttagcaccaagcgtacttgatgaagagaaatatgttctggtcaatgaattacagaagttggttagtggtttccctggctattttatgtttgatgttatacaaatnnnnnnnnnnnnnnnnnnnnnnnnnnnnnnnnnnnn

SEQ ID NO: 41394 - DNA, 779 bp, Oryza sativa
  unsure (1)..(779): unsure at all n locations
ctgttggttaacattcatataatagcacgaatgaggaaaatcagtattgttgaggaaaattcacaaggcagtattgttgttatgatttatcaatagcgtcactggtctgataaatatccaagcataaagatgtgacacatcctaataccagtccctccgtcccaaaatcatttatattttgggacggagggaatggtattaggatgtgtcacatctttttgcttggttttttatctgaccagtgacgctattgatgaatcataacaacaatactgccttgtgaattttcctcaacgatactgattttcctcattcgtgctattatatgaatgttaaccaacagttgaaacaatttagtcttgtgtttgaccatcaaagccagtggcaaattcattgtcttatgaatcagaaagaaatgtatttgactatatttggaatgaatctgtgcagagtatggtagctactcaagtaggcgtgcaaaaaatttctggaattacactgtatgccgtgcaggaaaagaagctttacgaacctttgtcagacatagaggtaaagataagcaaattcggtactatcaattactctttcttgtagtgttctgcatgtttgtttgctaaagctacattctcgtgatagcattatagttctttaaagttctcatgataaatttgttgaacataagtgctcgagcatgtgnnnnnnnnnnnnnnnnnnnnnnnnnnnnnnnnnnnnnnnnnnnnnnnnnnnnnnnnnngggatcctttaaagtagactgcagg

SEQ ID NO: 41395 - DNA, 2493 bp, Oryza sativa
  unsure (1)..(2493): unsure at all n locations
nnnnnnnnnnnnnnnnnnnnnnnnnnnnnnnnnnnnnnnnnnnnnnnnnnnnnnnnnnnnnnnnnnttcacatcattggcttgctaaaatgatggtttaagtgcaatactaggttaaaatataataacattttggcctttgcattgctgacaacattagcaggagaaactaaacgcaacacaagctcaaacatgcattactgaaagtaacaaaccatccataatatatcctttatttgttgacaattcatatcatgatatagcacaatgtttccatcgccaacttgtactacgggtgaagcacaattgagtctacaataacatctatttatccacgggatgatctttcaagaatgcaagaaggagctcattcacatagtcagggaattgctcctgcacaaaatggctcccttcagggatataggtgatcttcatgtctggtgcatgcctctccatagtgccgtctttgatagcagactcgacgccagggaacttgtagacataatctttctcccccatgacaacaaacactgggacttggaattttgcatctccaattggtttcctcttatggagagacctaacaagcatagcacaaaatctcgaactatcaaatattgttaagctcagtactacttagtatggacaattaatgacttgatgtttacctatatggcatctgtagtggatatcgaaaaccggatttctcatagagagatgagtatacatcaagatcctcctcagtaaaccactcaggaaggggtgttgacaagtctgcaagatccatgatctcttgatcttccttagccatggggatctcgctcttagaaaagagaatatagatagtgcgcacaactctcttaatattatacctgccaaagtcagcctccgctcttcctggttgctgcaagatgagttttttttactgtcattacaagcaaaccatgcacttattgttttatcatgacagtctgacaattaccgcccaacgaaaaatgtagagtccttctggcaaggtgttaatggatgaagcatcgttaccgaaagggatgcccaaacccatcacaccacatgtgcggtttgggtgacacagagcaaaatcataagctaccaaggccccaaaatcctttgcaacaaggaatgcctgacacgaagaaccgtataagttatcacaagaaaataaaaaaaaaaagaggaattggtttagtagggaataattgatatccttccatcctttatacagaaaaaaaagtgccccttaatatcttgtaatcatttttcaggcctctaatatactcttgattgttggtgctacatctaccagcttcagatcaattcggtagaactgatagtgttatcaattatcctctccaaatctctcccttacgatattgaaagtttgtttgtttggtcacaacctatccatgactcaaacaatacactacaaaaatccatcgaaacttctaaactttgtccaaccaattatgaattttgcctctcatttactcagtaactcaaagaggataaaatttgtgaaaaagccaaactgatccaggcgcttaccttgggcacggcgagggcgtcgaggatggcgaggagatcctcgatgaggtcgtcgtactccgccgcctccggctccggcggctggtcggagagcccgtacccgcgccagtcgggcgcgacggcgcggtacccggcggcggcgacggcgagcatctggtggcgccacgagtaccatatctccgggaacccgtgcaggaacaccaccgtcccgagctcccctgcatgcgacagccaaacaaacacctggtgggctagctacggcggcgcgcgcggcgcggcgcggcgggcgggcaaagcaagccaaggaatcgaacgaagtggtcgggggggggggggggggggaggagggctagcgcgcggaggcggccgtacctttgcccgcctgcgcgacgtggaggctgagcccacgcacggggaggtgggcgtgctcgatctcggtgatctgctgcggctgctccgtggcggcggccatggtgtcgagctcgccgtggacgacgacgcggtcacgctcacgcggcagcactgcagtgggaagagagagcagatcgcgacgtgacagcgtgaagtgtgacgtggatgggaaaagctaccgtactttgcggctattcattgctgctccacgtcgaactccaactcgttgacaaaagtaggctctgtcctcttaactattcgtacggtttaactattcgtcttattaattttttttaaaaattattaattattttatttgtgacttactttattaaccatagtattttaagtacaactttttatttttttatatttacacaagtttttaataagataaatggtaaaaacaaaaatatcaaaatcccttatattaaaggacggaggaagtattttcttttcccaataaatactaagaaatacgcattgggtttcacatcatttatttctaggggatcctcta

SEQ ID NO: 41396 - DNA, 1462 bp, Oryza sativa
cgcttatagggtgtatttagtccaaagaatgttaattagttggattttcaagaatcatatagtaatcctagagtactaggataggtgacctccttaaaagtcctttgttgcatccctcttttgagaaacactcaagtagtcttccgactagctccacaaggtggtggaatagacgacctgggttcgaagcctcaccccttctaattatttgatattaggtccttccctaatattcgcgtttttttaatcctagttgggtagaatcgccgggagtgttaattagggatataggatcggatcctgggataacccaaattctggaaaatgtggcactaaaatcacccagattatcgggagtgttaataagggatataggatccgatcctgggataacccaaattcaggaaaatgtggcactaaaatcacctagattattggaaccctgtatttcaaagagtccctaagaacatcactaggagattatgtataatcttcccccaaagatttcttttttggcttattgaagtgaaaataggtagccaaaaaattgatctctccaagagaaagcctaaaatatcccaaaactaaaggtgggcacttctgttaaactaacaccaattttcccgttttcctccctctcacacgtgctcctggcgctcacatgcgctcgtgacgctcacccttgagaaaaatctcgtgcgaatgagagataggggacgacagacacgacgtcgctctccctcaagtaaatagaacaaaggatgcggcaaagggtttccaaacaattaggattcaaataggacatctattggaggcattatttttcaccaaaattccaaaaaactaggattgggatggaataagggaaccgttggtgattctctaagcatgtttttgtgtcaaagtactaatgccttgatttgctaagatcagggtataacattaacagccaggagaaaaaaacaaaaaaaatcttcccattgctgacaacactagccgcagacacagggtataacaagttcaaacataactggcgttgctgaaagtaacatcaaccataccagttccttcattgataattcacatcataatatcgaacaatatagtgttcttgtagcgaagttgtagtaagggtgaggcacaatgtggagtttctaaacagccataggatggtctttcaagaagctaagaagaagctcattcacaaactcagggaactgctcctgcacaaaatggcttccttcaggaatgtaggtgatctttaggtctggtgcatgcttctccatgctgccgtctttcataacagactcgataccaggtatcttgaagacataatctttctctcccatgacaacaaacaccgggacttgaaattttgcatctccaattggtttgttttgatgcatggacctaacaaagcatagcacaaatcccaaactatcaaacactgataaacttagtg

SEQ ID NO: 41397 - DNA, 980 bp, Oryza sativa
  unsure (1)..(980): unsure at all n locations
nnnnnnnnnnnnnnnnnnnnnnnnnnnnnnnnnnnnnnnnnnnnnnnnnnnnnnnnnnnnnnnnnntgtccacgagttggacatgcaccagcagctagccagtacaaagaaaaaaaaacgtacagcaggtgcggcatccccatctgaccccgcgcgactcacctcacctcccccgtgagttgggatcctctcctgtaatgtatgtgcggtaagtgccaatgacatgtgggcccggaataggtgggacccacatgccagtgacacgtactgcaggtgcagtacagcagtggatttgcatcccccacctcacactcccaccaccgtcacgtcgcccctctgctctctgcactgctgcggcgaggagctagctcgagccggccggaagccatggccacggcggagcagcggcagatcgagcacgtccacctccccgtgcgggggctcaccctccacgtcgcgcaagccggcaaaggtttgccctgcgcgcgcgcgcctcgccgccgccgccgccgccgacgatcgtcgggtgaatgattgttgggctgctggtggtttgcaggggagctcgggacggtggtgttcctgcacgggttcccggagatatggtactcgtggcgccaccagatgctcgccgtcgccgccgcagggtaccgcgccgtcgcgccggactggcgtgggtacgggctctccgaccagccgccggagccggaggcggcggtgtacgacgacctcatcgaggatctcctcgccatcctggacgccctcgccgtgcccaaggtgacgatgaagtttgatttttcacagatttttatcctcttttcgtagcttcagattaagaaaaaaaacttcagattttcagttttgagtgcgtggccttttgctatagctcgtaaaatgtaaggtataattcataattggttgaacaaagggttcgagatttcgattttttttgtagtttttttttaatcctggataatttg

SEQ ID NO: 41398 - DNA, 775 bp, Oryza sativa
gacgtgacatagttcccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccataaatagagtgtccactagatggggttttgtttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctc

SEQ ID NO: 41399 - DNA, 736 bp, Oryza sativa
atcttcgaacacttttctaggatgatgagtaggccagaaccgagaacatgcgatattaactggcaagccttgcatgccccaacgacggacctctcgcatctggacgatcctttcacggaacaggagattcatcgggcaatcaaggagatgccagctgacaggcaccagggccagatggctacacggggaacttctttaaagtttgctgggacattatcaagggggacattatggcggtcttcgaatcgcttaataatctgagatgtgcgaacatgaacctcctgaactcagctaacatcgtcctgattccaaaaaaggaaggcgcggatgaggtgacggactacaggcccattagcctaatccacagtatagcaaagatcctctccaaaaccttggctttgcgactacgattacacatgcgaaccctcgtcacagtcaatcaaagcgccttcatcaaaggcaggagcatccacgacaacttcctctatgttagaaatttggcaagaagataccatagaacaaggcggccaatgcttctcttcaagcttgacataaccaaagccttcgattcggtgcgttgggattaccttttagccatgatgcaacatcatgggttcccgcagaaatggagagactgggtgacggccatactcactacctccacctcgcaagtactactcaacgggataccaggagaaaagatagcacatggcagaggactcagacaaggggaccc

SEQ ID NO: 41400 - DNA, 712 bp, Oryza sativa
aacatacgtaaaatcaatctagggtttgtctcctactctgtactgtgccgtctatcgtagactactccatcccgctcgctggcgtgcaccggcaatcgggagagcaggtctccagaacctctgcattcgacgtccttcaccgggagaaggcggcaataaggtttttgggaagcgcttcgcgcgactgctccctgttcatccgcgacggctcgccttcctctccgctcgcgtgctgcgcgccttcgtcgacgcccgcaaccgcaagtagttcctgccgagcaatcggtctttccgccacctcggtatgtgttcgacatgttgcgcatatttgatctgttcatgttttactgcttagtttacatgtgtagatctaatgatgcgttcaatctagtttacgtctgcaatgacatgatttatttatggaataaattaaatcattatgtgcttataatttcaacacctgaatcactgtcaaaagaagcatcaacattaatcttgagtaagggcaacaatagctacatatgatcttgacggggtctgaacactttcaccattaaccatctgcctcctttcccaccaaatataccatcctcttgtcgaaacaatttcagaaaagcccaagtcattaagcatagaagtgattcaattgctatgattaaaaatagaagtgactagttgataccccgcgctttactccggggtatatggatga

SEQ ID NO: 41401 - DNA, 62533 bp, Oryza sativa
  unsure (1)..(62533): unsure at all n locations
nnnnnnnnnnnnnnnnnnnnnnnnnnnnnnnnnnnnnnnnnnnnnnnnnnnnnattccgaaaacagggaaagttagaaataaaaggctaagtttatgctaacctgtttgcaaagtactgccaggtatggctccagaattgttttgacttgtttaatgatatctgcaagagatccacggtccatgtattctagaacaagatatattacaccattatggtagaaagattggtggcaaaggactatatgtgcgttctgtgttgcttgatttattttgagctcttgtactatttgtttgcgaactgcctcttgaatgttcatttgtatgccctgtggacagaattgcaatgctagttaattaaatgccacagcagtatgaataccagggacaatgcacagaattcttgattgatctgaacatcataacatgatgttcttcattagcatcaatattaattgaaaatcagagttcaatgtagatattgcatgcaacacgtaagctgacgacagatgcttctgctacaccatttatgtagaatgccccacctaatttcaacagggaacatactaataggtgccaacactaccaaattgattaaaaaatcaatcaaatgctatgatgcagaataatctgattatgataaacatgttcaaaatggaactgagagattgacttccagctttccatgattacaaacataaagatagagaaacagttcaactgaaggactcgcagcctgatgcagccacaagatatacattttccatttaagaattagtgtggaacactagatggattttgtgtaatggaaattaccttcaaggcatataatgtccccacccacttgtgccgaactagttggacgataccaccactccccttaccaatgacttgaatcatctcaaggtcatccattgacaactgaacatcttccaccttcaggtttgttgactgctggaagacataaagatgaaacagaaattgagaaatgtgaacaatgttatatccatggataaactctgaaatgtttacacaatgattccttagcactattgcagcacataatacattgcgagaatgcatgagtggcatggatcccatgcattgcaagtgagtattgcattcaatcagccaaatgaaaatcaacagaagcatgataaggtttgactgaactagtcaacctgtacatgtgcttctacactaacctacatgtcaccataaggagtacgataaagcagtttacatgaacccagtagggagatatgaacaaacaaaaaaagtagccatggcaccaggaactcacaggttcatctgcagtttcctcggatataagctgcaaacctctttgattaagccgcagttcaccatccttgaatgtaccactcgcggtcctaaaggagcaccagcgatcagtgacagctattaaattttaccacgaactcccgaaacataaatcaacgattaggctgatggataaacaaaataacaaacgatctggaaccacgaatagcatttcagccactctaagtgaggattgaagagtcagttcagcaactcagatcatagatatttcaagcaaaagatcagttagacagtataagtagacctacgcttctgtaaatcttatctccatctcagttcataactaaccccaaaatcacagtaagacactatgcaagacaattcgatctgaactccaaaatcgtcaacaaataactaaaaaaaaacacagaagcccttctataccagaggcaaaacctcgaaagttcatgacacccgatcgctccaaaggagaacacacaaaggaaaacgaaatcaagtgacagtaaaaaaaaaaagaaaaaaaagagcacgtttcaggcccagggaaccgagggagggggaccctacaggaacttgtcgacgggcgtctcctgcgcaggcacggagagcttgagctccttgtgcggcttcttccccctcatggcctccccctcctcctcctctccggttagggtttatccgccggtaagagacgggggaccgaagcgcgagcgagaggcctatcccggcacggatctgccccgcggcggctcgagtaatcagccgggagtggcgggacgcggcgggagggagggaggaagcagcccgcggcggcgagggagggaggaaggagaggtgaagtggcgtcggaagaagcgaagaaggaaggaaggaaggagagcgtgtggggaagggagtgggatgggaagagaaagaaagatgctgacgatggggaggggggttgctctgtgggaacgcacgagttggaaaaatcaaaaaacttgcggggcccgcctacgtatgcggctgattctgggacacggtcatctcgtcttcgcaggcaatgaccttgggcacttaccgttattcccttcattctcgattcttgaccttgacattcccattctttcaactacacatatatatggtgtgttttgcgaaaagagaaatttataggtgtcacattaaacgttgatcggatatcggaaggggtttttagatacgaataaaaaaattaatttaataacttgcctggaaaccgcgggatgaatttattaaacctaattaatccgtcattagcacgtgtgtgttgctgtagcacttatggctaatcatggacaaattaggctcaaaagatttgtcttgtgatttctatgcaaactgtgcaattaatttttttatctatatttaatgttccatgcatatgtcctaatattcgatgtgacgtttttaggaaaaaaaattgagaactaaaaaaggccatatatgactcaccaaacaacatatttgtgaagggaagataatttataaataaaatttttatatacgtgttcttagcgatctaaaagcaaaaactgaaaaataaactacgataaaaaaacttcaaaatcaactctaaatttaagattgaaaattcaaattttggcttataagcataatcatgaggctgatacttccgaatacaagaatcattttacggctttgctattttgcactcgcatgaaaattcgtaatccatctccctctggtcgtgaattctgcttcaagatctgtgcacactatcggactagtgtggaaggtttttctacatggacagttcttcagcaggcctttttttcccaagcccatggccttaccctatcggaaagtcctttttttttaattggatccatgccactaaaaatatgccaattcaaaaaaaaatactactattatttactactatttaacatatcggttgtgtgccactgaaatttaaaaaaattggaaccatactactccatcacgaaattccgtctctctccttccctcttcctctcttagcaggttagtgttgctgatacggtggcgcgtggttggtgcgacggcagatgacaggaggtcgatggcgacgacgactcctgagccctcctaccgccacccgcaccagcccaaagacaaacctgccaataaaagcgctatggtggtgcttggtgtggcgtggcagggaggaggtctcgacggcgctgtcgcagttggtgccgacgatcttctctatgtccatgaaggtggagaagaggtcgtcctcggagtcgatgtcgtcgaagccatcgccatccgcgctgccgacgaggcccaagttatccgggaagcggaaggctgcctcagatctggcgtggcgacaagggcagtggcaaccacggccggctgcgtgggcccgtcacgccgctaccaccgccagggatgggtttgtcgcgcatgtacgccaccactgtctcctcgggaagctcatcgttggagcccctgtgcacgatgttgaacagtcgcggcgcctgcagtggcgccttcgccattcccgctgcgcctccttctcctcccccgaccaacgatcgtgcccccgcgacatcgcagtgcacaagacaagcaccatcgttgccgtggcccctgcacccgacgatggtggtggagaatgagaagcgtcgctggagggagagaccggagagaggtagggaaaagagaagagaggggagggaagtgaagaagatgaaactgacagctaggtccctcatgcagttgaggttaacggagattttcgacatatttttgacagattcgtaaccgcgtgccacacacattttgcaaaattggaaaccatgccactgccatcacattttccatccgtcttcttccttctctcttctcatcttcttgctttgcgagcgtcagacatcggtagttttgtgacgattgcggcagtcagcctccgcggctgtgaggaggtcagcgcgagggctctggcaacggcgagggagagaggcaggaggggttggcagagagcgcggtcacccaacgggctgacacgggggatgtggcctccagatctaaagaggagacaaggagctagagagagaagagaaagggacaggggtggagagtggaggggggcaccaccggcgatggaagggagcgtaggtgacaaatggtagcgacggtggtggaggaggaggagcgacgacggtggctgtgaggaagtcggcccgaaggtgggagcgacggcggcaaccagcggcggtggtggagggggaggaggagcgatgggggcggagggagcaaacgactcaaccgggctgcaccgcccgcccttgtgtgcgccatgaccgtttgccaccaccccgtctccggtcgctctggcctcgacttcaacaccgggtgaggaggcaggagaggatggtgatgcgtatcgggttaaggagggaggagcggatgagatggattgctagggaggctgagaggtggtggagagagatgggaaaaacaagagggaaggatggaggaaaaagatgaatctgataggtgagacccacatgcagatgagaaagaagatagaaaatgtgacggcagtggcacggtagtgacagcaaagatgttggccatcgagatcttctgcgattacttcacatcatagttcttcctttcagccttgatcacacacagaaaatcctaaacgcatgtaaacctgtacacaaatatgacacaatgcatgtgaccgaataaaatttgtgcaaacttattaactttggtcaattaacactctaattgcatttggtcaattaacactaattgcttatcagtacgaaaaccatcagaagctgactaaccaaatcacagtgaaccaatatttatcatttggctaattgtttggctaataaccgaattgtgcaaattaaactctcacggctatgtatcaaatttggctcagtgtgattactatattggatgcgtgtaatacatgcaacgagttcctctttattaatgtataatatggtttcggggaactgctggtttcattttgcattttagacttcacacaacttgcagcagcctcttacgagacaaggcagtattttttttcaacaaaactagaccaaaaccacatataaaaaaagcacagagaaattaaaagtatgccgaatctaattcgtacccttatcagaaaatcaagtaggatggctcccataactattgaaatcggtgtaatttaaccctctcagcggttttggagaacggtttcactgacgtgatgtttcaacccgatccaaccgactggctcaacatgtgggacccacgtatcatagtcacattttttttcttccttctctttctctttgtttcttcttttacccaccatggcgacacatggcccaaggaggagctgcagctaggccgccctgatgcgtagcgatgacgctgcctcgaggtgacgctacatcagcctcccctccagccagcgccaccgccgctgctcatcttcgtgttggggagaggggagaggcgacggcaaagcaaaagcagcgctcatcgatgtcgtcgaggttagggccgaggtcgttgagagaggcaatgcgaacatcccaaggtggagaggtcggctcctccctgttgagcgacggaaacagaggggtggtccggtggagcgaagaggagctggtcggcggtggcccaaaccgacggacggggacagggtcagcttggagcagagatccaagaggcgctcctcctgttgtgtcgagatcgataggggtggatcgcggtggaggtcgcggaagccggcgggggcggcacacgtcctttcttctctcaccgcaagcatcttcccccttccattctatccccgtgtcccgttgcccatgtcggcgaggtgctaggagctcgagcttcgactcgctgacaatggcatgcaacagcactatcgtagctccggcggtgggcctcgagggagggcggtggtggcatgctctcctcttcaccagctcggtgacaacggggacatgaggacgagttcgaactcgaggagaccacccaactccacgcgctggtgcctccgtcctcccgcctcttgcgccatgctcttagacgccatgggtgcctcgatgtcaagctccatgacggcagcggccatagccatgctactctaggccggagacgtgcttcggcggtggactcggtggtggtgggctcgtcgcgaccacccctgcatcactgttactgcgtagaacatcgtgcttgaacgccatgccgtcagcgacagccccgctgccgacttgccggccgcctcacactgccgggctagaaagaggagaaaaagagaaaaaaaaaagggagaagaaaatgtgacactgacatgtgggtcccacatacagagtcaaccagttggatcgggttaaagcgccacgtcagcgaaaccgccctccaaaaccatcgaaggagtcaaattataccagtttctcagggtcgttctacccggttttctggttaagggatacgagttagattcagcctactttaagggagttaaagttgatttttttttccactaataaaacatcatacaggcccattgcacattgcctagaaaaagacaaaagcccaatacggagaataaaaaatcagaccccaaaatgggaccgcaaaaggagtgctacgggcccactaactccctttgtttctttgtcacacgcccgttggatgcagatcgaatgctcacacaaattgactgacggattcaatttttttctggcgaccaacagacggtcccttcaattagtagtaaaaatcattaagagatcatgtcttggaaagaattggctactagtggctttcttaatctggcatggtataggattgggtgtaacatagttcggaaagaaaatcagcatgtgacaatgaatgcaggcttcaagctactttgtactcccttttgcttgcttcgagcaccaaaaactatcaggcacttcgaagctacgatgacgctagcggaaaagttctcattggaacggactatcaatccaacaaaagagttcgctcaccattgagtctgagaagtgatttttgtttgccctacgaaaaacattttacctagaaaaacagttatttgaaggctcctatttttgacgctcgatggtgcatctaggaagatgtaaaggggagccatctctagtgctatggttccttaagtaccctaagaaaacgttctaaaattattagagatccctaaaccaatggatccatcaaacatgtattttgcaagaggcatggatgagttagataatgtttagttgtttcctgaaaacacattgccatttgtgagatggttgctagttgctacattgctctgggcccatagctacttgttgctttgcttaattcgattacaatcatttttttaaggaaacccgattacaatcactggtggtatcttgttgtccttcatttttaatccataatttttgattgcaaattacccgccgagtagaaaccgtgataaggttctttttctcaggctattcatgatttgcgttcatgacatggttcaacaaaatgatactcatactctcctagactgtctaacaaattacgatttggccctctctactgttccctagcagcagaaaccacgattggtttgtcattcgggttgagctcggacctcctgcgcaatttcgattgacagggctgttgttaaagttcctcagattcaatgacaaacctcgtggggattctttgttgagtccggtgatgcttacaccaatatcttcggctcagcaatcaacctcaatctggtgccattcccgtggaggtaactgaaggggattaacggtttgtcaagcggtgtgcacttatcatgaggcccatggcagcagccgacacaattttaatacgtctgtggctttgcagtagtcatggctcactgcatctccctgtccgcttggtcctttttctgctggtccgtttcatttggaaggctgcttccatagttcggctcaccctctctttttagggttgtcacttttgctttcaatttctatctttggttgtgtactggggtttatcccttaactctgttcttgcttaataaagtcatttgtgtttaaaaaaaacaaatttcaagtaaatatgaattacaaaaatgtatctgttatgagttatcgaaagcatataccagtgctcaggcgaatgaatggtgttaatggttagtaatttctgaatacaaataaacttcctaccactgaatacaaatctccttcaaccctacttccctccaaacttgtttagctgcgccctgcctcaccttccctgaactcctgcggctggtcgtcgttgacgacgctggtagtatttaccgtaacgagagtccacaacaattggcttctctcgacgttgacgacactggtagtatctctcgtaactagagtccacaacaattggcttctctgatcttctgtagtttcttccaagagaagtactaagctgttccacaccacccatgtaacgagctttcctctccattgccttgtggagagcactctcatatctttcccctcttcttttttccaaacgtgacatgctccttttcgaaactgggacttcaggccccttcatgatctgattcgatcattgtgaaaatatgcagagttgtaatgctttgagtaacaattttgacagagaaacaaatcaggcagcaattgctaaatacctcaggtttttcagctactgactggttttgtgcttcagtagacctgactaatttcaggtctgctgttaccaccaaggtctccgcttcagcagccatagcttgttgtgcgtccagtgggccatgtggttccaataccaaatccaatgggccctgcatgcatatgtagttactagttacagattatcagaacaacacaaatttcacaaaggaaactctgaagctgatctttacctctgaattcacaacatcagttctctctgcagcaagattaacatgtttcatcatgttctgagtagcgatcatctgaagcggctccacatattctgcagattgtaaaggaatagccaaatccgctggttgaacctctgtagggtatacaaataagctaaacaatgatttttgtacggttgagcatcaatataatacaggaaaacagcatactattccattcttaactacttgactctcagtcatacatccagccttcccctcctactgccactgtataccgtactgaacttggcactaacattactaccatgtaataagtttctctagtgctttaacaccatgggaatcacaagaacattgctgaaaactactacatctgtcccataataattgtatttctaggatttgaatttgtcccaaaataattgtcacaatagagtactaataggtctcattaatcacttctcatttaatctttttctattttaccctccactacccttccactcttacctatacaccatttaataaggggcatcatagtatttcttctcaaaccttaatatatactccctccgtactcgtaaaggaagtcatttaggacagcgacacggtctccaaaacacaactttgatttcttgtttctataaaaatatttattgaaaagtgatatatgtatacttttataaaagtatttttcaagacaaatctattcatataatttttacattttcaaactcaacaacttgagagttattcatgatttatattcccaaggtttgacttaaacattgtcctaaacaacttcctttatgagtacggagggagtactaaacaaactagaattgcaatttatatgggacggaggtagtatataagaacaagggaggaggacattcaagcaagctgcatcttgtctgacacctcaagaaaaggtcactgtggtttaaggtgcattggatcagcatcgagtggatattttttgtttagcaaaatgatgaaaatgaatcaaccttgaccttgacttaggccaaaccaactgaaatgcaacaaaacaataacgtcaatttttcgttagtgtgatgcctactttttgttagccactaaaaaatgaccacataaatcttatgagatgtctaaacagctgtgtgggtagcatttttatgagacatctaaattactttccaaaacaatagatgcctaattgaacccagtatgcctaccatgaaatgcggccattggcaggtctccatctaaagtctaaacatgactttacaaaaaacatgtacatgttcttcataactaatagttcggattaaacagataaaattagccaatttgtagttctgtcagttcagttcaggaagcatgaaaccaaagagttataattcagtttaattctttaagaattaaatccaaaagttgctgttgaagtgattggaatgctcgccctctaccaacacagtgaccaaaactacactagcaatcaattaagatcaactcacttctcatagcaagttatccacagtaagttccaactcgtagtctaaagaagcaatccactcatatatttggaagtacctaagtgatgtgtgaaagacttaccgctatcgaccaacaaagcgggtggccatggcgtttggaaaagataagtctcgccgctgcacctaaactcagccatgaccttcatattcttcaggtcaatggcaaattgaggatagcggtcatcccaggaaacaagaaccaatccactagccactgttcggacttgtcgcaccagggaatgcctgtcaagcacttcactaaccggcatttccttctccaattcccacctcctgccaccaccgtcctcctccatgagcagccacacttgcatgtggacgttgtccatggtgccatcaaggcatacaaggcagcacacgccatcctccatctcccctatggcgtacttggaaggctggaacaagcttacagggagactgagcatggagaattccatcgtgagcgtgtcaagcaatatcacaaaattgtcctcgcatttccagaagataatccccgccgcatgcatcgcctggccccggcgaggccgcctcatgttttccacccacgggtggaagctccactctcgagtaccggagttgtactccgcggcgcgcatcctccggccatggcgctgcacggacaccacgcggaacgacgccgcgccgttgtcgccgcgcccgtgcagcaagcagtcggcaatgtaggcgtccgagaaggggtcgtcctgtgggcggcggatggagacgcgccggcgggacaccgggtcgtagacggcgacggatctacctccgcagaggagcaggcggccgttgcggcagtcccggagttgccagcggggatcctcgccgtccccgacgcggatgagcgagaagtcgcccccgagtaccgcggcgccgaggtcggggtcggagcggacggtcgcggcggggtggaacacggggaggccggagctcccgtgggagacgaacaggccgaggagaggcgacgaggtgtggcgggcgcggaatcggcggaggaagtcggggccggaggcgacggcgagccagcacttggaggctagcgcggcgcgttggagggaggccgccgacgggaggcggagaaggatctcggcgaggaggtcgtcggtaaatggctgcaatgccatccggatccggaggagtgggggcggcggccggcgcgctacgggaagaggccggaggagacgggaggggcgcggagttcaccggagtggcgaatagcaaggcagaggcccgcgacacatactgacgcacgacgcaggtcgccgccgcccgccggtgaacccccaaaggaacggtgggattggaccgttgagcagtgaggtgagcacttttcacttcgcacgagtccttgtcttcggtcgcctttcctttttttttttaacgaaccgcgtgatgcgaggttccatattaataacagaaataaattactccacaaatgtaaaaaaaaacaagaaaaaattattatctagattacctcaataaatacaatgaaagcagccaatgatactagagatattacagttgaggattaaacaaacaaaatttaagggagacgggtgtgctacttaattgcattgcatgcatacatgcgtgttttttttattatgaaacataagaaaaatagttgtcttatattttagtataaacattaaaaaaataatggttatgtcttatattttgggataggggagtagtagaaaaatgattataatagcttggaaggttataataaaaggaaaaaacaatacgtcatgttgcattcctacaacacattgctcactgttgagggacaaatagataaaaacacgtcagtacgtcaaccaaaatgcacttaaatttatccatgctattgtatggagagggagagggcaattgataaggatggagccgctcttccccgtgcaaaaccgccaatatggccatcttgagaagagcggcgcgggcggcggcgtcgggcgctggggcctgggggagagccgcgcgagcgaccggtgttgagggctggcggcgactcgtgtgggattggggatgaggagtagagctagggttttgatgcatatatggcccttcaagcacatatgggccacaagtccacaacagcatgggctagctacctcagctcattaaggctcgcgagcagctcgcgagccagttcgagctggctcgttatctctaacgagttaaaaggccagctcggctcgttagaaaaatgaaacgagccgagctgagcttggcgcgagtcaagcgagctaacaagccacgagcttttcgtccaggccttttgatgggtgagatagctgggcatggtttgggtggcttggacaccaagcgtccgtggtgatcacgagttcacgacaaggaacaacgtcaggaggagatgaggagattggatcttgtatttgcttgattaggaatgacactgtcgagctccttaaatatactatatatatagagagtatatgtttgaaagttttcaattaaataacttgctataatatttttagatagtcccaaaattttccctattacctccgtcttaaaatatagctatttctagcacaataccttatcccaaaataaaactatttcttcacctacctcctcctctcaaccaatcacaaccattctccttcacctacccatgacacattaatcaataatacacttcctccaatcattctcacatacttttttaatatccgtgtcaacctaaaaaatatctacattttaggatagaggaagtaatacattatcaacaactgcaaaattaacaccatacgaatgtgctttcgaatgcgaatacgatgatatcatatgcatgccactagatatatatatatagttagttagttagttagtttaattattataaaaatgatgcaaatgttgctttttttcctaatattataggcgccttagaatagagggaatagacactacttttattattaaaatgaccaaaacgtcgaaggagggattttatattagacaaattttgcgacagcacactgctattgtgtggttttagccgtaggacaccgcccgaatatacttttgggagaagacactccataaacgtggtaatttatcaatggacaccgcgccgattagaataataattcctggttgaagagtagacagaaatcacgtgaaagttctaaaatacccttgagtccacatgtcatatatttctaacatctctcttctctctatcccctcccacgcttccatagccgatgcctcaccgatgacgccatgcctcaccaaggacgggggagtcgagcagctcggtggggctgagccccagtgggatggcgaagtaggacgacggcgacactggtggcggcgagagcggcaggcttggtggctgtgcggacttgaacttgggcaccgaccaccagagccaccgcgccacgaggaggtgttctccaatggcctcaacatcccggacatcatcaacgagcacctcggcgccgagccgaccctcccttacctcagcccggaccttcgtggcgccaagctcctcgtcggcgccaacttcgcctccgctagcgtcggcatcctcaacgacaccggcatccagttcgtgagtgccactgactgatcactgatcgatcgcggtcggtgagatgcgttcatggcgttcatggcggtgttcttgcaggtgaacatcgtgaggatgagcaggcagctgcagttctttgcggagtaccacaggagaggctacgcgcgctggtcggcacggcgagggcacggcggatcgtgaacggcgtgctcgtgctcatcaccctcggcggcaacgacttcatgaccaactactacctcgtccctttctcccttcgctcccagcagttcgccctccccgactacgtccgcttcctcatctccgagtacaagaaaatcctccaggtctgttagactaagcctgtcacatttagctggttagttattcatttgtttgtgcatccgtggcaggtcattggattctgtcacgagttagtttctcttttacatgttgcatgagccagaggcgcgcagagttcgcgtcatggccgagagtgcgtgtgtgtgtgactcgccgagaatgcagcgttgatcagcacttcgtgggatggcgcggaggaagtggtcatagcggctgaataggtgaagctgttagtttgttatgcatgtaatcgttggagaataaatgagataaaaaaaccagaaaagctgcaagacgttgcgcggcaccaaaaacctgtgttcttgtgttcatctctgttcgttttgctttcacgcgcgtctacacttttgtttttcctgtgtttatccaagtgatcgcgtgtgtgagggttttgccacaacaagtggtatcagagcctgagtttaacatgtcttccgacagcgacagtggccgctacactcctccggggcggcgtggcgccggcggcggcggcggcagcggcagtggcagcaagcagggcggtggttcaggcactggcactgatggtgctgaagtccccatcgtccaacaaccagcaccgagggatcctagcgtagccgtgcgctatccggtgctgacgagaaccaactatgccgaatgggcaatgttgatgagggtcagcctcctggcacaaggtgtttggggagcagttgatccgggctatgctgagttcaaggaagatcgggtcgcactagcagccattttgcaagctgtctcaaaggagatgctacgaccgttagcaaagaaggactccgcaaaggccgcttgggatgccatcaaactcatgcgagtgggtgttgatcgtgttcgtgaggcgaaggaacaggcgttccgtcagcaatacgaagcaatgcgcttcaaggtaggagaaactgcggaggagttcagcttgaggctaacatcggtggtcacggacatccgtgacatgggtggcgtgcttgatgatgagcatatgatcaaaaaattcctacgtgttgttccaaaaaggtacaagcaggtggcagtcgcacttgaacaattccttgatctgaagacaatgccaatcgaggagcttgtcgggaggttgtcgaccgccgaaagggatgataacgtggacgacgacgatgatgcgccacgcggaaatcgtctctatctcaccgaggaggagtgcttggcccgcatgaaactgaaggaccacgatgggtcctcgagcgggtcgaagagcggtggcggcggtgagaaaagccgtcatgacaagccgtgcagcggtgggcgtggtgaccgcggccacgacaacaaaagcggcggtggatcatcgtcgaccagaacgtgggataggtccaaggtaaagtgcttcaattgtgataaacttgggcactattccaaggaatgtcgcaagcctcgccgcgagtggcgggaggaggcaaacctggtgcaggttgagaatgaacagccggcgctgcttttcaccgaagtgcaccagacggtgttcctcaacgaggaacgcgtgattccgaaggagatgcctgatgatgtctggtattttgatactggcgctagcaaccacatgattgggaaccgagcgatgtttgcatcgcttgacgagaaggtgactgggactgtccgcttcggcgacaactccgtggtcgagatccagggcatgggcgccgtcacgttccagtgcaaaaatggtgagcaccgtgccctgacggaggtgtactacatccctcgcctgcgtagcaacataatcagcctcgggcagcttgaggaaggaggatgcagaggtgtccttgaaaacgccgcactaacgctgttcgacgcagagcgtcagctgcttgcgtgggtgccacgcaaaaacaggatgtataccctgtccctgaaactggccacgcctgtgtgcctgctgacgaaggcagatgatgaagcatggcggtggcacgagcggtttggacatctcaatttccgctcattgcgtgatatgagtctgaagcatatggttgaaggcatgccactggtgaaccacgtcgagcagttctgtcaggggtgctcccttggcaagcaccacagggctccgttcccgcgcgcgtctgcattccgcgcggagcgagggttcgaattagttcacggcgacttgtgtggaccaatcacgccgacaacaactactggtaaacgctattttcttttgatcgttgatgattattctcggtacatgtgggtcgagatgctcaggagcaaagatgaagcgttcaagtgtttcaagaaaatcaaggcagcagctgagaacgagcttgacgtgaagctcaaagctttccgcactgatcgtggaggagaattcaactccaatgagtttaccagctattgtgtcgagctgggcattcgtcgggacaccacggcgccgtatacaccccagcaaaacggggtggttgagcggcggaataggacggtggtggagatggctcgaagcatgttgaagagcaagggcgtgccggcacatttctgggcggaggctgtcaagacggcggtgcacgtcctgaaccgtgcgcccacgcgcgctctcgacggcatgacgccctatgaggcgttgtatcgtcggaaacccaaggtacattatctgcgtacttttggatgtgctgctcttgtgaaaaaggttgggcctggggtgtcgaagctatccgatcgctccatcccaggcgtgttcatcggctatgaagacaatgccaaggcatatcgggtttatgatccggttgcaaagaagttgtatgtgtcacgtgatgtggtgtttgaggaggagaagaagtggaactgggaaaccaatactggcagacaagatcctgactggtctggcacgttcactgttgtgtatactcccagggacatgggagacagcttgggatccaacggaggcacccaagaggtgtccgacgcaccggggcagcagtcgccggctacaccggagcggccgccgccggccacgccatccatgccgaccacctcgactggtgtggagtttgtcagtccgccgatgggaggttcgtgtgactcggaagggatgccactccgttaccgttcgctggaaaatcttcaacagacgacgctgccggtcgatgacacggtgatgtcggacgtcaacgacttcagcgggttttgcctcgtggctgccgaggagccagacagcgtggaacgtgcgctggccgaacccaattggcggcgtgcaatggaggacgagatgagctccatccgtggaaatgaaacctgggagtttgcaaggcttccagaagggcatcgagccattgggcttaagtgggtttttaaagtaaaacgagaccctgctggtaacatcgtcaagtacaaggcacgactagtggcgaaagggtatgcgcagcgccagggggtggactttgatgaagtgtttgctccggtggcacgcttggagatggtgcggctgctacttgctttggctgcacatgacggttggtcagttcatcacatggacgtcaaatcagcgttcttgaatggtgatcttgaggaagaagtctatgtgcagtagcctcccggatttattgacgacaagcagggcggtgcagtactcaggctgcgcaaggcattgtatgggctgcggcaagcaccgcgagcctagcattccaagttggacgccaccctggtgtcacttggttttgatcgatgtcccatggagcatggtgtgtacaagcgaaagactggtgatgatctactgctagttggagtatatgtggatgatttaatcgttacagggtccaaagatactgatattgaggagttcaaggctcaaatggggaaattgttcagtatgagtgatcttggtctcctgagttattacttggggatcgaggtacaacagtctagaggaataatcaccatgtgtcaaagtagctatgcaaagaagatcctagagatgtctgggatgatcggctgcaatgcttgtgcaacacctatggagaaccgactgaagttgagcaagaaagatggcagtgcagctgtgaatccaaccgagtacagaagcatagtgggaagtctccgttacttggtaaatactaggcctgatcttgcttactcagttggcatagtcagcagatatatggaagctccaacatcacagcatatggctgccgtgaagcatattttaagatatctgagtggaactattggatttggttgctgctatcgcaaacaagaccagtctgataatggcttgatgggctacagtgacagcgatatcgctagtgatctcgatgatcggagaagcatgtcaggtgcagctttcttccttggagcaagcttggttacttggacgtcacagaagcagaaagtcgtggcgctctcatcgtgtgaggctgagtacatcgcagccgcgtcagctgcgtgtcaaggtctgtggctatctcgcttgcttaatgacttgattggaggtgcagcgaagaagttcaagttgttggtggacaacaagtcggccatagcgcttacgaaaaatcctgttcatcatgacagaagcaaacatattgacaccaaattccattttattcgtcagtgtgttgaggaagaaaaggttcagattgatcacattggcacagatggtcagctagctgatttacccaccaagccacttgggcgtgtcaaattcctggagttaaggcggaagctgggtgtcgagaacgtgaaggtgacaaggcttaggggggtgatttgttagactaagcctgtcacatttagctggttagttattcatttgtttgtgcatccgtggcaggtcattggattctgtcacgagttagtttctcttttacatgttgcatgagccagaggcgcgcagagttcgcgtcatggccgagagtgcgtgtgtgcgtgactcgccaagaatgcagcgttgatcagcacttcgtgggatggcgcggaggaagtggtcatagcggctgaataggtgaagctgttagtttgttatgcatgtaatcgttggagaataaatgagataaaaaaaccagaaaagctgcaagacgttgcgcggcaccaaaaacctgtgttcttgtgttcatctctgttcgttttgctttcacgcgcgtctacacttttgtttttcctgtgtttatccaagtgatcgcgtgtgtgagggttttgccacaacaaggtccgtatacacttcgtcttcttcctctcgatcaattcgtctctgatgtgttcgtccgttggcatggcatggcattggaagaggctgtacgacatgggggcgaggcgggtgctggtgatggggacggggccgctggggtgcgcgccgcacgtgatgcgcgcggcggagctgttcaacccgcagctgtcgcgcgcgctgcaggaactcgctggagagcctgttcccgttgaggaacacgttgcagagcgccgtggcggaggcaaggtctcccaggagcgcaccagtgagcgcattgaggtggaggctgagcgtgtgcagcgccgtcaaatcgtcgtggcggcagaggacgacgccgacgccgcgatggcaacggcggacaccgcgagtccgcgagctttccgacagatagagagagatgagagagcggtggtggtgtggcagcgcggcacgcggcacgcgccatggaagtgtggccgtgggcaaccgtaggccatggacgggatagagagggatgggagagagatatgacatgtgggcccaagggcattttagaactttcacgcgatttctctctcctcttcaatcggaaattattattctaatcggtgcggtgtacattggcaaattaccacttttatttagtttctttcccccaaaagtaagttcgggcggtgtcctacggctaaaacaacacaatagcagtgtcatgtaacaaaatttgcctttatattattacttgaaataatactgtagagacctctatagttctaatggccccaggtaatgttatgctttagggctcgtttggaaaaaaaaaagaaaaagtgaaggatttctagaggatctagatctttagggtacaattaaaacaaaatattgatgcttaaatttctttcgaagatcctatggaaggagccattctatgctggagccattctatgctggtattgaaggaaaacaaacataatgtcttccctgctggaagacctaaattagtagattattagatagtctacagaaagaataatctgtagaaatatcttaaaagcctacctgatagaaaatatttatagtgccatcttattatttataatttatagtaccaccttattagttctagtatagtagacgtctagtcacttgaacaatgtggtaagaattagagaaatgtgcatgctcgtacccctcgtcaggccgggctcaggcatggggctccaaatggtcgcgcatacgccgcttttttctatagctctgctttattgtatttaacgaattatccgatgtttgtttgttaaactcactggatggtctgctgcgtggcgtggatatcatacaagcctcttgatcacacgttgcagtatctctataaataccaaaccgccgtctatatgcaacttacatgaaaacaattgccttctcttttgtattgccccattgctcattgtttactccatcacgcccgccaccatgcacgggcatccgggagagcagctatatgcaacagttgcctttaacatcctgcacctagccagagagggcggataagatttggaagtgctccgcacgactgctcattgttcatccactgtggctcattttcctatgttccatcgatgtgtgttgtcatcaatattttgtaccgcacgtcgtatgggcagtgagtgccgcgcctcgtctagaacaaaatcgtcggtatgttttaactatgtttcgtatatttgatatattcatgtctagtattgtcgtatacatatctaggcaatatttatgtgaggtgataatgttagcttatatagttatatgtttaatattatgatttatttgtatgtggtggcggtagggtttcggcagtggattggggaaatggagcggtggacggggtgctcacgatggctgcggtggcgggaaaagcgacggcgcagtgcgnggtggacgggagcgacgatggggcaccgctgaatgcgatgggaggcggtggagagagggaacacggtggagaggtgctttaggtggtattttggggaaacgggagggatgcccaggtagaacttggcacggcgttgcccacggcgcaagtggcgtggcgcgacggtgactagggcggcggcgaggtgcggctaaaaagctccggcgggcggctgcgcatggctcggcgtggggagagcgatagggggcgcggcgagcccggggatttggggaaaatgggagagggggccccggggatgctttttataggtccgggaggtggaaatcgggaccgagaaaggcgggaaccgaccggcgatgtggggcgccgacgtgggaaggttggcggcggttcggcgctgattttgcggggaggagtgggggaaatgggggaggaggaggtggggatcgagtccacgtgctcgcgaggtgaggtggagcgcgggaagcgcggcatcgtggggcgaaaccggcagccatggcggttgcagccggccggatggaggtaaggggagaagctgacgagtgggcccgcggtcccacttgtcggcgagagaagggggaggaggccgatggagggatgcaaagaggacttgcgggagagggagggggaggagctgggccggcccaaaagaagggagaacttgggccgaaaggaggcccgaaaggaaagagggggattttaattgtttttctttttatttaattggttaaatgaactttgtgctattaaaattatttcttagaaaatttacagaaaaatccggagagtatatttaggcacagagaatatttcaaaatatttccggccaatgatttttaaagaaaattttaatttcctttataatttcccttgattaaattactttaaattttaatataattcctagaaaatgcattactaattgatttttaatccccaacgaaaatcggggcgttacactcaacctcctgctgcaggatcagaaggttttaacgaggtacgccggccatcacccatcgggttggctgcataggctgacacgcagcctcggccgctgccgatggagaggatctcggtcacaggacaggatcggtgatgttgtcgagggcttgcagttgcaatagcctggctgacttcaatgtcaacgccagcacgaccttatcgatgagctctacaaacttggcctataagcctgatctgcctgtacgtcttagtccatgatctaaaattgtgattcctgatttatgagggactatgagtctgatctccctgtatcagactatcagtccatcatctattttgttttttcttcctaatttgtcagggttttttaacaggggaagacaacgaggtgatggaaaacaacaccgcctgccagatgcagtatgttagcagcgtgtatttgtttgacgaattgagtttgcagcgcatatgtgaaggatggttattgtaatgtgtgaaggctagggatcatggtcacttctgtacatgccacaacacggtatttgcactcttctcatttaatctactagcccataggccccatacaaaactaaatgttagtacatgccagatacactattcataattttgccactgtttataggtcaattttttccatgattgataaaagttcaccttcacatctttttttaatcaacgctgacattaactaactccttaattatttacttgcatcctgtacattgactgagcagttctcttcaaaaggaagaatgtcatcacaaacaacaatgtgggcatgatctactgtcaatgtatgaatactaattgaatatttgttttttttttcatatacactaattgaaatagtactaggaagagagctataatacagtaaggtggttgttcgtcacaaataaaaatcaaggatggttattcaacaaaattatttccacgctgattcggcacttcagatttctactgcttgcattgtatcaatatttttagatgattatattactaatattattgatgtacctagaaattatacatgttatgttgtaatgtgattcgtttgttaatgacaggaattaggaaatatgggaagtggtgtttgatgttttctcatacagccatatttatattatatctggtctatgcaagaccaaattttgcttaggaaaaaatatttgacaaagaaaaccattttgcaagtccaaaaaagaccaggggacttacatttttgggctagtctcatattagccaaagagtcttttcaaaggttcggttccttcttattacaagatggctcacaagtaagattttgggaggattgttggataggagttcaatcctttgagaaggagtatcctaacctctacaatctagttagaaataaaaataaggtggtggccaaggtaatgagtggaataccgttaaatctgtctttcagaagatcaatagtgggaagaaacttggaagcctggtatgagctagtgtcgaaagttgttaacactgtattgacagatcagaaagatcgcttcttttggaaaaacaataaagaaggcattttcacagtaaaatctatgtacaagttcctcatgtatgaagggctggttcctaggaagaatttcatttggaagctcaaaattccacttaaaatcaaaattttattgtggtacctcaaggaaggggtaattctcactaaggataatctagcaaagagaaggtggaagggtagcctaagttgctgtttttgtaactctaaggaaacaatacaacaccttttctttgattgctcaatggctagatatatttggagtgcgctcctttttacatttgggattaggcaaccgtgtagcatgtctcaaatgtttgggaattggctgaattgtgttgaacctaggctcaagagaatattgtgtgtgggcatagctgtatttctttgggcaatttgattatataggaatgatgtggtctttaatggctccaatcctacatctttcttgcagatcattttcatgggaacacattgggcaaggacttggtctttgcttcttaagggaaccgatgaagaaatagttaagaactattgcaaagtgttggagaagcatgtggtggaattcttctccgtgtatggctggaaccttagaagaagattggaagcctagtcttttcttcgtttgttgttcttaaaacctttgtttgtgctgtcatctcttatgtaatgggagaggtcagttgatgcattttgtacccttttattagggagagtcttatgtactcgtgttcggattttggctgtgtataccccacaaaggtgtagaggccgggtttgataatcctttatctaaaaaatgcaagctcatgtggttaattcattctaagaattcttccttctgcctggctgctctgatcttttcttactacatcgagataccgtcagatcatgacatgtcttctcttcgtccgttgcaaaattgtgtgtgtgtgtttttattaatcactccatcttctgccaaattgtaagtccatacctttcatttcatctggaccctgtgaacgggaccggatttcctgtctagatttgtcttttttaactaatttttaacttttttctattcagtgtactgatggtctagatggtgcatggatacaggaggctgttctacactggtggagaaaccatctttcgtcggtcggccgaattccacaatagtttcggttgcaataaaaaccggggctaaagatgattttagtcccggttaaaaagggtaacggacatatttaatttttagtcccggactaaagatgatctttagtctcggttcaaatgctgtcagggcctgccaggcctcccccggattaccaaccgggactaaagatcgtaactttagtcccggttagtgttaccaaccgggactaaagatcacggggatctttagccccggttcataacaccaaccgggactaaagtcccacccctatatatatgtcttcttcctgctccagctgcccgagcaagcttcaaaatttcttcaaaaaagaggggaggtcatgccaaaatttctagtgaatttattttggtgattatatacaaatcggaggtgcctaaaaggttagtaacttcatcctccaatgtttttttttgtcatattacatttggagctatgttttgcacacttttttgtctccaaaatttagttgtaagttgatgagagagaaaatttgtgtgggggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtcattattgtatgactgttgaaagagtttgtaattattttataattattgtatgactgtcattattgtacgaataattatttatgtatgattttttttcttttcatgtagatggatcggcaatggatgtacgctgaccggcggtccaaagagtttattgacggcgtgcattattttttgagagtggccgaagctaacaggcataagggttttatttgttgtccatgcaataagtgtaagaatcagaaggagtattctgcatccaggactattcatttccatttgtttgagtcggggttcatgccaagctataactgttggacatcccacggagaggaaggggttgaaatggaagaagatgaagtggaagacgataatattccggactttagtcaggacgctggatttgaaggaaatcaaatgggcgaggaggaaagggatgctgatggtaacgacgttgcggatgatcttggtcagatgttgcaggacgccaaggaggactgcgaaagtgaaaagggggcccataaattggacaagatgttagaggactacagaacgtcgttgtacccaggttgcgagcaggggcacaaaaagttggataccactctggagttcttgcaatggaaggcaaaaaatggtgttagtgacaaggcatttggtgatttattgaaactcgtcaagaacattcttccggagggaaacaaattgcctgagacaacgtacgaggctaagaagatagtctgccctctaggactggaagtttagaagatccatgcatgtccgaatgattgtatcctatatcgcggtgaggagtacgagaacctagaagcatgccctgtttgcaaagcactacgatacaagattagacgagacgatccaggagaagttgacgggcagctaacaaagaagagaattcctgataaggtgatgtggtatttccctataataccacggctaaggcatttgttcaggaataaggggaatgctagaacgatgcgatggcacgctgaagagcgtcaacaggacgggatgctgagacaccccgccgatggttcgcagtggcgaaacatcggcaaaaaatttaaagactttgaaaaggacgcatgaaacatacggtttggtttaagtacggatggcatgaatccttttggagagatgagcagcagccatagcactttgtcgcgccccaaaacaaccctaaaatacatcctctaaattatgcctagaataattaaaatccttgtgaaagcctttaaaaattaaaatgtgcaaagttaaaagtcaataaaggcttggaggattttttgtatatttcctaaaagcctaaaatgtgtaaataaattttagtggaattttcagagcacaaataataattgttaagaaataaacaaagttaaaaatgttttataaaaagaaaaaccctaaaaatcccccttccctctcttgggtcggctcggcccatttccctccccctctcccttctctccccgcggcccatccggcctctccccacgcgcgcgccgctgacgggtgggcccgcccgccaccctcgctgacgggtggggcccacccgtcatctccttcctcccgccgctcccgccgcctcgcccgcgcctagcgccgccgccgccgtgaatcccgccgcctcccgtcgtccccgcgtgaaatcaataggggggaattactccccgtgatcccctccccgtttccccccattttcccctctctctctctctcgcattcaaacggctggatttgctcccgcaaatctcgccggcgccattgatggcggtcggacctcccggccggtttccttccttccccggccgccctctcccccttccaaccccatttaaaccctccccgcacctccttcgcccgtttccacccttttgccgcaccttctcctcgccggaatcgagctcgcgccgtcgccctctctctcctccgtcgccgacgaccttcggccggctctctccgctcgccgggaccgtttcccgccccagcgtcgccttctccggcttcgccgcaccgccgccgtcaccgtccacccccttgtcgagctcgccgaccgccagagcgccgccgtccccgtccgcccgagccgcgccgctgccttcctccgctccggtcgcctttttcgtcgtcgccgtcgacctagagtgagccgtggaccgccgcctcgtttccccctttccctcccctctctcggacgccgctccgccgcgcctatggctgccgccggcgaccataggggcgcaggcgcgccgcctcccgccggccacgccgacgtggccgccttcgggcgcgccgagcggctgccgcgtggggcccggccgtcagccgcccgcgccctcgggtgcggctgacgcgtggggcccacggcgccggccggtgcgagcccgggtgcgcccggtccaccgtggaccgtgaggctgccacgtgggccccactcccgtggacccggtccgcgcccccctccccctcggctgacgcaataatccatttttaaattaaaatttaaatgaagaaattcgtaaatattcatttaaagagcatataaacctcaaatggccataacttggccatttgaactcggaattggaccgttcaagtctctaatttttccttaagaagtcaagaacccatttttgtgctttgttcctacttgttatatgaagtttattagagtaaaagcctttttattttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattaatgcattatcgctttatttaaattcccgcgttatcactgttttatttagccatgcctatttacctttgttatgaccttattattattgctattattattattaccttgttcaccctagactaaacaaaacctccaactagtgggtaccctatgcgtggtaccactagtatgaatttaggtagatgcttcgctggttaattaggcaacattaggtggttttacaactctagactttgggagtattcatatcacctggacactatggaatggttggattattgtggaattggattcacacctccccctctattcaaaatcctcaaaatggttttaggctgggctcggggtgcatggttttgatagtagcgcctcggccatataaggaccggtcttcgggcttctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcctggtagtcgagatgtcatggcacagggctggtgtcctgctgctaggggctcagtcctgcctacctgtcccggaggttccggccgtaggtggggttgggtcggtactcttgtctatggctaggatgggttggaaactatgtcacatcttccgtccgtataccgtggtggtatgtggcatgtggttacacgtgaggaagatgtgtcttgtgggtaaagatgtacacctctgatcagagtataacctattcgaatagccgcgccctcggttatgggcaagcctagcaatgtacccaagttagtgttttaattcttaaaacctgcttaacaactaaaatatggaatggttggcctgggttggcttgggacgagctgggacccagggtcgggttgccagttcggtctgaatcatcgtaggccttgggttaaggcaggttcgtgtgggttcatggccttgattaataatcttgtatagctctaggatcgtatttacaaaataagctttgagcaactaagtgtcttttaatgctgtttactgcaaaccctaacccctcatattataacccccttgtactcccttgcatttattctgcacttgtgggtgtgtcttgttgagtatggtggttgtactcagtcttgctcaatttttcccaaacccagaagaggagttcctggatgatgaaggctttggtgtctagctcgtgcctgccgtcaagcgcctatggtcgtcgccctagtcttccgctgtttttcgtttgtcttcttgtgtgctgggccttcgccgcccatgtaataaattaattatttacgcttccgcttgttaaactctgaattgtatcaacttttggtgtaccttgcctcctaggacaaggaataatacacgcacgtaaggaacgcccgttgggttatttccggtcgtgacacacttggcccgttacgatgtgtatctacaacctccctcctggctatgtatgaagaggaagtacataatgataccaattattattcaaggccccaagcaacttggtaacgacatcgatgtgtacctaggaccactggtcgaagatcttaaactgttatggaaaaaggaaggtgtccccgtgtgggacgagaacaaacaggaggagtttaacctacgagcgctgctgttcgtaaccattaacgattggcctgcacttagcaacctttccggtcagtccaacaaggggtacaaggcttgcactcactgtatggatgaaacagaaagtacgtatcgtaagcactgtaggaaggttgtgtacatgggtcatcgtcgattccttgctgcaaaccacccggtacggaagaaaggcaagcactttgaacataaggcggaccaccgtacgaagcctaaatatcgcagcgggaaaacagtgtttgctatggttaaagaccttaaagtagtgttctgaaaggggcctggaagccagcctatagagagcgaaggtggtcacgcagcgatgtggaaaaagaactctatattttgggagttaccctattgggaattcttggacgtctgccacgcaattgacgtgatgcacctcactaagaacctttgcgtaaaccttcttggcttcctaggtgtatatggaaagttgaaagatacattggaagcatgtaatgatctaaagcatatggaacaactcggcgaccttcacccggaaccaaaggagaaaggaagccattacttgagtccagccagctacactcttagcaaggcagagaaggaaagtatgtttgaatgcttggagagcataaaggtactgtctggatactccacgaatatcaaccgaataataagcacgaaggagaagaagttcataaacctaaagtctcatgactgtcacgtgttgatgacacaactgctaccagttgtaataaggggtatccttccagacaatgtccgggcaacaataacaaagctatgtgctttcatgaacgcaattttgcagaaggttatcgacccggatagattagaagcccttcagaatgatgtggtgcaatgtcttgtcagttttgagttgatatttccaccttcatttttcaatataatgaagcatatgctttgtcaccttgtcaaagagaacagtattctcgggcatgtgtacctacacaacatgttttctttcgagaggtacatggcgtgttctgaagaagtatgttcgtaaccgtgctcgtccagaggcaagcatcgccaaggggtatggaacagaggaggtcatcgaattttgcgtaaaatttattgaaaaccttcgcccaatcagggtacctgaatcacgccatgaagggagactacggggaaagggaactctcggaaggaaagcaataatgacggtagacaacaatttattccgtaaagcccatttcacggttctgcaacaatcttcattggtagctccttacatcgaggagcacttggctctagttcacgctagaaacatcggtaagtccgatgcatggattacacggcatcacattgatactttccccgcgtggctacgacaacatctcatgggtaacgagacgatcaaccaacaactggccttcctggcgaggggaccatctgggtcgatcgcgacattccagggatatgagatcaatgggtacacattctacacgagagcccaagacatgaagagcatgaaccaaaacagcgcagttcgtatcgatgccatgggacacgatggaacaaccggcacgtattacgtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtctagcaaaggaaagaagggtagagggcatgacgagccgaagcgtcacgtggttcacccaggcaaaagaaaaatcgtcggagttgaggacaagactgacgaggattacgattagttggatgggcaacccccttccacggtgatgattgaccctagcatcctcctatcaaatgaagacaccccttactcacgtagcgatcacaaggagggaacaatagtgaggagatagtacgtgcggtcaaccgtcaccgccgatgtattgccgtaattattgtatacacgatgtaaactattttggatgtattgattatccatataaatcaattgttgtatggcatatgttaattacgtacgattattagaggttttaacagttttaaatcatgtatatgctagttatatgcaataattagaatttttaaaagttttaaatgatgcatgtggcatttacatatgttacttagagtttttaacaattttaaatcatgcatatgctagttatatgcgataattagaatttttaaaagttttaaatcatgcatgtggcatttacatatgttacttagagtttttaacaattttaaatcatgcatatgctagttatatgcgataattaggatttttaaaagttttaaatcatacatgtggcatttacatatgttaattagagtttttaacaattaatttaatatcattcatatgctaattatatatgattattagaatttttattaattttaaatcatatatttgcttattacgttttatccacttaatttactacagacaacaataatttttcgaagtaattgtcattaatttttcgactttaaataattttagtgcattattttctattttagaaacacatatgtaatggaaatcaatattcagtgcgtttatcagtagtcctggttcttaaccctaaccgggtttaaaaagaatttgaaaatagagggaaattatctttagtcccggttgatgagaacaaccgggagtaatgatatctttactcccggttgttgagaacaaccgggagtaaagatcttatctttagtcccgattgataagatctttactcccagttgttcttgttctcatcaaccgggactaaagatttaggggtatatatatattcccgatgcgcgccctcgtcttctccaccaacacttagaagttttttccccgatcgatctctctcggcttctccttcgccgccactgcctagggcatccccgcgccgacgccgccgtcgtatctcgccgttgtctcgcgggcgtcgtcgtcgccgcctccgccgcctctgccacctccgccgccgccgcatctctagggtgagagccgccgccgcctccctctctctccaaccttgatctctctctctctctccccaaaccgccgccggccgcctcgttgccgacgccgccgccgacgtcgtcgcggccgaacacgactccgccgcgccgacgatgccgaccccgacctcgatacggcagccaccggcgacgacgtcgcgccggcagtgccgacgaagccgggccaccgcgccgccgcgccacgacgccgggccgcgccacgccgccgcggcggcacaacgccaggacgccacgacgccgccgcagcacgccactgccgcgctgctacgccgccgccgcgccgcgcgccactccgccgccgcgccaagccgcagccgcgccgccacgccgtcgccgcgccgcgcgccactccgccgccgcgccaagccgcagccgcgccgccacgccgccgctccgctgccgccacaccaccgctccgctgccgccacgtgaacgaacgaacgatcgtgaacgaacgaaacgtacgtgaacgtgaacgaacgaacgaacgtgaacgagaacgtgaacgaacgtgaacgaacgaaacgtacgtgaacgagaacatgaacgcgaacgaacgtaaacctaacgtgaacgtgaacgaacgtgaacttaacgttgtatgtgaacgtacgtaaacgaacgaacgtgcgtgaacgaaaagtgaacttaacaagaacgcgaacatgaacttaacgtacgttaacgtgaacgcacgtgaacgaacgaacgtaggtggacgaaacgtgaacttaacaagaacgcgaacgtgaacgatcgtgaatgaaacatgaacttggtgagaacgcgaacgtgaaatacaatatatgttactttgcgtttatcctaatacatctttttgtatgttgcagaaaagacgtagtcgtcgtcgtccctcaagccggagtggtagctaaccctcgaaggaattcgcgcaggcaagtgatgtaaatatatgattgttagatttttaatgcaattaagactattagatttaatatacgacacttggacttagcatatatgattatctaagtttgaaatgtacgacacttagacgacttagcatatatgattacctagggtcctaatatacgacacttatacttagcatagtataagattattagatttgtaataagacagcatataagattgtgtagggttctaatatacgacaattagacttagcatatatgactatttgagttttaatataagattattagagttctaatacaagattatttgagttttaatataagattattagatttgtaattagacttagtatataattattgtctagggtcctaatatacgacacttagacttagcatagttgactattacagttttaatacaatattatttgagttttaatataagattattagatttgtaataaaacttagcatataagattgtgtaaggttctaatatacgacagttagacttagcatttatgactatttgagttttaatataagattattagagttctaatacaagattatttgagttttaatataagattattagatttgtaattagacttagtatataattattgtctagggtcctaatatacgacacttagacttagcatagttgactattagagttttaatacaatattatttgagttttaatataagattattagagctttaatataagattattagatttttaataagacttagcatgtaggattgtgtagggttctaatatacgacagttagacttagtatatttgacttagcatatatgattgttagcatataagattgttaaagcaaaaatgacctatagacttagcaaatatttcttgtatgaacagatggctgatcgcgatgaggaacagatactgtacaatacaatcgtggagggaagcagccagtactggaacgaagaagaggggaacgaggatccaaaccagtacttgaacgaggaagggaacgtggagagggaagcggaggggaaccaggaggggaacgtggagagggatgtggaggggaaccaggaggaggaggctagtggaagtcaaccctccgctggacagaagagggcacgcaggcaacgaggtgccacgaagaaactagagggtcggcacatcataacggaagtggacgaagatggccgacctagtgccccagcggaagcagccaagaactacgtacgacacagctattgggttgtgcgggataacgtgcctgtcagtatggtgtactggcgcagaacaagggcacgcggagatcatgagagctttgtcccagattcggagaaagagatgctgtggaccacaatgctcgagacattcacccttcccgcgggtacagaggacaaagtgaaaaggtggactctaaagaaaatggcagaactgtttcagagcttcaagggagatctgtaccagaaatatatcctgaaggggcagacaccgaacttcgacacattcccaaagctaagggatcactaggacgagttcgttgcatataagacaggtcaacaagggtaggcgatgatggaaagaaacaaagaaaatgccgccaagaagaagtaccatcaccacttggggtcaggcggctatagcgtcgctatgccgaagtgggaggagatggaggcaagcttgcttgagaggggtatcgaactggccaccgctaaatggctggatcgatcgaagtgctggtactatgctcacggtggaatgctcaacccagttgatggctccctggtcttcagcgatcagatacgcgaggctacgcatcgactaacggacgcagtggaagcctcttcggggggcacgttccgacccgacagagagaaggacgagctgtcactcgccctgcagactccagagcatccaggacaaacaagagggaaaggagtgattccttggaagattggattcaaggaggacatccacacgtacaggagtcagatgaggagcaagagagataccgaggcgaagattgtagatcttgagtacagggtatcgagctacgagctaagcatgcaagaggaggcggcaaggaaggttggtgaacacatggccgcacatcggtcccatgatccccagccgaccattcctcctgcaatggtgagcccttcaggcaatcgtagcagctgcgcctccacggggcaggtaggatcacagagcatggacgccatgcaaacccaggacgaaatcacctgccccgttgatgacatcactcagcggacaccatgtgagctgcatattcccttcaagaacttatcaataaaggtaagctcgtagtttatagattttagatttgtccattccgcaagttgctgcttatatatgttgattactaataaataacctctcaccacgtgaaggtggcgtcgggcatggccatcccgacggacccttcaggtacttaccactgcaggccgattccagcaggatactccaaggtcgaagttgagttggtggaaggtgcgtacgaggacctcgagttggattaccctggaggagacggtgagtcgcatctacgagacacaagccacgccattatactatggcgcaagcggtatatcatcctccctggctgacaagcagcgtctcgtgcaccatctcctccggctccaccatctcctcctccgactccgccatctcctcctcaggctcctgcaccgtctcctcctcatgctccagcaccgtctccacctcaggctcctacaccaactcctcctcaggctcctacaccaactcctcctcaggctcctacaccaactcctccgcaagctcctcatccggtaccttccaagtcaagggccccccaagctccaccgcatgcccccacaagggcaacgaagaaggcgaaagttgacgccacaaaaaacaaggacccggggtacgattgcatgcaagaggagcttgacgcttatgtggcatcataagtcaggagacaattgaagcctcgaagtccagaaaagaagattcctatagacccgagtgccaggaactttttcaggggtatgtctgcacctaccaaggaggccataaagctatcggactatgagcaaaccagtccctcagcttggagaggaaccaaaccaagagatcgagccgttggtgaccggtgaagattttggaatacaagaatttattaatgacaccgggctaactatggatcaattgctacgaggcgcaccaatcgaaaaggcggaagtgaaatacatgtacgaactcggtaaaccgcttgtcaagcctgagcagctgcagtccctacccagacaaatatacaagttccatcaactgtacatggagatgagcgccaccggtagagagatgatcggagcgaggatcagggacacggacttcttgcaaggagatgacattctcttgatcaatttcaagggtatctacgaactataccagctggacgccctcgacgtctctattatgagttgctagattttgtaagtatcgttcagttagatttcttattacgtttcctttaattaaataggtccttgtatataagtagactatatataatatatacttccttttatcgttgtagaatggagattcaaagggcccgacggcgggggggttttgatactggattcattgaccctcggaaagtaaacgtcgcaatgctcgaccagtatccgcaagccacagaggacaatctcgtccatctcttgaaggcgcagcattacaagacgttcatactattgccgtacaacacagagttagtttttactgtcttcctataccaaatatcattcccgcacgaacatgctaagtgtttcatatgtaatgcatcccacgcacattgcagattccactgggtccttttactcttcgacctagaggcctgcaccgtcaacgtatatgactcaatagataaaaaagtctacgtttgacaatgttttcgaacttatagacaggtactgtcataagttcctatgttaattaagaatcttgttataattaattgctactatgaatcatagctttaaactgcatgtagggcttggtatcggttccgtcatttggtccgcggcaaatggagagaaagacttaggcagaagttcaattttcctgtgagtacacatgctctacatttatattcaatctccaattcaaatacatacaagtgtatattaattagatctcttgccgtttgtcatttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattgcgtacatatcgatttgtttttaattactaattaatttcatacattcatatagtttattcgtatgagggataacctgatcacacacaaggaatttatcgcggcggttaaagaacaactcatgggattcatcaacgaataaatccttgatcccaagggtgaattctactacgacggaaatacaattcattggtccttagcttctgagataacgactacgactactactacgtcgaaatcgtagctagctaggacatcataatggattgtaattaatacatgtctatttttctatatgcatatacacattttctttaatgtaaatatatattttggtcatatatatatataaaccatgcagcaacaaggccatgcaaacaaaaaggtcagctcgatctttagtcccggttatttcacccgggactaaagatagcgatctttagtcccggattggtagtcccggtttgaaaaccgggactaaagggggttacgaaccgggactacaaacgctttctccatcagtgctatccgccaatgaggtgcctgccctgccaactacttaggagtgtgccagcattctacatggttgtcgcctccatgatcacttagcaggtcagtttcaacactcggcctctctcccttttcccttcccacgttcttatggtgctctttgttctcatgtgtgtgttgcaaaaagatttgctcgatagaatgcttattcgatgtaatatcgttcattgcaatttttagatttttatgttcattactactgcatggcttgatttggaagacaactactgtgaagagcatcagaagtggcaatgacaacaagctatggtgtattatcccagaaatattgccatgtctgcgtgttgtatcttctcacacttatcttactttcatctggtgtaagcaagcactatgtttcttcacttatctgtttattatgtttctttcaatcagtttttaatggcaaagttcttctttgcgagaaattgctttgtaatctgtagtgtgcgttgttctgtaaggaatcatcagtggatcacaatccagttgtatatattacaataatagtattgaggatttgatgtataaattgtttagaccatgaacattaagatgaaaaaattaatttgtgtcccatgatgaatccaaaattttgtatttagttattttgatcacttatatttacattaaccaacatatagtcccataagctttagatggtatttttattaccacgattaatatgggttgtgcataataaaaatatttcatcttgcaatatggcaagtttggtttatattagttaaagaaaatatgtccgatttaattgatattggcttctacgtgcattgcacgtgcatgatcactagtaaattgaataagatataagtttagtttacaatttaattatatcatgcaagggtaattacaagaaaatcataaccagcattcaaagcacattaaataagttcaatttagcttaggatatagcacaagaataaatcaaaaatcatcagtacatggacattcataataaaatttcacgcacattaagaggatgtttggttgagtgccaacctttgctaatgttgtggcaatcaagtttgaccaattaagcttagtgtttggttcatgccacaagtgagttatgccacaatttttcagtaagctggcccacttgtcattgagtggttttttttgccataacttaccacaattgtggctaataaattcttttttttaaacaacccgcacaagatagtgtgacgtttctattaataaaaaaggaataaagtacaagcctatagtcctgggagactatagttaggaaaaagaaaatatacaaccacaccacgcgtctacgactgatcctactgcttaaacaaaacatgcacacaacaccccaaagcaataggacttctaaacgacgcctccaagaaggaaaacgacgccaaaagcgccgccgccgtccgtgctagataaccaagacaaggttttgacatgaagaacccactgggaaacaatagaaaacacggcaacgccccaaggggaaaacgacgcctacaggcgtcgccgttgccagcccaaaggctaggcctttgcctgttgttctactctccacgttaaacagtgcttgccattttagcagaaccaccatctaatccccttcgacgtgcagccactgcgccgacgcctcgccgagggccaggcatcaaacaagagtctccaccttcaccgtgcttcacgtccatccacgtggttgggttggagagggagagggtgagagagaagaatggatcccctctcccccgcactcgcccgtctagcgtggccatcttacggcggcaagccgccaccgcaagagggcagacgcctggaaggaagctcgccgcaggcttcaacacccctgtcgacgtttgatgtcgcgattccggtatttgcatagtatggggatcgttggtaccagggtatatgcgagattgtaataaaagagatggggacgaggatttttatacaggttcaggcccctgaattgtcaggtaatgaccctactcctgttggccgaagccggtcgttgctcttattcatcataatcacaccagtacaatatttagggtagcctatctatttgttgtcgacttggcgttctgaagtgttgactcgtagtcgacaacagggtagccttcctcttcgaatccgcatccggcgagatcaaaggcagtgcttttgtctctcctgacagtatctgtagacaccataggggactagccatgcttatctctgaagtcgatatccggcgtcttgtcttggcgtatgttggcttgtatgttgatcttgtgtcttgatctattgttccgtgtcccctctcctcctagggggccttgtatttatacccatagatgtccccttgtccaagtagaacttggaaaaccaatatggatacaatccttgtcgtttccatgtagaacactattcatccttccttatgcggaactcctcctatatctaaaggttgtttctatataagacatgctatgtggtgggtcctgccaagatttagtcaactactattaggtatatggtatccataaccctgacaaccccccgcacagcatgaccgtcgtcgctgcctcgactagaccacccgtgttccaacgggtgcttggtcgcatcatcgtcgcctccgtcctcctcaccgcagccatcgcctcaccgttaccaccgccgacgggcttcaccaccgcccccggccgctccgtcgcgccgtgcagccgtctcctgtcgccagctgtgccacgtcaccctgcgccatcatcggccaagcctccgctatggccgccactgcggcctcccgcgcgcgccggcctccgcagctcccggccgcatcaccaaccacggcctccacgagcgccggcctccaaccgtgcctccccgcgcgccatcctcctcagcctccgccaccgtggcctcgccatcaccactgcgtcctccacatgtgccggcctccttcaccggcggccgccagccgccagccgccaccgccaccttcggctcccatcgtcgtcgcccgagggcttgctccggccagatccgtcatggaggcaccggatccaaccgcggggaggccagatccagccgcggcggcgccggatctgccgtctccaccgtctccacgccgcgtcgtcaacctttcctccacgcgtcggcccgccatccacgcgcggagacggggcgccgtcgggggttggcctcgccgccgccatcccggctggccgcacggttctccggcggcgcgctccgacggcggcgaggggagggagagaaggagagagtggtggcggcgacgctagggtttcccctgtgtcgcccgcgtgtgggcgacgcgggggcgagagaatcctggttgccgctaacaaattcttagccatacaatgtgtgccatgccacactttgacaaatattttggcctaccttcctactttctccgtcccaaaatgtagacattttttaggttgagacggatttaaaaaaagtaggtgagaatgattggatgaagtatattattggttgaaaagagaaggtaggtgaagaagaatggttgtgattgattaaaagaagaaggtaggtgaagaaatagctttattttaagactaggtactatgcttgaaatagtatattttaggatggagacagtagttaattgtgacagctaaaaaaacacagtagcgaggtttagattctcgcccttttctttattcgacggtacgcacgttaattttggtttgcttgacgtggtgttcaacagcacgttgccgtgacttggatagcaaaacagaacgctacggtgccccggctaggggagtaaagaaagggtggaagaaagatactcgagcaatcagcgataccattccaaatgctagatgacaaatctccctttgcaggctcgcgcagcgtcattctcggagtcatcgcttccgtccttctgacccatcgcctgctttgggaaaccaaccttttactactctcacttcacctgctatctgaagtatcgaaccccttttctttcattcctgtcctacgcagctctcccttggacctttgccgccacaaccaactactgagagcaagtttaatggctataaactgaaatataaccttatacgaaggaaagaaaatttaagaaaataaaaaggttggctctcatgtctaatagctaactattcacatactttaaaatcaaaacattaaatgtataggtgagagataaagataataagaaaaatagagataatcttataacttatctactatacatgttaactctaatatacatgttaactctaatattagttataagcttataattgactctattactaaactggctctaatataagttataagttcatagttgactctattattattactctcagagtgaagtaatgtggtcgtttttacagtgtggtacttgttgagatctagacgcagcggcggagacagcgtgggggcttgggggaggggtctttagaccccctaccgtaccattagagccccccataataccccctaaaattataatccatatatttatactttgtattaaaaatatagctaatttatatgagacatgtattagtttttattgaccactttgtttaaccctgctataattttattctagacgtacctacacggaggcaaacaacgttccatttaccaaaaaaaaataagtgaatataaaatcttggaacacaaattgcttttcacaagttaatgcacgtacgctaattggggcagctgtctatcgatgcaacaatcgcattttacagtgccaacatcatttctcttcatcttcagcgagcagctgggattgcaatctgcaattgctagcgtctggtttgaagtttgaacttcttaaaactcagcgaacagctaggaatacaacttgcaaagtttcaagtttgaacatttcgctccgacgatgaaagaatgcagtgcagcctctttgaggtggttgggcaaacgcgagcacccaaacaattcgaggagccagcgtcattaaagtcagtgaggacatgagcgaggcagccaaaccctccccatcttccgcggttggcctttggccggggctgacgccaagccacgctgccgggccaaaacggctgccaccgatcgatggcgacgaacggaagcggccaagaaccgctcgcgcgaaccgcgcctcagccgcgtactactaggagtattataacgggtggcctttttgccatccccacgcgcggcggccggatccggatggatctccccttgctttttgatccaacaacaagcaggagtattgttctgggtggggtggcgaccgcgggaacgccaaggctggcgtattgggcgttgtcaaccgtggtgcgtgatcgtggtatcggtggtgtgaggagagaaagtcaggagaccgccttgtcgtggcgctctcccgtctcgacgtacttcgggagagcacgagcttggggttggacgcggacgacgacttttcagcggggaattaacaagaaggaattcgaactgaaatattcgctatatgaatatgggttaggtgagatgaaagttgggtttctcttaccgaaagttgggtttcccttaccgtcggtggtggggttaccgcgccttgacaataagcacaggtacaacagtaactgtgacaaaccgtaagattccgtataaaatttatcaaaatttttaaaatttatttaattttatagttaccatgattttaccttttatcttacctagtggtaaactcaattaccacgaaacatgcgtagttaccggattttataaagcctgaatggaaggtgcaaaacggaccgatgatattttagaaggtttgttggaccaatgaagtcttcttaggccctgtttaaattctaacttttttcttcaactttcaacttttccgtcacatcgaactttcctacacacaaattttcaattttttcaattttttcactacatcgttctagttttttcaaacttctaattttaacgtggaactatatgatacgttgaattttacaaggcagttgtttttcatccggaatataattaagagaaatccatgcgtaggccatgtagtatcatatactcctacgtcccgtgtggtggtccagatgagtgtgtgctcagatagtcgcactgaccagagtctgccgtccagggcgatggttccattggaccaccggcgagtcccgcttgaccgccacggcgccacccatgaagttcgcctcacagtcacacgcgctcagacaagcatcctaccactactagtcgctatactccagactagtgccaccgccacggcgcccgcggcttgctccgtcctcgtggatgttaaaaaaataccccttgcagccgtccggggctcccgtcgcatgcacccccagccacagctacaggccacagccaggcaggcagcgaagccagcgacacgcctccgccttcgccgcggcccgtaccccccgccccacgctgcttctcccaccacctgcctcctctcctccttcctgctcctgcctcctcaaccccacttcacctcaccctcctcccgcgcgcggtcacggactagccgcacgccacgccgccaccactagctcgcttcatttccaccgcacgcacgcacgcacgtacgcgcgccgcgccggctccctcccgccacaggtacgcgcggggtaccggcggtgtgtgtgcgtgtacgtgcgcgtccggcggctcgcacgcgtcgtccgtccgttgatgaggcccgcgcgccggggctggggagtgggtgccttggcgcgggcgttcctggttctgctgctgctgctgctggccgcggcaacgacgacgacgatcggcttcggctgccgaggcgcggaggccatccgcgtcatcccgccgcacgggccggcgccaggcagtgcgaggagtagccggggccacggccatcgccgaagccatggcaacgctgcccgggtggtggatgctgcaatgccggtggtggggacgaggccggtgcccgcgctgtcgccggcggcggacgaggagagcaagcgccggatcccgagctgcccggatccgctccacaaccggtgaccccctgacgcattgaccaccatgctctggcacatgtgctcgccacgctgctcctgcatggatcgatcaacccttttgtctttcttgcctgcttaatcctctcaacttctcttcttttgttttctcaacttctctgtaattagtaggcagccagctagatagggctttgtattggaagaatctcccaatccattcctcctcctagcggtaagaggggatcgagattcttggcatacaaagccctatcatgcctcaccactttatttatgatcgatgatgatgagaaatcaatgaaaaaagaatgcaaagatctatcagattcagaaaaaggctacttccaacggaagaagaatcagttgtcgtattgaccgtctcagttcatccacgaaccactccagtgcaaagcacaaccttttcacagatgcgacagccttccatgatccctttttcttcagatacaactcccattttttctgtttgttcttctgccttgtaccacctgccggctttgcttcttgatcgatgttgctgtagtaggtgtgttcgatcgctgctgtgcactgcagggctgactgctgctttgctggtgggagttgcggctccctcgacacggcattaaatgcgcacgtcttccgtgtggccggaaagagtcgagagcgccgtgctgcgacgcgacggcgagtgatggatgggacgggtggcgatggacaggcggatggaccgatgggggcgcgtcacgccgtcccgccggggccggcctctccgtttacctgcccaattttcgctggacagccgggggttttcatgtgcacggcccacggtgtgacccggtctgactctccgtcgtcagcgaccaccgaccatatgcgcggcgcagtgccagtgagtgtgttcacgtttgagttgtgtgctgtgtttgatcggtttgcttccgtcacgctgttgaggttgaggaggggtcgcgttgcagcttgcacgctagctagtcaggtgctttggcgggggcaatgatgtctcatggccatgtgggtatccaggcagggttggtggtagcagcggcagattagcagctgtagtagcacagaagagggaggagggggaaggaagatatggggcatgtttggaaaaccagtttacaagaatttgaaaatgttggatttctcggggcttattcgtttcaaaggaattgcaaaagaaaaaacataggaatagggataggttttaaactaccattcgtttcatagaaatgcaccatagaaaaactataggaaagttttccattcatttatttttgaaggaaaagcataggaaaaaataatcctaaagatgaagatgaagataaaagattaagtgtttcacgcaaaacgaggtggtaataacgtgtgattaattgagttttaatttttacaaacttgaaaaatggattaatcttatattttagaacaactttcatatagaaagttttcacacgaaatgtaccgtttagtagtttgaaaagtgtgtcacgagtgtccaaaagtttatccaactttagttagagaaaagaacagggctgtcactaatgtttgcattccgttggttggcttgctcaataacataggaaaaattcctgtgtttttcaatccataggtttgcacatgtattcctgtactattcctacgttttttttattcctacgtttcgaaaatcctgtgaactgaacgagccctcagcttttggcttttagtttattttttggattctaaattataagaagcaactggttggtaactagtttaggccccgtttagttcccctaaaattttcttaaaaacatcacatcgaatctttgagcacatgcatgaagcattaaatatagataaataaaaaaactaattgcacagttataagggaaatcgcgagacgaatcttttgagtctaattagtccatgattagccataagtgctaccgtaacccacatgtgctaatgacggattaattaggctcaaaagattcgtctcgcagtttccaggcaagttatgaaattagttttttcattcgtgtcaaaaaaaaccctcccgacatccggtcaaacatccgatgtgacatctaaaatttttcttttcgcgaactaaacatgcccttataagaatctgaaaaagttggatttctcagcttttggtttttactccgtggtttattaagctagagtgtttggggaacctctgattcctaaggaaactgtagcagtcagaagccctcctaaacaagcccttgatcagtctctacgtcctattttaacgatgagattttactgcaaaggaggacgtgagaatttcacacaaactttctccatgcatactgtacaatgattattaataaagaactcttaaactgtttaattataaatatttgctgacataaaagagagagaaaaaataaaatatcacagctatggttaaaaaatcaatatcgactcttagggtgtgttcgacagtgcagcatgggaactcatccctcctgcatgtaaaacggagcggccttttatcacgtgattaattaagtatttgtttttttaaaaaaatggatcagtatgatttttaatagcaactttcgtatagaagtttttttttgaaaaacgcaccgtttagtagttgaaaaaacgtgcgcgtggaaaacaagagacgtaggttgggaagatggagtgctgaacttagccttagcgtctatacaacataaatatagttgtatgagggtgaaaattaagaaataagaatagtagtgaaaaatattactctttgagttaataagttagattctttgttatcttaactattataaggaaacggtctttaaataatttgctattttctaaaagaccatactaagaatgtactgatcatgccataactagtgcaaacaataaatattgtcttatcttctcattttctattcgcacaaatggtcattattttggacagtgatgaagatatttccatttcatccaacgcaatgctagccttttggttttagtgtggaaactagtatctcccttatacacccatccaccaatcaaacgtactagatttacatttttggagaaaaagtttgaattgccctctgttttattggggtgagtatgaattatctttctagacgcgaaaataagatatatttcactctcaacttataataccagatgaaaaaaaactaattcaattcgaaatggttttgatactatgttagtagtccagtcaacatttttgtaataaaaaaaatgataggacccacctatcagattctctccttctcacctctctcttctccctcccctagcgcgccgattcggtggctgcagtgggcagcgaggtagcgacaagatggcgttaagcaatggaggctattggggccagtgaacggcggaggcggcactacacagcggtggggtagaggagctcgagtggtagaggcggatgggggcggtgagagatagaggtgggagagggggcggttcctccttggcctccgctggcgtgcgcctccttcttttgcctccgccggtgcacggctgccctccgtacaagctcgtgcaggcacaggggcaatcaaggatatattgagacaggggggaggggggaggtgagagagagaggagaaagtgagtagagagaatttgataggtgtgtcccattgattcttttctataaaaatgtgctggctatactatcacgtaggatcaaaaccgtatgcaaagttgctcgtggtttttcatccagtattaataactgatagtgaaagatgtttggttttcgtatttatggggtaattatattgtcccaataatttaggggcgtaatttagacttattttcttgcattctttatatttgaacaaaaaaatgttgcacaatgagctatatgtgttacaaccgctttgacctaagtttgcacggactatacaagttgtgatgttagagcaaacaaattcgcaactagcacacaattaagttcaggcgccacgaacataatttactcaaatttaaatctttaggctgtaaatccaggaagcgtgcaatcactatggtactgacgatgttactttcgccagattttccagtatggttaatcactgtaccggtggacaagtagcgctgatgaatgattctcactatagattcctagtaacagtagtttccactcgctatactattgggctcatgcgcaagcaactactaggggttattcaatgagttgaaaatccagttattctgactgcaaagtaacaactccattcttttttcgtgaacgcttcaaattagatacgctacagtatttttgctacagtgctgagaggaatcatatccttctacttgatatcatacagtactacagtgctagtaggatcgcttcggctcctttaggcccccctttgattcaaaggaaattcataggaattttaaaggatttcattcctaaaggattattttcctataaagacctttgaatcaaaggattgaatcatgtacaatcctataaaatttctatggaatgccttttctcatacaagttttggaggaaatttaacatgaggttctacctcatgttaagaattctttgagtctttatctctcctcaaattcctatttttttcatgtggctcaatcaaacagtcatttaatgactatatttttcctgtgttttgtaatcctatgtttcacacttgtactcctgttagaatcctatatttttcctattcctctattttttcattgctgtgatttaaaggggcccttagaggataccaattcataggaatcattccaacacatgttctttggaacaaaggattgtagcatacaaattccaaaggaatccattcctatatatacattccagggaaaaatatatgtttttctttttctaagggctcctttgaatcgtaggattgagaaaatgtaggaatagaaaaaacgcaggattttgagatgaatgtaagtgtaaaacagaggattgcaaaacacaggaaaaacacatgaatgaccgtttgattagaccgcaggaaaaacacaggaattagaggagagataaatactcaaatgaaaatttccatgaggtagaatagaacctcatgttaggtttcctacaaaactagtatggcattaggcattctttcgattcaaatggctatataggaaaaattcttataggaatgaaatacactaaaatttctatgaatttcctttgaatcaaatgggcctaaatttgcatgaaggtattagattcaattttttgtgcacaaatatatcgccgtcacagcacagagacagaagggccagttcgtaaatgacatcgcatctggacgagcggcaaactcgtgaggtacttcaccgtggcggcttgtgaaagtgagacgcggacgagttctcgttttttttaaacaagtttcgtattgatatagcaggaaaaatacaaaattacaaccctggggattctaaccaggaaaagaaaaaacaccaccacaaccacaagtttgtagctccttgcttaacccaggagaaggtgctagcaccgaactgaccacagctaagtgtgaccaaatgtcactatacctacaaaggggttgtaaacaccctgccaaagaccaactccacacagaagataatcgacgagcttccggttgtcctcacgtagaatggttgagttgaaggacagggtgagagaaaaggagatccactcgtccctcgctccaacctgatgatgaccaccaagcaactccgacgatcaaactgagagaatatggtaatggtgaggaccaaaagacctcctagacaatggctctaagaagttctcgtattggaaaagcgaactcgcaattgcatgacagtgtgatgccgcgtaattaacctgtgtaattaatataatttaaaggcaacatatttaattaactggtgtaattaatgtaattaaatttatctttctttgtttacaatttcgatattcacgacatcgtgtagcatcatccggactagttctagcagaaggaacaccaagttgacacggttcggacgagttcgcttcaggcatggtgcaagtttgtggccacatggtctaatttggataggaagaatgcgatcccgtggcctcataaaattactttgcttcttgtccatgaactcattgcaaattcgcggtgtccgcacatgatctgttgataatgtctagtttgcaccgttcttttgcaaactggttcttttgaaaaacttatttcgaaactaaaccgcgccaaaaatttcatccaaaaataagtcgcgggctcaacgccagggccgctggcactgaggttagtcaaccgccatggcactaagacggttaacctcagcctgcgtccggcttggacgctagttgacatagcggatgaccaggagcaagtggagaggcagaatgagtaaccacggtctagacgggacctgttcaagacagagtggtgagtatcctttgtatttacttatttccactttccgtacttcgtggttataacttcttctacatgcacgggagttggtcggatagtgaacgatgcgagcgtggcgctgggcacggtccctggctcgcaagaagagagcagcgttcttcgcaatgctctacatgtagatttctaaaattcacgcaccctgcacatatttggaactaacgcctacatccttctcttggtcgtagactctacgtcagcgatgcaggaagttggtggcacggctgggatgtagggccgacaatgccatcgaaccagctcgacgggccgaggaacaagagggtcaagagaaggaacaagagggagaggaggagggagatgatgaggaagaggaggaagaggagggggagggaagacgaggagcaagtggagctcgggccctcctagctataggacacaccacagttgtcgcagggggaggggcatctcgaccacagcgcaagagagcatctacttatgtgtggaggtacactcctaccagcctcatgctcctaggtgacttgtatggttgtgacttgtgtacccaaaacttgaacttgtatggttgtgacttgtgaacctatattttgcttatgtctatgaatgggttgtgatggatctgattgtggatggatgtggatgtgtatgcatgtggatgtgatggatgtgtatggattttggatggatgtttactccctccgtcctaaaaaaaggcaaaccctaggtttacgtgtccaactttgactgtccgtcttatatgaaatttttttataattcgtattttcattgttgttagatgataaaacatgattaatattttatgtgtgatttgtctttttattttttttcataattttttcaaataagacggacggtcaaacgttggacacggaaaccagggtttgtctttttttgggacggagggagtatgtttatgtgtgtggttgaattgatggatggatggatgtatatatgtacttgaatgaaggatgtatatatatggattgatgattactctgaattgatgaattgcggatgaaaactgggcagagagctggttgtgagctctctacctggggccatacctcagtgccagggaaaatggagctgagatgtatgacctcagtgccaatgctactggcattgagacctggccaggtccaacacaggagcagtgttggacgatgttgagcaactgacggctaagtctcaaacatcagcgccaaacataatggcattgagatcatggggttcaacgacatttcaattggtgccgagattagccaggttagcgccggcgggccacccaacataggagtggtgttggacagcccgggcgccagcggctaagtcctaaagctcagtgccattacggctggcgctgagctttggggttcaacgccaaacaaaatggcgttgagtacctgccatgtcagtgaggggagcgtcctcgactccacgtggataggggctcagtcccaatgtagctggcgcaggtatgttcaacctccacaccagctaccatggcgctgagccgacgacctatttttggttgaagtttttttgtacggtctagttttgaaatttataaatttttgaaaagggccaatttatcaaataaacggtagtttgcatgccgttcttgtgacgtctgcatattattgtgaaaaaaaaaatcaatattgatattttttgagaaaaagaaatgaacaatataattttaattttttttcatactgtcggtgttatgggcccggggtacctgggctaagggaaaggaagcctttccctgtgctacgtgcccgggtggcccagaccccccctcgggggattggacacttggccgataagtggccaaaaagcggccgtgtgtccccggggggttcggggtgcctcgtcatacccctcgggcccgaggggctgagtcatccccgaggccctagctcggccgccacgtggcagccacgtgggggctagaacgggcgggggcgctgtccgccagaggcatttatgggcagcgccccaaccgcccccatcgcatttaatgcgacgtggcaggtcgcgcgccgtccgccgatagacgtgcgccaggtgacctgctcttgaccggtctgcgacccggtgatggatggatgggacaggcggcagcgcacccacgcctcattttgtgtcagacggcgtgggggctggtatgccccgtcccatcatctgcagagaatagacatgcgggtcaatactccccacgcacgtgagcccacgaagtcaccaagaagttattagggaatgacaagggatgttcgccgtgtcaggtggaggacttcggtggggaccacccaagggcggccacacgaatcgcttccggcccaagccgtggaccacttttcaatctaggcatgtgtgggcccctctcccagaggagggcgtaggggcggtgcatgtggtatccccttcaactatgaaaggaggaccttgccctacgagcaaggggacgactcttgatatatcagatttgaggcataggctagcaaaaccctagtttgttcacctgggatcctagttctctgtaactgttcaaagatcaacgcacacacaggagtagggtgttacgctctatagtggcccgaacctggataacccctttaccttgatttcttcaccatccacctcgcaaaccaaatcactgcggatccgactcgcttgggtgagatttcgttcctaagcatcgcttccagtcccttggccgaactcatgaaggggggcctcacagcctcctgctagagaggatcactcctcaacacatacattccacaaggaaaggatcacatcagctcaaacctattgttatttgttctttgagaagtccaatgcaacttctctctttgtttgtcttctcactagaacggataccctcatctcaatcgagcggtaagccccatctcaatcgggcacggcgctcgtcacaggctagaagtcactgatgtgaaaagtaatctcaatcgggcaaatggtcgtcactgatgaacctatctcaatcgggctctaattgaagcccgtcatcgatagctttgacctagtctaccagttaaactatagcccgtcatagatgacctatctcaatcgggccacaaataaagcccgtcacagatgactactaacctcagtcgggcctaaactatagcatgtcacagatcacactcatcttaatcgggcctaaactacagcctgtcacagatgactgctggcctcaatcgggcctaaactagagcccgtcacagatgaccatcatctcaatcgggtatttagttatggcccatcacagataactataatccacaaaaaaaaataatttttgttttttggctagcctcaagcctttgctagccatgcccgctgcaaaaatgacagaaacaaacacagatatcaaatatccccagatccccagcatcacccattcatatacatatgcattcacatacatagacatcaatatatttcacacaaccacacattcacagtcatctcatatttcacatccattcacatatttcataatcattcaaatatttatcatatttcacctgcaaaactgagttaattggatcaaatatttatttagcaagtcttaacataaacatatgaaatatatacatagatataagcatcacagttacatcatcacagttacataataagtgttcatcattgcctaaacataaaagttcaacattgttcatcattttattttaagcctaaacattcctttgggttaattatttcgcggaagatgaagctggctatctcctcgcgaatctcctcaaagctagtaggcagagacatggtaattgtgccctacattgtcataattcgagattagttcatcgatcatatataagtactaaaatgtagttactctatcacaattgagaccaccgacctcaaaatcagccaaagtcttcaccttttctgtgtacagaaggcgcatgttgtggcacacatggaatcggcactggtcacctatttgttgcttcaccaggaagtcttttttgtggatgagggtgtcatgtcctgtcttcctgaggcctcctctttgcacatattgggcccgcgcttcatctatcgctagttgaattggggtccaatcatatgcgttcttatcaattctggagttcaggtagtgacatgtactccacttaggtgttatgaccagaaggatccaatgggcactgtggcattaatatagtgaaagttaattaagtactgaaggaatgtgtcatgctattgtgtatatttagataacacacttactattgattataggcgcacataatgtactccttgtctcggcggggccacaaggtgtcgtagatgtagttgacaattccttgacggttattctggagatttgtgacagtgaccacttgtggatcaaggaaggcaacttccggtgaattcttctgacaccattgccaacttaacctacacacaagataaacgatcttgtaagcgagttaaaccgattgttattaccagattgagttgggcgacaatacttacaaggagtagcacttaaggaggcttgtgtccaccgcttggagcctgtagaggtcgaatagatccttgaagtcgaccacgatataatttgttggaccaaggaatggctttccatcgtgctctccaaggatgtcgatagctttattcggcctcctggcgttagatttctccatgtagtatacgtgaaggtccttgcaagtggtgcccattgcggcaagcacgtcatctccaaccaatggtatgcctagttggaactcctgtggagcgacgtatttcttcttgacctctttgcccttagtctcttcctggcccttgcccagatctagcttccttggagctagaagcgaggcctgcacctttcctccccttcctctcccctttgcttcgggtttatcgatagtaattctctgaggggaagagtgtgccttcctgctcttcttcatcggtgggggttcatgaatcgccttgctgccggcctccgttcggtcctccccaaaatccatgtcatactgcaactgcacatcgtaagattatgcatgacgatcttgagcaggaggggttgaaggagcagatgcgggtctctttggtggacgaccgcctggtgcagtggttggcctcgctgtaacccttatctcaatgaggtccttgggccattggatgaaggtaccacgggcatttccaagtgagaggacctcgtcgttcggtggatacttcagtgggaacagctcgtattcaggcttcaccgagtcgacttgaacttttgcatagtcgcccctaagttgcgctccatgcactcttgtctctggggttggcttgtacgcaagtccctcggctgctggaaccgtgaaggtcggcatcaccctaactgtgagggtgcagctcgttggttcctgcgatagattcatcaatttttttagaatattatatatcatatggattcgttaagtttttcatgcattgtggacaaaacttttaccgttatgtggtcgacggcgctgtcgaccgatgttggattttccgccaactcagttgatgcacaactgctacgtttttgggtgggacttcctaactcttcgtgtacagcagcagcggcgccctaggggttctgttgctcttctcggatctcttgcctatcttggtcctcatcgactcgagcttttcgtcgaattcagatgtcagctccgctcttatcgatgcctggatcttggtttcaaggcgtgcatctttctccgccttgttggaagtccgcttcttgtactgccacgtatagtctggaaatccatacttccagggaacggaagacccaacgccccgtgttcgtccacggtgttccttgttgcccaacgttttcgtgaggaggtcgtcctcgcgtctttgagagcaggcctcttgcgaggcttgttgctcggcaaccaactccttctgcattacaatttagtgtggttaaataaattgcacgatgggaaacaatgcgaacatctattttgactagacacttactatagcatcgtacactcgttgatcttctggatttggcatgaagattgtgccatgagcattcttctggtacctggccctggccaagttccttgctcgagggtgtgggatatcgccaaacatgagcggcgtgttcgattcctccgcttgttcatcctcctgctgccattcctcttccttaccgacatatccggcggtgccaagccggtgcggatgctggttcttggtctggagcaagcgatatgcctcccttctagctctggactcgggggtcgacttcttcgcatggaattcctcccagacctattccgtgatccaaggaaatttctcttttggatctggattcgccgggttgtagacgaactcaccgactagcttagtcttgaagttcttccaagcattgcccataactttaaaaacagtctacctgatacggtcctcatgctccgtaggataatcgaagctctccttgaacgttagccaagcaatgtccttctctgcggccggcacatgcttgatgtcatcttgcagaatactaaatttctgcctccctatgaccctgcagatagacctaaatcggctcaatattttccttggagatgtcggcaaccctacttggtccaccgctgttatgcggaaccgttccttagggattttgttccttgtcctaggagtacgtgcccttgaggactcactagttgtcatcgacattggttcgccttgctgagacatcgtctactttttttcaaaataacgaaaatacacaattcagtgcttcaatggcttagaatccaaagttctaaaatcacttattcacgtaaataaactaaattgcacatctcacaaatctaataaactgaattgaatatcacatataaataaattaaacatttcatctattcatccacattcatctatgcataaacattcatctattcaaacacattcatctaatcatctattcatcacattcatcaatcgaaccacattcatctattcatcattcatgcgcgatggaggactcacctgggggtcggcgtcgggctcggtggaggcggcaggctcggtggtggtggcgtcgggctcagtagagggcgtcgccggggtcggtggtggctgcgccgagctcggtggaggcggcaggctcggtggcggcgtcgccggggtagatggtggctgcgctgggctcggtggaggcggcgtcgggcgtcggaggctcggtggaggcggcaggctcggtggcggcggcctcgagctcggcgagggaggagtcggcgaaggaggagttggcggcggcggatagtctcgatggcggcggcgccgggctcggtggagggcgtcgctggggttggtggaggcggcggcgtgctcggtggaggcggcgtcgggcgtcggagaggaggaggcgacgacgatgacgaaggatgtcgccaggcttggtgggggtcgtcggtgaggaggcggcggcggtccgaatggagggcggaggaggctcggtggcggcgggctcggtggcgacggcggcgggctcgacgatggaggacgacagcagcgctagggttctaaggaggcaggaaactgtagcgggacttagaaaaaaattcgatccgatatgagaaaccctagttatagtagagtgatgagtcatctcaattgggcattgccagagggcccatcagagatgactcatcggtgacgggctccatactaatgcccgattgagatgacactcaggcccatcacggatgactcatctgtgacgggccctaagataatgcccgatagagatagattaatctctatcggacttaaagtaaggcccgtcaccgatgactatttttctatttttcccatcaagtctatatttgtgagtgcaaaatatatagctgctatataataattcaatttgttagtcataatacattttcggatagtaaatgatttcaaatcgaaatatggtcaacaacaaaattgtagagcttatcaaggacaacttttattttggtcatttgactatataattttgttcccaacagcttgaaattgattttgaaaatatgacaaattaaaacagcatttgtaaatattaaatgatttcaaatgaaaaagtcaacaacaacaaagttgatcctctcatcatgatctacaacttttatttgggtcatttgtctctataactttgttcccaacagcctgaaattgaatttgaatatatgacaaatttatacaacatttgtaaatattaaatgatttcaaatggaaaagccataaacagcaaagttgtaaaacatatctaagatctacaacttttatgttggtcacttcttcatccgacaaagtgatagtaccaatgtttacaaaattgacatatctgtatcgatgtttataaaccagatgagagaaatgtgatttttgtgaataatataactgtcattttgtcggatgaagaagtgaccaaaataaaagttgtagatcttaataagttgtacaactttgctgtttatggattttccaattgaaatcatttaatatttacaaatgttgtttagatttgtcatatattaaaattcaatttcaaactatttggaaaaaagttatatagaagaatgactaaaataaaagttgtagatcttgatgagaggatcaactttgttgttgaccatatttccatttgaaatcatttagtatttacaaatgttgtttaaatttgtcatatattcaaattcaatttcaaactgtcaggaaaaaagttatatagaaaaatgtccaaaataaaagttgtagatcttgaaaggctctacaagtttgttgttgaccatatttacatttgaaatcatttactattggaaatatattatgactaataaaatgaattattacacagcagctatatattttgcactcacaaatacaaatacttgaaatggaaaaatggaaaaatagtcatcggtgacgggccttagtttaagcccgatagagattaatctatctctatcgggtattgccgtagggcccgtcacagatgactcatcggtgacgggctccatactaatgcc

SEQ ID NO: 41402 - DNA, 28546 bp, Oryza sativa
  unsure (1)..(28546): unsure at all n locations
ttgaatatatgaaaaatttaaacaacatttgtaaatactaaatgatttcaaatggaaaagccataaatagcaaagttgtagagcctttcaagatctacaacttttattttggtcacttttatgtataactatattcccaatagtttgaaattcaatttgaatgtttgacatatttaaacaacatttgtaataaaacaaaattagccatataaatgactacacatattaagtctttgtaataaaacaaaatacttcattcattacaatagatacgtacaaatgcatcggtcacaaggttatgccttccgtatgatctgaatgagcatatgccacacgctcttcgggatcatcgtcaaggtcaatatgaggtcttacatgaagattctggttgtattctttttcatcgacgaggttgtcaactcatacaattcggcgcttgccatacctcacgatgtgtatcttcttgtttgaagggtcttttatgtagaatatctgctcgaactgtttcgcatgtacaaatggttcatcggcgtatcccacccttgatagatctactaaagtgaaaccttccttgtcggctttgacaccagtgcgtagattcacccaatgacagcggaacaaaggaaccttgaacttgatgtagtttagctcccagatctcctcaatgcggctgtagtatgtgtttgacccaacttgatcctggaatgcatctatacggacgccgttgttttgcactgtgcttttgtcatcttgtttgacggtgtaaaatgtgtatccatttatatcgtatccttgccatgtgtctacagtccaagacggtcccatccccaacaactgtactgtttcatttgggacatccgtggacattgtcacacgattcttgaaccattcgttgaaccgagaattatgttctctgttaatccatgtatcagatcgccccaagttctcatcttagattttcactaagtgctcctcaaagtatgggccaacttctaccatatgttggagcacagtgtaatgagcctgcgcgtaggacgcttgatcgggcctaattcttttccttccgattgtgccaacacctgacaaccttccttcgtgacgagatgctggaactccgataggatcggcatcggacatgaaattgacgcagaactcaatagccttctcggtcgtgtaaccttcaatgatgctcccctcgggtttagctctgctacgaacgtaggacttcagaactcccatgtacctttcaagtggccacatttcccttagaaaagctgggccacatagttttgtttgcttcaccagatgaacagggagatgaaccatgatatcaaagaaagacagtgggaaaaacatctccaggtgacagagggtattcacaatatcggtctgcaacccatcaagatcttctggatctataaccttctgtccgattgcattgaagatggcgcacatgcgttggatcgtgtgacgcactttcggtggtagaatgcctctgatagcaactggcaagatttgtgtgattagcacgtggcaatcgtgagacttcattccaaccagttttagctcgtccaatttaacatacttggttatcctcgctgaatagcccgatggaactttaatatctttcaagcatgataacattgcgattttctcatccttcgacaatgtgtggcaggctagagggaggtacactctttttgtctctacatctcgtatgggctggagttcactgcgaatattcatgtcctgtagatcaaggcgcgcgtttaacccgtccattgtcttcccgtgaatattcaacatcaggccaaccaaactctcacacacattcttttctacatgcatgagatcaatgcaatgacggacatcaaaatctttccagtaaggtagccgccaaaatatggattttttcttccacatacccttctcctttgtcttgctacgttttcttttcttcccaaactcattacttatgtccttgaccatattgtggacctcatctccggacaaatcctttggagcaggttgaagttatctcttaccgttaagaaaattcttctttcttctaaatgcgcgacgtagcgggagccacctccgatgacccatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttttttccaaagaatctcaagatcatcgataacaggttccaggaatacatcgatatcattgccgggttgcctcggaccttggattaacaagcacaacataatatatttccgtttaaagcataaccatggcgggaggttatagttcgcagtaagaaccggccaagtgttgtgagtactactcatgtcactgaaaggattcatgccatccgtacacagacatatccttatgtttctagggtcggcagcaaattctttgtatttttgatcgatattcctccattcaatcgaatccgctgggtgtttaagcataccgtcattccttctctccgtggcgtgccaacgtactaacttcgcttcgtttgggttggcgaagattctcttgaaacgatcaattataggtagataccacacaatctttgccggaccacccctctttgacttctttccttcgtcaacacttttctttcgcttgtatcgagaagccttgcagacaggacaagcatccaagtccgcatattgcttgtggtacaatatgcagttgtttggacaagcgtgaattctacagacctctatataaccccagtggacacagaacctgctttgcttcgtatgtcgtctcgggcaatgtgttctcagtaggaagcatagccttccaaattcctaaaagatctatgaaactcttgtctgtccatctactacttgccttcaacttcattaggtccaaggtaactgacaacttagtgtgctttgctttgcatccagcgtacagaggcgtctcagaatcactgaccaacctgctgaacttcatggaatctctctcattctgggctgggtcctcaacgtcacgtaacatgtcttgcagcagatcgtgatccacatcaaccatttcaccgcccaatggagaaggtataaacatgtcatgctcatcttcatcttcctgattatgtgcaccacttctgtctgctgctgctccacttcctgattcttactctccatgcttcacccaacatgtatagcccttcatgaatcctcgttttatcagatgatcgtgaacatcctctgcgctatcaaacatattctcattcttgcaatctgcacatggagaacacatgtaattgctgtttcttcttttcctatcctcctccgcggcgttcataaaatttattacgccatttctgtattccagaaaatgacgtttcatatttttcgcatacatccaacttcgattaattgctacaaaataaaaaaaacaaattagaggtacatcttataagatcagtattgctaaagtaagacgtgatgaaattgctcaattaatgattaatattactcacttgattgctccattttaatcacttttgggaattttctgttttccttgcaaaaaagacaaagaaccaccccctataccctcccaccaaaatagtgaacaatgggatatagttacactaggttgtggggggtatttatactatgcaacaaatatctgtaacggccctaaaacaatcaaccatgacgggcatacaagtaatctctaccgggccttaattaaagcccataaaaaaagagtgtcatctgtgacgggcattaaacttatctcaatcaggcctctagttggagcccgtcacagatgaccctcatctgtgacgggcttcttttagggcccgattgagatatggcacccttatctcaatcgggcctcaactatggcccgtcacagataagtgtcatctgtgacgggctctagttttatgccgatctaccatggctatgcgaccatatctcaattgggcgaaactttgacccgattgagattacttccttgtgacggcccacaaattctagtcttgctaggggccgtcacagatggaaggatcggtactagtgtctctctctaaaatccatccaaattcatttgttgttttccttagagccatccaaacacattattttttgaattcgcgtgtttagatttgcatgggattcgtacctacctttcgtccaataaaaaatgaatgtaggactagatgtgacatatcctagtacaatgaatccggacagaggtatgtccaaatttgttgcactaggatgtgtcccattaagtactaggttggttttttatgggacgaagggagtatatgatatcctaatccaacgtttttcctgtttccatatttctaaaatcctgtgttccaaaggtgtccttaacttagcaactgcacaaaagtcgaattccaaatttagtcttgtttgggaaaacagatgaagaaaaacattggaaaaaaatctatttaataggaaagtatggcaactcatgggctgagcctcttcttatttttcatttgagaattccaatgcaactactctatttgtctttcttctctcgttcaaaaatctatccgaatttgtttgttatttttccatgagcaatccaaacacatcatctttcgaattcccatgttggattcgtacttacgtgacagtctaatgatgtttttttttcactattcctatatttctaaaatctgtgttctaaagaagccatacaactcaatattagccatcagtttcattggagaacttctattaggcctcctttgaaacaaaggaaaaatgtaggaattccaaagaatttatactctacaggatataatcctatgaaatcttttgaaacaaaggattgattcttaccaattcctttgaaattcatatggaatggactattgtaaagtaatttttgaggaaaataagcatgaggtcttacctcatgttttgttcttcttgtgtgttgaaatcttacgtttttttttcctgtcactatcaaatagtagttttaaaactttcatctgttttcgaatcccttaggtatccaataaatatgatattctatttctacttttttcctattcctgtgtcagtgaatatgatattctatttttatgatttttttttctattatcatgttttgacaattctgcatttcaaagggcacttagccttcacctcgtttctattttgctttgaaccacaagaaagtggaaattttggttgagcaacttgctttcctccattccgaagtccaaacacctccatatgaggagtgaaaaataaaatcttttatagatcgttgcagtaactatgtcccaattaatgtctcgtgtagccagccgtgaaaacttttgtcaccaaagtaaagtggcaatatttatctttgcaaatgattatacatctgtaggtaacatatatgtttaccaagtaaaaaaaacataaatattagggaagtgcctaatatcaaataaataaaaggggtgaggctttgaatctaggccgactaggccatcatattgtggagctcctaagcgtttctcatatggtcgctaaggaaaattttgataatttgacacttttttcgttgcccaattgttttaattgatatttgtgaggatgacatgtgaaaccatctaagtaaatgaaagtgggtcatgatgtcgaataatcgaaacacatttaaaagagtgttaaactatcaaatctcttgccaaccatgcttaaccaattatagacacacccaaatccctaattacctatgcaattgattaccactcgtataaacatatatctaccgtgcttgtctcggttgagtagaaaaagaaatatatatctacagtgcagtgctatgtacagttcctcaattcaatgtactatcgaatccaagtcttcaagcgctcgcggcgatccggcgcctccgccgaccatggtcgagacagcagaaagtttcaacccaaacaagagacggcgcggcgcagggctcgccagggtggtggccgttcgcccgtggtcttgcccatgcgtcggcgagcgtgaagcagtcggtcggagtcgggagagccttgccgaagaggggatcgcggatcacggggttctccgggcgctcaggaggagggccagtgaacagaggagcattcttcttggacattggttcgaccatctgcagaaagtccaaatgcttcatgggtcagctccgtttatcagcattgagattcgttaatcagacaaaatcatatcaatattgtagagatcctgccacaatattcatctatagataaaaagggaaatttaaaaagtcatttgaattttgaaaattacaccccataaatcattttgttgtaaatataaatgcgcaccctctagccagttcgattgcaaaaatcatctcaatacgcgcgtgcttaactgaatcaatatatttatcaatgtaatatttaacaaaactaaataccttaggagtatagtcttaacacttttctttgagatttcacaaataaaaatgctgatgagaatttaaacattatcgcactgagattcgcgttaattagaattcaatgaaacatgaagaataaatctaatgtaagcacttggataagattgacttagctatcttagtggtcatgcacatgtatattgggatgattttttgcataaaatgaggggatgtgtatttgcaacaatatactccctgcatctatttttgatagttatatttctaaatctgaaaaatttatttttgttaggcatatttcaattcaacaacatatactcttaatgactttctcggatttaatgcatggctctctattctttcacacaagattgactacatgggcatcgagaaaggtaaatattaatgaatcggttgtttacgaggaatgactagcagtatgtttaaatgaatgataagtagaattacttatctttgatctgtgtaccaagatgaaatatgagtatcaaaaggactcatagggtgaagcaatttcagtacttccgagacaaaagatcatgaatgtgcaggcaacaacaaataggtccccaactaaacattatacccatgactcaaatatattggttgtagctctgttgagtcaaggccgggatatagattccattatctaaaaaaaataactcaaatatatactaacgtgttttggaaaagcctatacagcaccaaagaggagctagcgttaattagttttagatttgacaaaacctatcgtacgttccaaaattttattctgaagataaatcgtacgtttcatcatagtgctgcagttcctcctgtcccaagagttaatggccaaatgtaccgatttctgaagccatattatgtactgtgcacgcgacgaatgcatgaaaacagagaacagaagaatgaatagtagcaaatgcgtagcagaactgcagtatggcgaggcgaatccagaaggatcagaaactggaacagcggcagcacgtacctcgtgtaccaggtcgccctgttcagcgtcagataccacgcccccatccccgcgagagacggccaaggacggcggctggtggggtgtgggccggagtagcagcaccggcggcggctgggacgacgatccttctgcttccatcgaaaagcttctcgcaatgcaacgcgaactgcagcgtgcgtcgtcgccggccgggtcggtttgcggtggccggcggtgatggcgtgtagggaggaggagtactcgcatatggcgcggggtgggggaattctggaaacccgcggtgaatttatggttatgacgagagagatagaggcaagtaacggttggtttggaaagtcgaaaccgaggggtagggaatccgccattgaaggagtctccacgtcggtgtgtacatggccagttgtccgtccacgcccgagattccctctgcctcttcgactgcgaggatgtgtacggcgtcgtccgtgtgttgcgctgcggagggaatcagatcgggggcttcattagattgcgctctaattatagcagtggagcatgcgggaagatgccccctgccgcagaaaatctgcatgcgggtaggtcaacacgttggatgcttggagtccaaataattactcggtatgtctcaaaatataagtattttttggctgtgaatctgaacaactgtgtattcaaatttataactaaaagttattatattttagaatagaagtagtaattagcaactatttgcacgctcctccccacgcagcgcgcggcggatcgagccatgtgactcgcgcggagagggccgtcttcggaacggtgcgtgtgcctccgtttttttcctgtttatttttctggttcttttctttttttatgtacgtttgtacacgntacttatacataaaaatatatacacatctcttctctatctctactattactagccatctaatttggtaaaaaaaatatttgtttttagagaaataatctgctatatatttgtggaatatacatgatgtttagtttggatgatttgtagcatgggaggaaatgaatggacgaacaatgcatgtgcataaaaaatagattatttatttatatctaatatatggattgacaagatcatcttgtgatatatttgccaaaaccttttagtacctgatgtgacaacaattttttgggtgagcctgtatataaataatagaaatttaatacaaattattcctattttttaattttttgttgaatacaaaaaaattaaacaataaaaataaaaaatgaaagattatatttagagttcatatagaaatgaaatttagaaataatataaattataaattatattggatgaagtctagaatattctccaaaagaggctagagtgcatataggaatacaatttagaaaaagaattgaaatttgaaataaaaaataatatttttttgaaagaaaaataaaaatggatattgaaaggagagtttacagtccatataaaaatacaattaaataataaaaataaatccatatcaagagatacatttaacaaaatttctcactacttcaatttagatagaaataaattaataaacagtcataaacaatttaaatgatattaatgctatttgtgaaaattaaaaaaaacttaaaatcaataagagagaaaaaactgatttaagcccgacccaatagagcggccttatgtgcttcacacatgcggtcggcccatgggatggcccaatagcgcagcagcctaaaacgtcgctcggcccgacgtgggagaagcatggactgtccgatctgatggacagtctcgattggtcctgacctagataaatacccgcaaccctaaccctaaccttaaaatatctctctcgataccctaacgcgctctctctccctttctctcttgtaaagtgacggtggcggcagcgactattccaacgggtggtgacggcagcggccttccccaccgagcagcggcgacgacgctcttttgccccgcaagcaggaagtggtgccctaccctcttgcaagtggcggcggtggtgacaccgctccctctccccaccactggctccttctctcctcatcgggcaatggccgccgccccgctcctcgccagatccggcgggtcgacggctctccaacagcacggcggctcgggatctagctccttcctctccttctcagcatccagcggaacgacgggttggtagctcctcggcggcgcgattgcacagcggatcccccgagttcgcgacctccactacagcgaggtggcgaggagcagcacacgacggcctcatctcatgttaatattttgaatgttctttgatttgtattgtgatgatttgagcatcattataggtgcccctttttttataaaaaatagcacctataaaaccgacacctataaaatcgagccgagctagccagggagatatttttttctcccgtggggcccacacccacaccggcaggaggggataaggccgtgctccattcctctctcggctcctcccctcatttctcccccactctctctctcccccacttctccctctctctctctcctctgtgcggcggtggcgggaggagcggcggtggcgacggacgacatggaggtggttgcggcccggctggggcgggaggggcggcggcccggatggcgtgggggcaaccggccggacctcgccttcgctagatctggtggtgtggaggtggctgtggcccggcgggggtaggaggggcggcggcccggacggcgtgggggcggcctggtggacctctgctccgccagatctggcggtgtggaggcggttgcggcccggcgggggcgggaggggcggcagctaggacggcgtggaggcggccggccggacctcgcctccaccagatccagctgtcgacgggggatacccgtagaccggatatagagggtattgtggtacgttggaacgaggatctacgtaatacgacatcaagcaaacaaaagataaggattatactggttcagaccccttggtaagtaatagccttaatctagttggtatgggattatatgatggaaaccacagattacaaagggaataatggaacttggcgataacgacgagatcgtagtcgagttggttcgactagatcacccggcgacttggctcctgtaggctccggcttcgtaggctgtggtggatgtgttggcggtgagattcgatgccctaggtcctgcccgggggatcccttttataccacgggtcagttgatctccaagtaggactcggagatattagacccctcacgatatggtaacgacccagtcttgtccaagtaggactccttccatctgtggactccgcttctgtcagatgatagatttccttaacgtatacaggaagtatctgtatatgcgtgggtataccgtatcagcatacaacgtatatatatccaaggatagagggtatacctgttgatgaaaaacatgaggcatgggagatctgcttaactccagtgcaggtccaaaactcgccttcgggtatgctagcgtgccagttgatttgatcctacaatcaacaagaaacaaagacaaggaaccacttcatctgatttgatcctacaatcaacaagaaacaaagacaaggaaccacttcatctgatttgccttcgggtatgctagcgtgccgacttaatagatcaaactcaactgatacagcattaagtatgaaaagaagaacaatatctagacaatcaagccgctggaagtttcagagtggtaaatatcttgcataatctaaatcaacgtcagaatctaacctaatcggctgccctctactaacagatgttaaccgattgtagattagatagcgatattgccaaagattatgtgagatatatgataactcgacgaattacataaacaagattagagtgtcataaagatggaagcactaatcccgagaacgcaagccgtcataacaagctttacctcttgttgaagatcgaaaccgatgcagctcaacccgaacgcaagaactcgtccaaataaaactaaagcaaaagagtggcgatgcactgaaattgtattgtacgtgtgttaaaaattacatagggctcggggtcttatttatagccgagaattacaagatatgtctataccggacacgactattatctctaacaaactctaatataccataagtctttgcggcagacttttgcccaagcatatctctaaggaaattacataaaatatcctaattaatagatacaattgccttctcaggactttatccatgcgcggcaatcatcttgaagcaccacaattcaacccgatatcgcacaccaagttgtattgtcggaatcggctgcatcaggctacctagtccgactcagactcatccgatcctaatcgtagccgatctagactctagccgattcctgctctgttcctgaatcgatctccgcctccgactccacttcgatctaattttcttttccgatgccgatgttaccaaatttggttgttaacaataccttatttgtaaccctgacagtagcctctgacttctgcttaaatgaactcatgcaaccgatggcgacttctgatgtcggaatcgttgtcattctcatctggtcgatctcgatatgagaaccgtagagacaaagagttattgacaacatcgtatgaagttcaacggtcatgagtgaatttaaattgaagtctgaaaactgccgcgcgtaacgtacccagaattttttggcggcaatctctctcctttccttggaatacgcaccgtcggtagtgcgcttatttaaagggattttggggatccattccgaagtccgtttgccagaaagctctcctgccttctagcgcttttcgtcttctccgtccccgcaaaaaaccctagctcacttcctccatcctgttctccgtcaatcctccagcggcgatggatcttgagaagtcttcctcgaacaccgcgttcatgaagaagctgcagtatgatggtgccctccctggtcgcgggaccatgcagagggaggctggaggtatagaacctgaacccatcttgggctgcatggttgtagttgacgattacgtttcttgcggtttttagcctccgccttccgaatttcttctcctcgtcttgaacttctatggtctttctttgcttcacctgaatcccaactccatcgccttccttagcattttctcctatctttgcgaggcctatattggggtagagcatttccttgatcttttcccttttttactatgagttgcgttggatggaacccaaaaaggtatccgactgtgtcagattccgacttcgggatggcctgaaatcaagatacatccccttccaatgccctcttctcgcagcaaatggcgggcgggatggttctatcttcagatagagaactcggatcctgttcttgtagtccctgaagaacaaccagacaaaatcccagagtggaccgctaagcccgccctgactccctcccttcaatcattcatcggcatcatcgatgaccttcgaactcgagggttgtcggggtatgaagtcgctgccgacttcatatgtagatggatccaaccgctccaggcccgcgcccatttggcctttgattactcggggccagaggacacgacccgggtctctcgtcggggtatttttttcttatatttcagattttattccggatgtgcatgtttctcctgacttatcgagttcctgttctcgatctacaggtttggacagcaacaccgtggagcgccgcgtcggccaagtgatgatcagctcccccctcagcgacggataatgtcccggtccccctttgcgagaaggggccagccgaatgcaccgccgcaattaatgtaagtgtactcgatgactcctttacatccttctcctcgagaccgtattgtgacttcatgttacacaggctctccctctgacggatatcatcgggccactcgcggaccatcaggcggcggcgtcgttgaaggagggcgtcaccaaggaggcgtccgacgtcgcggttactgccactacaagcggccgcaacgttctgaagaaggggagaaagttctcctccatactcgggacccgtcggaaagcatcaaccccggcggtaagcctctcctatcttttaatgcgttgtcggaatgttttgacctcacaccatcttatcttgcttaggcctcggacgcatctcctccacctcagcgaaggcagaggttggtgacgatcggcatgaagtaagtatatgtttttgaagtcttttcattcacgagaccttggtggcctaattttacgaaagggctgaaattcttcgcagggcggcgcgcgcgaaggcgacgcaggacggggccggcgcgacttccagcgcgtcccctgcagcgacctcaacagatgttgtggtcatcacaagggaccgggaggcgacaccaagcagccccgccgtcggcctggtgcctattcggagcccggctgctgatgcccttacctggggggagctccaaaccgagatggagcgtatcatccaggtagatgcccgcggcgtaggccgcgagatcaaggaggccagggcagcggcatcttcggcgactcagcgtgccgacaagctggcgtgcgacctggcggaggcccgcgaggacctcctcaagatgagggagctggtggctggcaacgagagacagcgacaagggctcgagcaccggatgtcgtagctcgagaacaacttgtcagagttccgcggctcgctgcgggtgtcttacaccggcctacactagctcgctggggaatacggtgtcatgaccaccatccccgttaacccggacaagttctcgctgacgtcgtcactcgcggagctggcgacggcgatgggggcgatcccctccaaacatgcagccaggatcggcgaggagacgtccaacgggatctacaccggggcgtgccacgtcctcgcgtgcatgaggttggcgcaccctgatcttgaccttaagaaggttttcgatcagggggccgccgatgacgcgcgtcggggcgtgatggaggaggtcggtgacctgggggaatccgtgctcccccttttttgaagagtagggctttatttcccttgtaccccttaaccaatcatgctgtaaaaactttcgtgggttcaaactgcccttatgtatgtagttgttcctttgttttcttagcatgtgattccgagtactttgttgtcgttgtagagatgtcgttatcgaggatgtccagcagcgcgggcagcctaagacgccagtgatcgtcccggcacttgcgcttgagtcgtacgtgccgcaggaggatgtcagtcaatgcctgtccgcggagacgaacatggcgacgacgtccctaggtttgcaccttggtttctacttccttcactcttctgtccggattgacttaatttgctatgttctcgggggagaagaacaacttgacttagtccttttcgtgttgggcagacctcgagagtgcattggccgactgagatcgtcgaatccaaaactggaagacgaagctcgaggtggccgaactcgagaagaccatggtggaggtgaagaaagaccaggccgtggaagccctcagaggtcgcgaggtgtggttcaactcgtacctcaagagctgctgcacggcaatggctggagtctgcagggagcttcgagttcctcgcgggaatcctgaggagttgacggccggatacatctcgtggttgaatggggcctgcacacagctcgaaggggtcggcaagcgcaaagacgaggccctgaagcaggagttccgtcgatcgagccgctatgccggagggcatgtgctggcatttatccgagatcatcgccgcaactgcacctcgagttcctccacgaagggttcttatgttctcgtaggactcccgcagagattgatgatctggcgaaatcgatggcgccgctcgccgagaaggtttttcagtccatggattggcgttggccgtcctagtagttgttgtatcctatagaaaatatctcaaggaaacatgtaatatattttggaatgtttatgaatttcaagaggtacttgtgaaatagaatagaaatctatctaagtaagttttcttactctggatgtgctgtgtatgagtgttttctcatttcgcgacttcgatcagtcgcttgagtacactctccctagcccccagccttgtcgtcggagagttgttctcggaggataaggctcttggacccttgacttgccttagttgaaaaggcactgaccctagcccccagccgtgaagttggaaaactcaatttccgattacacgacttggttaatacgtacggcgagaactcttacatgaccagatcttacatggtcgtttgtctcttcatgatctgacaaggtcttatttgctctgggcgtccccagccgaagttcccttaggtttcacagaggccttgtcgagacggcgtaaagggacatgaggataggtttcagcgctaggtgtcgtcgtggtaagggatcgttgggaaggaacactttgaccgtaatctttacctgaaatcaactttattgaaattgtaagacgtcttacaaaaaatggatactattgatttatacataaaatttacgtaattgatcaatgttccaggaatttgctaactctcgaccctcgccgtctgcaatcttgaatgcacctggccgtaagacttgcgtgatcgtgtatggtccttcccacttgggtgagagcttgttgcaccctgcttggctttgaacccgtcggaggacgtaatcgccgatcgaaagtgtgcgtgctctgatgggcttctcctggtatcggtgaagggcctagtggtagctgactggtctaacggcaactctttctcgatgttcctcgagtaggttcacatcgtcgcttcattgttcctcctatgcctcgtcggagtacttctgtactcgtgtgctctaatgttgtagctccgtggggagcatagcctctgaaccatacacgaggaagaagggtgtctccttgttggacgttgtcggtgtggtacgcacgacccataggacagaggggagttcttcgacccacttcttgtcgtgtgacatgagtctgtcatagacacgggtcttgatcccttgtagtactatgtcgtttgccctctcgacctatccattgctctgagggtgagaaaccgaggcaaagcagatcttgactcccaatccgatgcagtaatcctggaaatcggcactgatgaactaggagccgttgtctgttatgatgcggtgaggcaatccatatctgcaaaatatccctttgataaatttgatggcgttgtcggccttgatttcccccatgggcgtcgcttcaatccacttggtgaacttgtcgatcgccacgaataggaacctgtagccgccctgtcctcgtgggaatggtccgagtatgtcgagcccccagcatgagaacggccaagtaagagggatagtctggagcgcttgcgctggtagccttgtgtgtttgctgtgtaattgacagacttcacaccgctgaaccatgtcgcaagcgtctttgagcgcggtccgccagaaaaacccttgtcggaaagcttttctgactaatgtctggccggcggcgtgtgacccgtagatcccttcgtgtatgccgtcgttggacgaaatgcgtttgagaagtaccccgattggcgcctttttgtatagatcattgccgatcatacaatagatcttggcttgtcgggttattttcttggcttctgcatcatcctcgggcaactcgtcgctactcaggaacttgacgagtggtgtccactagtcgtttgtggtctcgatgtcggcaacggtgcgttctgcctctgtagcccccgagctgatgtcggggatgactgtgctatcttcgtcgttcacctctttcaccgaaggctttgttaggacatccagaaaggtgttaggttcgagtggctctcgtctggacgcacgccgtgctaggtcgtctggttcgatgttgtccttgcggtatacgtgtcggacctcgatcccatcaaatcttttctccagcttcctgacttttgcgagatacttggataactcagggctagagcacttgtagtctttgtgcacctggttcgcgacttattcggagtcccctttcatgattagtagcttgactcctagtgcggctgctgctcttatctcaacgagtagtccttcgtactcggctgtgttgttggttgccctgaagttgaggtgaattgcatgcttgaactgatctcccgaaggtgatgtcaagatgaaccctgtccctgctccttggctattgagtgtgctgtcaaacaccattgtccatgtgtcgttgtcggcctgactgtctgccctattgtcaggcatagtccagtcagctacgaaatcagcgaggacttgggacttaatggctgttcgtgacacaaagtgaacatcaaactggcttagctcgactacccatttcgcgatgcggccgacaacgtctttatttctcacgacttctccgagggggaaggaggaaacaactgtgactctgtgggcttggaagtagtggcatagctttcttgatgtcatgattactgcatagagcagcttttggatctgtggatatcttgtctttgcgtcatggagagcttcgctgacgtagtaaactgctctttgcaccttgtctctctcgacaacaatgacggtactcactgagtatggtgtggcggcaatatagaggaataattcttcgtttggttgggggccaacaagtacagggggatttgacaggtagtttgagtgcgataaacacatctttggcttcctgtatccacacaaatttgtcttttttttcaggagagcgaagaagggttgtccttgttcacccatcctagcgaagaatttgctcaatgccgccatgcatccagttagcttctggacttccttgagtcttgtgggcgacttcatgttctcgattgccttgatcttcttgggattcgcttcgatccctcttcctgagacgagaaaaccgagtagcttgcccgatggtactctgaacgtgcacttatctggattgagcatgatgcaatatcgtcggaggttgtcgaacgtttcccggagatcatcgattaatgagttgtttgtcttggtcttgataacaatgtcatcgatgtaggcctcgacattgttcccaagctgatcgttaagtgccccttggaccgtgcgttggaaagtatttcctgcggttataagtccatgttgacgaaaaaatcgaacacaccggcctgggagatctgcttagctccagtgtaggtccaaatattgatgagatgcgggcatgccagtcagtttgatcctgcaacagacaagatatgtaaacagcagacaaaacagctgatcggctaggcagccgatggagcagttccagccggtagccaataatagccgataccgataccagccgatagcgatagggtttaggcaatcagctatatgtccaatgtagataatgatataaaggcaatcggctgatgataatataatatagcaatataatccagtataaaccaatcggctagcaatgatatgataaataagcatcgatccgaaggttaaagcacacatcggctggaggtctgatgttttgaaatccacaagattagattaaacagtgaaaactttgttgtcatcggctagatgcaactcatatgtatatgcaatccttatgagccgatgcaacgtccaaataacttatcggctgaaaccccgatgaaacccttattggcagtcaaaaagcaggctagagattatggttctaagcacgacttaatagatcaagctcaactgattcagcactaagtgtgaaaagaagcacaatatctagacaatcaagccgttgactgattttcagggtggtagatgtctaggctaatctaatctagcaacacgatttagccgataccggcagaaaccctaaaacgagaagcagctgatagagctaaattgatatgctaagactagattaacagagacatatgataagtaggtaggcaaatatatcatccaaaccagagcaatccaagaggtcgaatgtactgatgcagccttgaatgacaccgacgtagacgatacaattgcctggactgacggaacattggacttatcccttcgccggagatcgaacaccgatgcagccccacgtcaggtgccaagtcccgccggacgataaaataaagcagaaaaggtaaaaggtggcgatgcgccaaattgtattgatcatgaagatagattacatagaccccgggtgtacatatttatacccatgtgttgatacaagttcttgtcgaataagaaagaaactttcctaaagataaaaggaaaagataaagcctttataggacactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacactgacgacttgacaactctcattggctaatctcaggccttcgaagccgatgctgactctaagccgatgactactccgggcttgccaaatttcactgttaatagaccaaacagcatcttaacgtagcagaatacaccgaacggcgtgatgaatgatgtcttctcctcgtcatcttttgccatgctgatctggtggtagccggggtaagcgtcaagaaaacttaacaactcacaaccagctgttgagtccaccaattggtctattcgaggaagagggaagtgatccttgggacacgccatgttgaggtcggtgatgtcaacacacatcgtcctccacttcccattggccttgcgcaccatgactgaattggctagccactctggatggagtatctctctgatgaagccagctttgagaagcttgtcgagctcttctcgtatggcttgcttctgatctagtgctaatctccgcagtttttgctttactggcttggcatcgggtcgcaccatgagtttgtgctcaatcacctccctagggacccctggcatgtcagacggctgccaagcgaacacgtctgcattgtcgcggaggaaggtgatgagcgtgagttcctatttctcatccagtgacgccctgatcttgatggtcttgtcggggttggcgctggagagtggaacgatgttgattgcgccgtctggcttcggagtcttgttggttttgctcactatcttgggcggttcaactgtggtgggcgggttgggagtatgctcgaccatgtcgaggctccgcttgccgcactgcaccgctagcttcggcccaggcatcttgagcacttgatatgcgtagtgggatgcggccatgaacttcgcgagtgcagttctcccgatgatgacattatatgctgtatcaaactcggccacatcaaaggtgatctgctttgttcggaagttgtttgcctggccgaaggtcacgggtagcgtaatcttgcccaatggtttggacgatgactgaggactaattccatggaagggttgatcagtgggcgtcaaatcgcttcgtgagatccccattgcgtccaatgcgctggcgaagagtaggttaatggagctgccgctgtcgacgagaacccgtgcgaccttaatgttccaaattgtgggctcgaccacgatcggatatcgccctggagtaacggcagccttggggtggtctgcttctgaaaactcgatcttctgctctaaccacttcatcttgggtgcagccccctgccatgtcgaacaaactttgtgctacactttcttgtactctcgctttgaggagtacgccgtggaacctccaaagatgtgtgagacatggaggtcggagtctgggtaggctgagtctgagtcctgagtggctgcttctgtggccttctcgactacacatactcgcttgcccttttctaacgctagtttgtttcgcaagtgcctttttgaaaacgaaacaagtctctagggagtgcttgtctgacttgtgtaaagggcaccatattttcttcgtatcgttgccttgtgggtctgggtgtttgggcgggtccgcatactctgctgtgaggacttctgtttgagctttccttttcctactcctgtgactcttcttcttgcttgactcaggtgcatccttggctggcttcttctctccccctatcttcggcttgtcgttcttgcgtctcagggcgtcgtccgcataggcgcatcgatcaacaatctcgaataacttacgagcagttgtgatccttctagttgccaattctcgggtagtgtagcgatctcttacaccagtcttgaaagcacggattacggaagcatcggtgatctcggggatcgtatttttgcacttattaaagcgctgaacgtagtccctcaatgattcacccggattctgtgtcaacgtgtgtaggtcgtcctcgatcgcgtggcgcttgtatgttccttggaagttggcgatgaactgctgccacagatctgcccatgaagaaatcgagtagggcgggaggtgaaccagccatgaacgtgcaaatcccttcaacgccactggcaaataatttgctagtgtgttgttgtctgctccggcagcgtagagtactgtggaatagacctgaagaaattcctctgggtcggtgcttccgtcgtatttctctattgctcccgatcgaaacctctcaggccatcggacatcacgcagggcacgactgaaagccctacactcgccgccgggggcagtgggttgtcggcgatcatatgttctccgcggatgtctatccgttgacgaagacgatgatgatgatgacgacgatgacgatgaatcactcagttccggtgtgcgttcgggttcttgagaaccttgtcgccacccaccgttgttgttccggcgctgatctctgtcgttgtcttcattgcgtcggtgtcctcgaccagtatcgcccggcacccgttgttcgcgattatcgtatttgcggcggttgtggcgattatcacggtcttggttcccgctcggatgtcctccttgctcttcattctcacgatgtcgtgaagagacgcgacgtcgggaacgattctcgttgtcttggccacgtcgcgtttctcggcagccatttagatggtcacggagatcactggcgccgcgaagcggagggcttgacgaggtggcgttcactgcgcaggctgttccccattggcgccgccggtcggcgattgctctggttgtaacctggcagcggcctcctcgaacgcgttacagagattagccactgattcccgttgtcgttctgtccagtgatcgagatcagcgttcaggacaggatcataaggtgtttccctcagtattgcgttgatggtcctgatgtgttgggccggcgtttccacttgattctccgcttctgtgttaccgcccctagacgtgctggtcccatcgatagcgtacacatcgcgtggtgtacttgtcgacgatgaggcctggtcttcgagcaaatgtagaacagacggctcgtggggattgatatcgattaccccaacgaatcgatctgagatagctgtcgctcctcgttccttgtccgtatctctagaagagatttgtgactgctggaccttaggaggtggcgtcctcatggcgctgagaagaaccttgcagcttgagaagtcgtgattctttgtcttatgaataggacaatagacatcatgggttggagaagtatgttgaattccacgctctttgcaggcacggatctcggcttgtacgtcaagaaaaacccagcaggcttgcaaggtgtgttttctggtttagtgaataggacaccaggaccttgttgcctcggaagctgtcattgtcggctcgtgattctcgtcggaaggaccaaatttggccgcattaggatccttctcgggctcagatgtcgtcgatgttccgttctccacttttgcgggaggatccttcgacatggagccgtccggggtcgtaaccacatcgttcttgcttccggtcgttgatggaccagtcgagatcgacaccgtcgtgtagaccgggaagacgatttcaccgacttgagtccacaccagcattgttgaagctaaaactccttggttgatgccggggttgacgctgtcgtcgacgaggcttgatggcatagtagtagaaccttgagcaccaagtccccctaccaggcgcgccactgtcgacgggggataccggtagaccggatatagagggtattggggtacgttggaacgaggatctatgtaatacgacatcaagcaaacaaaagacaaggattatactggttcaggcgcattggtaggtaatagccctaatacagttggtatgggattatatgatggaaaccacagattacaaagggaataatggaactcggcgataccgacgagatcgtagtcgagttggttcgactagatcactcggcgacttggctcctgtaggctccggcttcgtaggctatggtggatgtgttggcggtgagattcgatgcccttggtcctgcccgagggtcccttttataccgcgggacagttgatctccaagtaggactcggagatatcggacccctcacgatatagtaacgacccagccttgtccgagtaggactccttccatctatggactccgcttctgtcacatgatagatttccttaacgtatacatgaagtatctgtatacgcgcgggtataccgtatcagcatacaacgtatatatccaaggatagagggtatatcttaaccgtaaccctgacaccagcggcatggagacggcggaaggattcatgttggaggcgactgcggtccggcgggggcaggagaggtggcgacgttgtctatttctctctctctctctctctatgtgcggcggatggcatggtggcggcggagcttttgaaagttttgtgtgttcttgttggaatattccatgtgttcttgatgaaaacagtgtgttccatgtgtgtccttttttttggatttttttttgttggaggggattctgactgggatttttctggggtgggggacggaccaaaaatcccctgacgaacgaggtgacgaaaggaaaaatatgaatcttttaattagttaagtaagataaaaattaaagatgtttttaccagtactttggtatgtcatctgtgtttgaatcagttttgattttatgtttcggttttaatctctatctctaataatataaaaaagaacgagaaatcaccgccgtctgtaggaaaaaaatgtccgactcaaaaagcgataaaaaaggctgggaacaagaaaacatctctgtcacagcctgaatttccgttttaggatttataaattatttaataaattattaatagaatttatattaaatgctcattaatttacaagtgaagttaaatgtgggaaataaaattttataaatataaagcatggatggatttaagttgtattaaattctccatgattaattatactctctgaaattttctcggaatttttcggagctcaattcctaatgttaataatacaaagaacagtttagcaattatttaattaataaattaatcattaaatggtatggttttaatatttttaaatactttgagtgtccaagtatgttcaatatttttcttggaattatttgagcattgaaagtatttttaacaattgaaagatcatctcattggttaatttatttggaaaagtaataaaaatcctcctcctcagcctgggccgaattcagcccattctctcccttcctcacagcccagccaaagtctgatctacctccctggcgctacagtactccatcttcctcctccagacagaggcgagccagccgtgctcgtgcacagtgccgccgcctcctcccaccaatccaacctcccgttgctcctctttccaaattagttgcgggaatggaatcccctcaatctcctcttccttttccccaaaaaatcaccaaaattttctatggaaattctttccaatttcgcggatcaaatccttcctttttccggcgagaaccctagactttcccgagtttttcccgtcgttgtcggcttgatccggagctcccgtgcctatataaaggaccctctagtcgtcctctccctatcccctcaagtcccgtccgccgccgtcgccggaaacgctctccccgcgctctccctctctctccacctccggccgccgctccgccgccattcgccgtcgccccggccgtcgccctcctgtgccgccacctccctcggcttcgcagtgaagagctctaccccggccacccgttcttttgcgccgaaccctgccggaagtcgccgtcaccgtgaaggccgaaccgttgccatgttttgatctccggcaaggccttgctgctccttccgtcatcgccaagcttcgccgtcgcctccattggattcgcagctgcgaagtgaaccccgtccacccctctgttgcctccgttcgtcaccggaaaatcgtcgccgccgtggagagtacctcgccgcccttcgaagctcgtcgccggccatcttccgtcgccgtctgtcgtcgcgtaagtgttggtaaggaccgtcgccttgcgctcttcctcctggtacactccatttgcattattgtaccgtggttcgctggtaactgccgttctcgtgcttgcggtcgtcgatcctgcgtggcagccatgtcatcgctgacatcagcgccatcttggccatccaaaattaatttaaatttgtcatctcttttcaatgacatattattcctttttaatatatgtcatctaccaaatatgatctaatctttttccggtggatgttttaatcttctgtctcagctataaatcatttgtaaattgtttaatcaatttagaatagtcttttctttaataggtttaattggaattaaatcttgtaaaattcgtaactaattcatacgaaatcggaatgagaccgttcaagtctctaaatttatctaaaatcatgatctacatgtttgtttacttttatgtactgtttatttggtttttattagtctttttcctcgttttgcgtgttagcttgtcgtttccgtcgtttcgaaggttcgtgagtgcgccggaagtattcaagaagactgattgaagaccgaatattgcaaggcaagtcacacagatcacaaacaaccctttgagcatgttgatgaattaacatattgtttgttatagcccttttgttcttgattactttattacttgataccttgggttattataacttgactagttgagctttatatattggttcaactagatattagatatgattgcttagccatgcttagaaacattagcacactattgggataactaatgtttcactattacttaatgatggatatttaattgtagctcacgatggtcaatcgtgattggttaattaattaatgtgcctactaaaacttgataatggtgggttgtgagcacatggttttgatggtcgtgctcatgacaattaaggactggttcacgatttttggttgtaaaacattaaccgtgccaaccacaagccagcgtgggcaacggctttaccttttgtatatcatggttcattgcagggcaccagacggagataagcccacgggggtcgctggggagtccatgccttgtttataagggggtgattatgatccaggaacggtgcgctgtggtggattgtgttgtgcgaggggtactgtcacagctcctttccgaggtaccgtggtggtatcgaggcgcatggtgacatgtcgtggggctgtgtcttgtgggtacagtggtacacctctggccagagtaaaactattcgaatagccgtgtccgcggttatgggcgggtgtaacaatgtctttcgtgattagtctcacacttctcaccataataaatgatgctataaatggtaataatttgattagctcctggtttggaatggtacattcctggtttggagatagatctgtgcagccgggtatggttgttcaggatggttgggcctgtgcagcatgggtgtgctgttcagtgttgattaatattgatgattaattactctactgttttaaaattctcaaatatttgctaaatgctgcttttgcaaatgagccatcctttggtatattgataaatctgtatattaaattccgctgcagttttcttttcttttgcaaattccgctgcagttttcttttcttttgtaagtatgtaacgttattatattgataaatctgtatattaaattgtcagtttgtgtacctcggctgattcctggacgaggatttaatgcacaaattagttcggaaattactagtgaatttccgggcgttacaagttggtatcagagccatctcgactgtaggataagccaaatggtcaaaccttaaggacgaattttccgaaaacatgatttgtgaaaatttctcctttcttccttatctagaattctttgcaaattgtttcattgtaaattaatgaactatcgcggtcgtccgaataaccctcctgaatcacaaaaccggacattcttcacccccaactatgcaaaccagacgaattacccccctcgacctaatcagcggtggttttggtctacgtggcagtccagtcagtaatttatttattaaaaaataggtgggccccacctgtcagtttctatctctctcctatctcttctatctctcactgtctcactctctgcccttcttctccttcggacggcgacggccgaggcagcaagcgcggcggaggaggcagcggcaaggcggtggcgttggagagtggcgggggcgaaggagagacaagcgcggcggggccggaggagaggcgagcgtggtgggggcggcggagaagcgagcgcggcggcgagg

SEQ ID NO: 41403 - DNA, 14775 bp, Oryza sativa
gcccccaccgcgctcgcctctcctccgcccccgccgcctcgccgctgcctcctccgccgcgcttgctgcctcggccgttgccgtccgaaggagaagagggagagagagaatgagacagtgagagatagaagagataggagagagatagaaactgacaggtggggcccccctatttttttattaaataaattgctgactgaactgccacatagcccaaaccccccgcggattagatccaagggggataattcgtccggtttgtatagggggtgaagaatatctggttttcgcacgcccgcgatagttcgggggggggggggggtaattcgtactttttcctttttttaatccgatcgcgcctcccgggcgctttgtcgccggtttttttccgtgcgcttttgtttttctcatctggttttttattcctatctgttcgccacacgcctcctgtgttgaccgccatatcgattgtgtgttttctggtccaatttggttgcaaaaatcgatttctcattcctccctcatcattttctccattattttcactttagattcggcttataatttgtcagatttaatgtccgttcggcgatcatcttggccatttttatcccgagttttacattctgattttggaaaaaaggaaagaggagattgagtggataaaaaaaaccccaaccaattttgggtgatcgagaaagattcggccggatttgatgggggaacaaatagttttacactctaatttgagatgtttttatgggtactttgtacgtgatccgtgttttatgctatctgtgctacttaaatctccattgtctgttaaaaagaaaataaaagtctgactcaaagaggtaaaagaaaaagtccgactcaaaagcgataaaaaagcttgtgtcgtcagtaaaaataaaaaacaaacatctcgtcgtaaaaaaatcatccgacttccttaaagggaaaaatggtctcgccaataaaaaacaaaaaaaaagtccgtttggtttttttggcacggtttttttttctattcttttgcacgtgaaagagttttttttacgcacgcgcttaggctcttggttttttcatccgttttttaatccaatcacgtctctcggacgctttgttgccggttttttctcccatacgcttttggtttttctaatctcgtattttaatctgatctgttcgcgcacgcctcctgagttgaaccctgccaccgcgccgccgccatatcgattgtgtgttatctccttcaacttaattaaaaaaatcgattccccactcctttctcatcattttctccattatttccactttcgattcggctttaatttgtcagatttaatgtctgtacggcgatcttcctggcaccatttgtggctgggtcgaagggaagcgggccaaacggtgggagatagcggactcgcctagggctaaaacggaaggaaggctatcgcccctaaacacgggaaatattttcattaacttttttaattataatctatagagatcccaatattaggattctcgttaactttttcaattataatgtatatagcgaacacaatattttaatttattgctcagctcttaatatatcagtgaaaaaacgtctgtacctgtttcaaggcacaggtattatttctagtatatataaaatatatataaagtttatttgtattaatttaaagtatatagatatgtattgatgggactaggggtgagttgatcgcgccggtgtagcctcgtgtggctggccgccgatcagcagcccccccttggagtcggtttgagacggcaccgacggatcgggattcgagtggtgccgaccaggccactgctaggacccgtgttagcccaccgagtatttagagccagcttgacatggaattcttatatataagtacgaattacccttccctaaactatcacggtcgatcgaattatccccctcgacccaatcgagagcggttttatcctacggcatacacatgtcaatccaatgagcatttctttttttaatggtgtggcccacctatcagatatactctttcacatcctcttcccctctctcgctctctctctcaggcgtcgttgggcgcgggtcacgcggcggcaggcgttcggcgtgcacggcgggtagtgggcggcgccgcgggatgcggaggcagcggcggctgttgatatttattaacgacattactataaatataattcctagcaatgacaccgaaattttcttggtatatttatggttacagatatgatttgcaagcgcacggatataccattgtagcatttcacctagaagtaatctaagatatcgtatttatttaatcacaggaaaagatatgataagaaagtactatactaataattcacattacttgtataaaccaaagtctaagcaggggttaatcaattcatgggtaggataaggttgacacacagaagaaaaaccaaggtactcttcactaaaatataatctaggctaagtggagaaagaataagaaaagaatcattcctctacttcttttatatagttaatttagtttacacttgctagtatacaatcatgcaaccaataccccctaactatgccctcctagtgtttcgagagaccatatctgattgctaagttccttatggcaacccgtcatggccatttgaccggtaaggaatacggaggagtacccataccaggaaagtgtcttaggattatgtactattgtggaggaatatccgtaccaagctgtcaccatcagcggcccacctctactgacccgtagcatataaccctaattaatggtatcaaataatctaagcaccacgctcacactactaaatactactccatatcgttacagcaaacattgagcaatcatagaaatgaacattaaacccacaccaaagcatatctctggtaagctacctacacaattatattgaaacaagtacgaactaaagtcaatactcgagtaatatgaattaagtaaaagactgaaactatataaagaaggaagagctagtagagccataccaaccaaacccgaaatctcctgaagactcgaggactaagagaactactctattcctattccactagcaataggacactaaactaaacttgagagagcttcttgatcttcttcttgagtgtgtgttgaagtggggtgaggtccttatataggctcccaatgacggttacagcggttggaaatgtcgcaaaaaacaccgcagccatcattgggaagcaatcctggatgtccacgtggaaggagacacggtggagctgggggttcggccgaacccccaatcggcccaaatctttgcaggtttgtctcctaatgactccccagtccagcggtggggtggttgggcccatttgatattatttcattggatttgtaagcctatccacccataagtctacctctcgatggatttcgattgatggttcggttaatttccgttgattctcctccaattatgtaaagatctttgcaaacaaataaacttccaagtacaagtgttgatagattagtcttaaacaaaaatatgcatgcaagcatagctagttctcctttattttggatatattgacggtcgaaatgggtctataacgatcgacaacagcagcgtgggacgcggaagcggcggcggcacgggacacaaaggcgatagcggcgaacttagggagggagccaaagttgtgggtggcacccccatgtgcacgacttgcgctggtggccaccgatgcccaagagagagagagagagagagcgggaggagaaagaggaggcgggacccaacgatgcaagtctccaccgcctgtcgtccctcttccggctttgtcgacacggctccgatgaggcgggccgctcgctgctgaccaaaccctcctccacgttgctcctatcaccgccttgagttccctctcctagccgcgccctatccctgtcgttcccgcagtcgaccggttccccctcccatccgtgcgcgcagccgagtggagccacccagccatggttgcttcggctcggtgacgactggttcctatcttgtcacacctgccgctgctcgcctagccgtgcccacagccgctcgggggaggaggatgggaggagatggaggcggggggccaccactccggctccctcccggagttctccgctcctgcctccgcgtcctgcgtagccgcccattcctacgcactgactgcctattgacggtcattacagacaaatttcgaccatcaatataactaaaataatagaaaattagctatgcttacaatgcatatttgttttcaaataatatagttccacttgtacttggagaataacatgttgcaggaatttatcaaataaaataaagagaaagtaaagaaaacctcactcctaagcaagttagacgataaggtgggcccacatgtcaggtgtaaccgtcaaaaaccgaccttagctgccacaaccgcctaaaggacccacctgtcagtgaccctgctgaggctggaggcctgctaggctggcccaggttcggctgaaccctggttgctacggctcagctcggccctccacgtggatgtccaggatacactctcaatgacggttgtgagggtaaaatggaaaattcgcatggctacaactgtcataacggccctataaaaggaggagctcattcactctctcaacacactcaagcaagcttaattcctcttcatacattagtattagttgtatagtgctaagtggagtagtaaagaatagtgttcagagtcctcggagtcttcggaagagtttttggtatggctctagcaactcttgtaatcccttctgtaataccttctgaattaatgcaatactcttctttatatatcttcggtgctttgcttagtctgagtactggtcttactttatatctatattatattagttgtgtgggtagcctaccagagactggaggtgtaatggtgcgggtttaatgtctgatttatcagttgctctatgtcgggtgcacgggtatagagtagaatttagtaatgtaagcatggtgcttagactatgaaatatcattaattgtgtatatatgctgctggacagtagaggtgggtcgctgatggtgatagctcagtacggttattcctctatgttagtatatgttcctaagacaaattcctggggagagtactcttccgtattttgccccggttggacggccataacaggttgtcataagaaacttggcaacccggggtgatctctcgaagtaccaggaggacactcttagggggtattagccacatgattgcatattagcatatgtaaactaggatttgagtgtatactagaagtataggaattgaatgccttttctttattcttccacttagttagaattattttcattatgaggatttatcagctttgcttcgtgtcactttacccttatattatacttaacccctacttaggctttgacaattacaagtaatatatgtataaagtgcattagcaaaattcactcttattatcttcccttgagattaaaaatatgaaaccttggaatacttccgggtgaaatgctacaacggtagatccgtgcgcttgcggattacttctgtaaccataaatatatcaagactatttctagcgccattgctgggaatgaatatttgtagtaatgtcgttaagaaataccaacaagcttttctagcaccgttgccgaggaagattaataatgagatgactaagctaataactttatatatatatatatatatatatatatatatatatatatatatatatatatatatatagtacctctgtatgagtcgttgtcctttgcaggcaaaccttgattgttttcacttgtgtcgtgaaaacaaggtagtgtatgactggtttcaacttaccggagtgtcaagcctcgtgtcgtccctccacagaagagactctccgaaaagaaaccagccatccaagcatcaccaagttttagggacatggccgagaagacccttcgcgaattcgttgccccgtctgctgacaacgtgcctgttggcccggctatcaacatcggagacactgatttcgatcttaagagcagcctgataactacagtgcagcaaagcccgttctgtggcaagccgaacgaagatgcaagcactcatctgcagcaattcttggagatctgcaccacttacacggtaaaaggtgtcagtccggacgccgtaaggctacgtctattttctttctcacttttgggaaaggcaaagcagtggttctacgtgaaccgggcgactgttaacacttgggacagatgctccaccgcgttcctcttaaaattcttcccgatgggcaagaccaatgaccttcgcgggagaatatcaagcttctagcagactagggatgagacgattcccgaagcatgggaacatctgcaggagtatgtggctgcttgtcctcatcatgggatggacgactggctcattctgcagtgtttctacaatggactcactccctcgtccagagatcatctggatgttattgctgggggtgccttctcaaagacggttcatgtggccattgatcttatttagaagatggtatccaacatgggatggagtgaagaacgactccagacctgacagcgcggcatgcacaccgtcaaggagacggagaaacttgccgctaaactagatctactgatgaagagacaggacgaccaggagaaggccaaaccgcaggccactatcagggcaatagactcgcacttcacatacgaggtctgcgggaacactggtcactaacttgcacgtgcgaactagtggtggtgcgcatcatgattaatcattgacatggtggtggtgcgcatcatgatttcaccgcacaaactcgcacgtgcaaactcgtgacatcacttgtgcgagtttgtgagttcactatgggaactctatgacatgatgccgcaaaattgtgcgagttcgcgcgtggatggtgcgaactcacccgctgaggccagctgaggcctacatctccggggcactgattacgggcgctcctccccgatctcgcatattaaagcatatcagagttacaacgactcatggccggacgccctcggcagccgcttcctctcgcaatgctatgtcgccatacggttacaacaggcacacgccctctatttatgagagatccttggacagagtccaacatttactctagtcctatacctagtacaactccaagtcctaaactgtaaccgactatgtacacatattcgacacaaactctaacaaagtccatcttggcgaatatgccatgccaacctgaatttgctccttgcgtgaacctccgtgtaccaggactttagttgatcctttttcgctgctcacactgagccgcccctacaagccttcaccaggctcaccgtaaacaagagacaccgctattcttacaacttcttcctcttgactccacctgcaatagtgctccaccttttctcttatcaccatagttgtcttgccaagcgaaattggattccttcctagttatcacgtcatagacttcccgaagaccatattcacctccatctactatcttaagtttgacttgatctaatccatggccagataaccgatgtcatcaccaaacagataaatcaaactcaccagacacgaagagaaccctttcttccttgtcgtcttatgaaccgagctaataaatccaacatgcacgcttctccagcattcgtagactgaatacctgataattgagaaaaccatcgttgcttgaatcactgaaagaaattaccaccatagcgctcgccctttctcttcagtgacgcaggtctcatatatctccatcttgcaaacctcgcagattctggatataccctgtactgctaaacataccgttgacgtcctcaatgattttcacccactgttgcccgggacctctcacttgtcctcccacgactgcctttaccgaatcataccaaaacataacacatcattgccttgctagttgctacatgcatcaatctcacatatgtcaaggttctacaagaatcaagcatgttcatagacaaacaagctagcgcgtccttccctgtatacatgaggccacctcagaacagaagcttgtacgtgcatgcatagacatgcatacccgtccaccctcacatgatcacatatttggtactgaccaaactccaatgcaccacgaattaatgttccatgcagcccatagctttttgacgtgcaaacactttgactcaacaagccagccagaagaaaaaaaaccagtctgactagtactccgtcttgcatctgatcaatcaaaaaacaatccttctcgatccaccggcctgacttttcctagtcggactgcagcggctccactagaccgttccacgcacaaccatacatccccatgtgtgtgcgacatcatctcggacagccacgatctgctccaactacttcggcctcgggcccacaccgaaccatctctacattgcttgtgctccgcttggttcacgaattgctgcactacacaaaacaaacactgcctcatcctccgaaatcaatgccgcttccacctggaactgccgtcttcttcaccaaagtcggcctgcctcagaccccgccgacacctgcacgcgaccgcacaaaggccgtgctcctgccgcccggagtttgatgccaccgttgctgctccaccttgagcccgcaaacccactccgactttcgatcaaccaccaatcaatctagccgtgagccgaagccgacaaatcaccatgccatcttcccagccgccgaacgacccgagcgctacgtctagctgtctccttgtcgaacgcagctcatcgaaaggcccggtccaccccacctagagtgttcgatttcaccgatcgagaacggcgaccgcctccagcttcaaccaacccgagcatgcggccgcacgtctccctgttgagactagctcaccggaaagtccgggccacccgcccaaagtgtccgacccaccgattggatcaccaatcgcttccaccaccatcaacccgagcaccacgtctggtcgtctccctattgattgcagcgatcaaacggtttagaccgacgcctgaagtgttcaatccaccgatcaaattccgttgatcgccgccatgctacaccatccatgtccatccctggacatcctgtgcggtcgtcgcagtgtggagcacctccctcgcacctctaccttggatctcccgcaggctctgataccacttgtaataaaaccagtcccgatagcacaccgagaaccaaacgcggaaaaaacgctataggatatccaaacacgatgacgacacgaggtgttagaataggtgtcgaatatactagtcctatttggttacagttggacttggtgttgtaataggtgttaagggtggagttagagtcgaactctgtaactcgcaactctcttaaatagagaggggggcaccactatataaccatggcgactacaatgtagcgtacacacgcagggagatgatggcggcgtggccatggactcgtagcggctaggtgctatattggttggggaggagcacccataatcagagccctggggatgtaggcttcggctgaacctcgttagcaaatatcgtgtgttcctgtgtcgtcatctggtatgtcttgggtgatcaatgactgaagcgatcgggaagattagtcgtcgttctgctatatcaactaacttttctaacaagtggtatcagagcccaaggtttagaacccagtatgatttccatgggtcacagggtgggaaggccaagtaacaagtctttggggtcacatgagttgatgtgatgggggagattgttgggcccgaggccaggtaacaagtcttcggggtcacatgggttatgacagggaagattgttgggcccgatgtgtgacgggggtgattgttgggtttagtctcacatcggaaattgatgatgggggagcacgacttaaaaggtgtgggtggtcctcacccattagactagtcttttgggttgtgtaggcccaggacctaaagttgtggctctggttgggcctgtggtggagcaggcccaatgtgacctgggttggcctacagttggtgggccgggctatacactctaacaagtatcccttacatgcatcgtgcacacctgcgcccaccctggaacatgttacacgcacaagctatgcttgcacacgtatatggaacatgcatacaaggcaacatgcatgtatgtacacgtgtatgctaaattggaaagtggccaacatggatgtacatcaaggttcggttattctatcaatgttgaggcagccatgattggacagcttgcagtacacgattaaacctatgcaaaggacagctactaggcaaagcagatgagggcgctgaaagatcgaggagtccaggatattcccgtgagcgtgttcgacacagtcttggtgtcgtgctaggagaggccgaaggcaactcaatctctggttgttgtgggagtcatcgcactcggctgtcctatccgcgattaatgagaccgactctaattcagttgcatgtgctctttaaaagcatcgccagggtggagttcaggattaatagacgacggacgaaggatcaactcagcaagtcaatggctcatcggtgcggaggcttgaggtggtgtctgagtaggctcggcaagaaaaggaggctcgaggtggtgtctgagtaggctcggccagaaaggcctgtgaacatatccgaaggttcctagtggatagttcattggtctatgtcttagatcggatcacaagacgagactgtgaggacgaatacagacggtacagaatagaagggtgagtattctggtggcaacaggccagtcaggccgcgggtgagtattctggtggcaacaggccagtcaggtcgcgggttggcaagatgacgccgacaggtatgaaatttgatttggtgaaatttgatggctctggaaattttcgcttgtggcagactagggtcaaagattcgttagctcaataaggagtttcaaaggctttgaagggtgtcaaaccggccaagatggaggatgacgattgggaggagatgtagttgcaggcggtctctcatattaggtcatgtaccatgtgatggaggagacctgatgtaggaaggggcggatctgacagcacatgtgaacgttttcaatcaactagtcacagatcttgtgaagatggatgtggaagttgacgatgaagacaaggccatagttcttttgtgttcgttacctgaatcgaatgagcatgtggtgactactttaacgtatggcaaggataccatcaaaactaaatatatcacttctgtgttgctggctcgtgatcagttgagaaagaacaaagagggtgaaacatctcaagcggagggtttgctagtcaaagaagatcatgttgggcgtaaggtaaagaagaacaaaaagaagaagatggtgcagtgcttcagatgtgatgagtgggggcatataagcagggagtgtccaacactaaaggaaaaagcaaaggctaatgcagtgacttcttcaaatgactcagatagtgatggttgtgatcttctcacaatgtcaagtgcacagtctaaggatgtagaagcgttgatattggattcagctagctagtttcatgtgacaccaaggaaggagtggttctcttaatacaagtctggtgattttggttttgtctacttaggggatgacataagttatccggccgtgagagtaggtgaagtcaaaatcaagctagaagatggaggcgaacatattcttcagggagtcaggcatgtagcagggctaaaaaggaatctgatttcgcttggaaccttgcataaagatgggttaatattccacggaaatcggaataggaagaccatggagatcatgatgggcaagacaactgtgatgactggagagaaggtggagtcccaactttacaagctgcgagggtgtattgttgcaggtggagtctatgaggaagcggttgctgggatagcaattgcttttggtggtggcgggtctggcgcagattcatcgggcggcttgcggtgaagctgcaaagaagacaacccaattctagaggacatgtggatcggcatggtgattttactacttctaggtggcgtatattcgccaaggtggagtttgttagaataggtgtcgaatatactagtcctatttgaatacagttggacttggagttgtaatagttgttagggggtggagttagagtcgaattctgtaacccgcaactctcttaaatagagaggggacaccacaatgtaaccatggcgactacaatgtagcgtagacacgcagggaaatgatggtggcgtggccatggactcatagcggctaggtactatattggttggggagggggccccataatcagagccccggggatgaagtcttcggctgaacctcgttaacaaatatcgtgtgttcctgtgttgttatctggcgtgtcttgggtgatcaatgactgaagcgatcaggaaggttagtcgtcattccgctatatcaactaacttttataacacgaggcacaatatttgataacggaattcagccgaggcctatatctctatggcactgattacgggcgctcctccccgatccagcttattacagcatatcagtgttacaacgactcacggccagacgccgctggcaggcgctccctctcgctacgctatgtcgccatgcggttataacaggcacgtccctctagttatgaaagatcctatgacagagtccaactcttactctagtcctatacctagtacaactccaagtcctaaactgtaaccgactatatacacatattcgacacaaactctaacagagtcgaataacagtggtgtcggtcctctccttctctcatgtcgccttccccaactcttcccttccaatggcctctctccctctccctcgtggatctgtcgccggttgtcctcatccctcccctccaccaggcactccccctctctgtcgtggatctatcatcgacagtcattgggaggcggggcacggaggaggaggcgacagccatggaagggctagatccattgatggcggccatggaccctgagctagcgtggcgagagaaggcttcgatctaaatcatgttgtggtaaagcttcaatttgaatcacagctctattttttttatctcgatcccttctctcaagcaaccacaaggaggaatccgttgccattgccagtggccatgggagggtcaaatccatccccggctgtcctcgggaggggcggggagcagtggagagggcgtctgcttcatctccacgacctcgacagtgataatgttgatgaccaagacgtgcttgctgcaacaacggcaggtggggacgtgggcagcggtggcagcggcagtgcgtggacaccaccgtcgaagctaggttttgattttttttttgtatttttcattttttgcacgcgggcaacataactgactgcatgagaaacttgcaattttataaattgaatagaaaaaatgcccatacgttacaacgggtaaaaatatttttggatcactatacattatactccttggttttggccaaaatctcattccttccttccatttcagttccagctcagtccgctatatccgttcgtttggcctgcctctctttggtctagttcacaagtggagctataggcccagctggagtccacaagtggagctataggtccagctggcatagtcgactgtcatcttcaacctccagaagacagtcctctgtctgtatgatgccagaactaatcctctccatcaaatctagttgatctttttccatgtcccaaaattggttgagggcttttgattcactcgatcttctcttttcgtttttatcaaaatcaaagcgaatgcacaaaactcaggacaaaaactgtgaatcttaaatggagattaaatctagtgaattaaagcagaatcgaaagggaaaatcatggggaaaataatgagggagtagtagggaatcgatttgtgaaagggcttgtagtctagtggttacagccttggtagtaccttaggtcctgagttcgactccccataggagcgattttttcaggatttaacggcattgtgctttcagaggtgtctgtggtgacttcgtcaatctcaaggatttgccggcctaatagaggtagggtttgcgtgcgtgcgttgtgagtgtctgtattgtagtgtgtaattaaaaaaaagtaggaaattgatttttgcaattaattggaagagaaaacacttgggaggtagatgacgtggcggcagcgctaggttcggcccgtcaacgaaaaaacagtcagattaaaaaaactgcttgcacacacccttccgcgtgataaaaatcgctacttaataaaatagtgataaaaataaccggaaaaaaggcgagaaaaaaagcgaagtagaaaaaaaaccagaaaatagggatggaaaagaatacccggaagttttatgtattttttattagttatattgatcgataaattacaattttatgggtgtgtttagttatttgggtgtaaagtttttgaagtatacggacgtagatttgaagtattaaacgtatactaataacaaaacaaattacagattccacctgtaaactgcgagacgaatttattaagcctaattaatccgtcattagtaaatgtttaatgtagcatcatattgtcaaatcgtgg

SEQ ID NO: 41404 - DNA, 10242 bp, Oryza sativa
  unsure (1)..(10242): unsure at all n locations
gtgaccatggctactatggatatccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgttgcgtcacctgtattgggccaatggacttgtaactttgtttgggaccctggcctatgtggggcccatgtggggtgcgccccaatctggtggagcacgacccttggaccctcttggtcgtcctcccacctctataaatagttaggtaccccttcagggtttcttgggttttgatagattgaagtttagccattgctacttgcttgcagcgcgcgtgtcggctagaccgtccgtctgcttgttcttcggaactccaacttatcatttgtattaaattcctatttgcaatatcagattgcttttatcttgttcttgcttgtttcttcgatttccttgcaggaatagggttgatctgcaccggcaagatcaacaaccaatggagaggtgtatcgatcgctaaggcgcaacacaacgtctcgtacggttgtagtcggatcgtcaacgtttctcccaaatcgtagttatcacaactcaccaaaagatcgggccaacaacagtcttgagtgtcgagaggaactcagggtccatcataggctcaaatgattcttctcgcaatttacatgtaaactgtgtaattagttttttcctcacatttaatgctccatgcatatgtctaaacatttaatgtgacgtttttgaccaaaaattttttttatctaaacaagtcctatatcaacaatccctgttcgagtaaaaaaaaaaacaatccctgttcgtggcagtgttggccaagtagcaacattcgacgaattaatgatcttgtgccgtgcacccgtgccgcagtatatccatcagtctacaaacattgaaactagctaataccgaattagacacagcttaaaactacaaatctatctagtttcaattcgttatgtttatctaattcttaagcaactacacatacttgtaccacttggcactccttaaacactaatctatttattttgtattataagttgtttggactgttttttagcaaatttatagtcaaatatagcaatatttttatattttctgcaaacctaatcaaacttaaaaaagtaaaaacgattaataatacgatgaaacgtagggagtacatataatcggaagtactccagtatttacatccggtatttaaatcttccgcctagactctagagaatcagaattcagtggcgtgagatagttacggcgtcacgccgtttgctttgtgtgaattcaaactgatgtcctgattaattcatctggtcacaaatatataattcatctgtgtacaaatatataattcatctggtcacaaatatataattcatcacacaattaattcatctggtcacaaatatatatcaccggagcagagcatgaaagatattgcacacgtacgtacacaagannnnnnnnnnnnnnnnnnnnnnggtcagggccggccggccgtcaattcgagtcgggcatcgtcgtcgacttaccaggcccgtcagcgacgatggcgatggcgactggtttcccctcgataacttcgcctttgtcctcctctgcagctgcgttcgcctcgctcctcttccccttcttgcagttgccgtcctggcccttggtcgtcgccgcctcgatgtcgtcggtggtagtgccgccgccgccgccgcactcgaagaccgccatctcgaacgccggccgccacggcgccgacctcggcctcttctggcgctggtccccgccaccgccaccgctaacgtcgtcttcgcggcagctgggcagcgctgcctccttgaacatggctctcagggcccgaacgtggccacgagcgcgtagaacctctccatctgctgctgctcttcctcctcgctcgtcgtcgtctccgccgccgtctcctcctccggcggcagcggcgacgacggccgagaagtcgtcgccatcttcttcgtcttctcccccgtgctcaatcgggcttccatttcctccactggtagttggtctatatatgtgtagcagtacctgtagcctatatatggatggagttgaatgtagtagtaagaagcaaactagcggcgtcccgccccgttgtttcccttgttcgggaaataaaccaaacgacatattacaaatgaagaataatttatacatatacttttatatacataatcttaatgatttgaaagtaaatacttgaaaataaatctcgataaaaaccttaaaatcaattttaaatttaaggttggaaatttaaattttattttataagcataagtatagatatgagtgaaaagatagcagggttagacgggaacgtgcatccgcttgcagtcacgcgcgacgcgtgtggtggtgtgggcgcaccgccgtgccgggaattatttatcgattataccttttaattccgtgagatcgagggattactagtgtcattaacattattaattaccaaggggcagtgggcctgcagattcattgctgtctctgtatgaccgtcacttccgttcccaccaaaccacaggtctcgatccgaaaggtcggtgaggaactacaattttttttttcaaaggcagtttgtatgttcttttaatagaaaatgcttgtttccagagatttaccacatgcacaattattttgtcagccagtagttagtgcagtaattacctggtgctagttggactgtcacctaacctgacctgaaaccaggtgggcacaaagaaagctttactcccttcgtttcgttcataattgatcatcacattaccaaaacaaaaatattcatatttgattagcatataactttgggaggccacttcttccgtgtgtgggatttaatacaccgccaattttagtacccatgtccgcatatctgccttcacaaccttggaaatcaggggggattaagtcctgtccaataatcacaattacgttcctagccatgcggattcgatgcacatgtatgcatgcacagtcttgatgtctagggttatcaagtccccattaataaatcagcatgcatgcataatttacaggaatgattaaattctccttcgtcttggcacccagacgtaacatgtctcaaaattgtgaacggagggagtatctagtcatggtaattataagcaacaattgcaatccaactgaactgaagtgctcaccaaaaatgaatttcattcaagtttattaccctttacaccaaagtagacataaataacattaagcaaaaaccagaggatagtttggtcgcctctgttgatcaaccaacagtaagaacactagagacccacaagccatcttatatggtcttattcacaatatacaatcttcttattctttagttaagattcattttgacgaacaatctgcatctgcacaacgttttaaaaacccctcggatgcttaagacactgcaatataatagtattgtgaaagacccggtcgttgggaggtcaacatttattaataggcaagtggcccaggacgaaattgcccgtggtgcataattaagctgctaatcgtgacggtgcatgctgatgatgcatccccacatcgtcacgaggccacgcagaaaaggcaaatcgctcgcgctatactggtgacggcacacggatgacgcaatcgagccttacgccacagcgcatcatggagacatggactactatttatttggactgtgatagcggccaacttgaccatgtcttctctcatactccagcgagaataaattaaggtagaatatcataagctcaattaggtgagtaccaggcatggctcatgctttaagttgatacaatgcaagactaccaacggactatctaaatttgatcctccaaatatttatatagtcagctatccaattaatttggcaagccaaatttatttctcactaatctaacagcatctccatctaacctctctattatgagttcatgaaactagagtacatatgtcggcctctactacccctaattcttcctcctctttctcccccacttcctcttgtccctagggtgacacactcaaacatccccgagttcctccccgtccctctctctctctatgcgaggcagggatggtcgacgctggtgaaaagaaggccgtcgacatgcgtggtggtgctcgagctcgccaccctcccccattcacccccaaccccatcgccaccatgggcttcctccataccggcggaggccgcaacgacagaaatcagagccgggagaagacggcgattgccccgctgagtttgcaccgctggccaaatccatgcagggcagaggtgttcgaggccggcgcaaggacggaggatatggatgccacgtcaacgagaaggcgcatggaggccgcgacggcaaagtcaagggagaggcgcatgatgtggccctgatgacggcagcggtagacgacaacgatggcagcggcggcatcgttggggcgatgacgagcggaaggccacggcgatggagtagggtggaacatcgggatgcggcattgatgacaacgacagaggcggtggcttcgttggcgtgccagcgagcggaaggccaatgcgacaatggaggcgtgcggcggtgaagtccctctcgatctgcatcacaagtaggaagaaacataatagatgcaatgggccccaaccaaccccagcagtggatccaccatgaggcagtaggtggttcgccggttgaccaggcgatgattgtgcttgccccttccccatgcctcggtacctaatagttgggcaccgggtacataataccctaggtactagaccctaggtaacgggtctggtacctaatagttgggtaccgggtacataatgccaccatcgttgtcgctgtcgcctccctcctagttgattaactcttacgccatctccaacccagaaactatcaagtaatttctatacttgtcatgttatatagacactatgtatagaaactatatatccaatggatagtgtcttcacattaaattctcatccaatcatctatcttctctctccttttatccacctatcctcatgtttttattcttggttcttgtgtagagatggtttcttgcatgagaaatggtttccatcttgttacctctctcttcattaattcacttgccacatcagatttttgcttatgtggcaatcaatttaatgctatagacactagatgacatgtagggtttgggatggccttattccaatggtcccaaatgagctccctagcctccagatctagtgtaggaggggggaagagggtggggatgctgttggtgcaggggacaatgattgaggagtcggagaaagaaatgagcggattgggctatagagtatagagttttaggtttggaggaggcattgccgctttgagggaggcaacgaagtcgagccttgagaagacgaggaaatagatcgaagggaaaaaaaactattcgcttgttaagttatcgcgtcactagaatggaaactcttgctgttgtttttctgataactaatgggctttgttgagactatacccatgttgtctaaagtttaattaattgtgtgtctcctttaaaaaaaatcttatgctataccatctcaaacccactcggtaagggaaaagaagttgaaaatgttatgtagaggaccgatgttcatcatctccttgttgtcttatcaaccatagccaaaatttaaattatactccattttagagttgatattgaggtttttccattatagcgtatttttttagcaatagcatttaaatcgctaaaaaatatggatataaaacttttgcccataaattatttttcttcttccatggcttataatcagtgccataaatataccacccaatcaaaaaaggactaggatagtgtaggatcaaagacatccgggggggagggtgtgaatagaattcctgctctgataccacttgataaactctgagttcgacttgacacgctcaaagctctgattggcccgacctttcggtgagttgagataaccacgatctgggagagaaaacattgacgaccagactaaaaccgtacaaggcgttgttgtgttgtgccttaggaatcgacacacctctttgtgggctgttgatcgtgccgatgcagaccaaccttattcctgcaagcaaatcgaggaaacaagcaaaaacaagataaaagcattatgaattacaattatgaattaaagctcaagataaggtgggtttccaaaggcgaataattaagcggtcaagccgacacacgtaagtacaaggaaaagtagtgattgctaaactttttactaaacaaaacccaataaaccttgaaggggtacctagctattttatgaaggtgggaggatgatctaggggtccctaggccctgaaggggtacatagctatttatggatatgggaggacgacctagggttctgtcatgctccattaggttggggtgcaccccacttgggctggggtcccagatggagttacaaacccataggcccattataagtgatgcaacaccttgtttctattattgcggccgattgaggtggaatttagagatgaggctagaaccattagagagaggactctaggagctttttatcaaatactcatggacccaaaacagagctcgtatgcgcatttggtggccagttgaagtcagcaatgtagcaggtggccgaattggatttcagcacttaagacgacttgatcttcttgttgatcaatgatatgaacaactgttgtatccatagtaggcttggtcatatcacccagcgctggacgcctgaaccctcttagtactagtactcaatacacacttttctacacagcaaataagcagcgagtcaattgtggttgccatggaggaagatggttatggtaatatactagctagtaggctgccttttttggggcattagtcagtcagtaggctatcaaaaaatgagtactctagtgagaaagctaataataaatggtgagacatattagtcattagaatttattttacgtacaatgaatgtttgatggttcgtgaggcatctcttgtgtgttcttttccttaacagagaagaagaaagaaggatcgaaggaacaaaaacaaaacctaacatctggttcaatggcttcatctcaggtcagttagatcaatttccgcattaagcagaggtgatcatgtttaggctaagaacttaagtagttaagtggattaaactccaacattgtgtatcagagcctaatcttagccttgatgttccatcatccctaatgaagccattatgccaattaaatcctaatcaattcggcatgatgaaaataagtgagaattgtttttcaatctaagttaattagctcggtttagcccttcatatatactgtttctttgcatgttttaaattcaagatttaatcttttgttaattgcttagcagtagaattaagaaattaagggaagggaagaatgagatcaatcggtttcaattttcccaaaatccccaaattgagaagaaccctgattcggatgaagaaccctaagtaacaaaatccccaaaaaatcaagaaacccaaaaaataaaaattaagcttgagttcagattcttaccggacttggagccctaattctaccgggaaacctcactgcggtgttggtctcgtcgagaagcggtatcgccgccgtcggcgccatacgggcttgcccatgcgtctcctcggtgtgcccttgccttctcctcctcgcggttgctgtgcgcacgcaaccttggagatcccccaccgtcgccgactaaccgggatgggaagcatcagcttggcgccgcctttggccttcgctcccccgccgacaaggtccgggccacgtgacgctcggcgccgcttgcgcgtccacctcgctggaccgcagacgccacgccatggtttggcactgcccacgggcgcaccctccagctagcacagatgtgccactctactcggcgctcatcgtcacacgcgtgctacacctcaccgaaccgccatctctgtcatcgccgccatacagtctcacgctcgctgggagaaggggatcggggaatagaaggggagagaatgagggctagggttgcacatgggcggtaatttcatcggtgtgggacgaatccgagctgtccatcagatcgtccctgcatcgggtcgtcacagatttcatgggccgcgccgccacagctcttagcccgctcacgctcgcgcgtgtaatccgggacatctttcacgaagataggcaaaattaagtttttttttattttaagcccatcatttatgattagatatttccataattttctatgcctttccttagctaatttaaaatcgatagaaaattatgatcaattatttgatcactcacagaattatttctagttgaatggaaccaacgggaagtttatctagcaaaaaatttaactagaaagaattaagatatggagttattttgacccacgttattataattttactaagattaagattactatttccttggttattttctgcccaacgatgatataattgaggaaaatttaaatgtaattattatttcctatgtcattttggcattaacggtaatatgacttaggattttaattcatgccattagtgcattattatttcctttatcacctctatcttatggtgatgtgattaaggattttaatttgttagtaagcttattaattgctttaccatttttgccaaacggtgatgtgtctaaggattttaatttcatgtcattactaatggcattattttaaacacatttcctatatcatttctacattacggtgatttgatttaggattttaaactgatttcctacgtcaatttaccttatggtgattgatttaggattttaaaacactacctactatattatttcctatatcatgtctaccttatggcaaattagatttaggattttaaatttagtatttacaatattattttctttgtcacctctgcccaactgtgatgtgatttaagacaatactatttattccctaatcatttacgcccaacagtgacttgattttagattataagtaatttcatttaatgattcctgtgttttgtctctacccaactatgattcaaagagaaataaagattaagttgtcattattgtgtaagtaattgtactaatgtacgttattttcacaggcaaccacaataataatgccacttaatattccagcaataaataatgttatttatcagtcaaagtctattgaattatttttctcactgatctaactgagcataagtctttcttgagtttgacttagcattgacaaatgtcacaccccaaagtttaccctttcctagctttaaaattcaataaataaattgctcaaagaaattgtttaattaaacctagagctaaaccctaaataataaatacatttaataatgggaaattatatggtggaatttttcttgagttccctatgttttaatacattaactgaatttttagcggaattttcagagcaacggtagcaattttaataacaaaaccaattatcagaatttaattaatccctaatctctttttttcttctcctttcggaaatgcgccattttttttggcccattttcccctcccgcgtgggcgtttccattgggccggcccatggccaaggcccaacagccgccacgtctccctatggcttaggtcgccgacaggtggggcccacctgtcgggcccttcctcaacatccggccggcggagacactgccccgcaactgcagctcctgcgcatcccgtgccacctcacccacccctccacatccgtcgcccactaccgcgccccatgccccactctcccacacacccgcacccacgaggaggccgagacccaagattcggttttcgaaatcccgccgtctctctctctcccctctcccccatgtcgccactggagaaaccgcatctaccggccacgtccgaccaccccgcccctataaaaatgattcccgtgtctttttccctctttttctatccattcccatgccctcaatcgcactcgcgtcg

SEQ ID NO: 41405 - DNA, 14599 bp, Oryza sativa
gttcccctctagctgacgtatccagccaagggtgggcgtgacggagtttggatgggccctgtgacggcctatgcggcttccggattcacctaggcacgagagggggctgccctctgcatgttgaggagtgggggcgaaacctgaggtgtggtgcacttggttagaggtggttatgcgaagggtcctgtcacaatctctttccagggtaccatggtggtatgtcggcgcacagaaacgtgttgtggggctgtgtcttgtgggtacagtcgtacacctctgatcagagtaaaactatttgaatagccctacctgcggttattggcgatcaaccaaattcaccgtgattagtcacatgcttaataatttgacttaatggaactggtatagttcaggtgcttgatttgggactgtcgcaacatggtgtagcattggatagtgattatttaatattgattaattacttcaacagttttactgatttcaactactgtcttaaagtgcctgctttatgcaaataaacccctagctcccttgtatatctcatgcatcataccctctcgtccggtatgtcttgctaagtacaatgggtagtatttagtcttgctctgtctcccacccccaagagttggagtacgcgtcagatggaggttacttggaggagtaggtttcatccgtgccgtcaaggatgcctatggattggagccgtcatgctgcaagcgccaagttatctagtttagcttgtttttaatttccgctgcatatgtaagactttttatatatttgtaagacgtggatctgtatgttaacattgtcgtttgtgcaccctggccggtcctggacaggggtttaatgcatattctgcttggaatcctatttggaaatttcttagcgtgacaacaaaggatcccttgtggctcctggagctagtatcaataatgttttccttaactcaagaggcattttgatgaaatattagcctgggggaagaccaatataatgttatattttgcatgtcactaatgtatacgaaggttatcatccgtatgtattagggattattttgagcttgacaatgtaaagccatatctagcaaatgttgagacgagctcttatagtttgtcaagaccaatgctaagtaaaattttagtgcatatgcatatttgtcaccataatcagaaagtttgcaataagaaataacttatatggcgttcaaacttagtgggatggacatcgtatatttctatgcgctacttgtccatttcatagtatttttctcccattaaactactatggacatttttcatattaattagtaatattcaataagacaaagtggaccatggttgacttgatttatcagttggtaaatcaataagaaatatagaagactaagaggcaaactaagtaagatcttgttaatcttgccatttattggcaaagatgaagctttactaaggggagtgttgcaactccaaatttagtaataacaaagctcatattcctcatcaagggaaataaaattgtctctatatcttacgtatactactcctaaaattttcttgtgtaagtttttgcgagaaatagggatatgcttaatgtcctggtttgagagagtagatgagtaaagattaatggcattaattttgggttgaatcattatgagacatcgtcaaaattatggccttattatttggccacatttctaggggagaataaatgtctcgttaaggtagagacacttcacccgtagaaaatactaacatcgatcattacttagatgataattctctaagaaagtcctcctcatttatgactcatagctcattgaaaaattaaattaaatttgtgtgatcaaagttcattgaaaatcagaaattatgcttccattacataaataataaaatcagtggaaactcatcaagagctccaacaagaaatattattctacctaatttatgtctcctagctccattatgtggatgctaaaataattttgcatctcttactatgtgacttgcagaaataaatatacatacgatagccggatggttttgttgtggaaagacaagtcacatattgggtgcagacttaagaaatccatttgtggacttaatcaagcatcaacaatgctttaaattccactacgtcactagtgaactaagcttaaataagaatgaggtggaaaattatacctgtaatgatggaagcaagatgtcgttaaaactgtgtcattctagttgatgccgcatttacaggggagattggaacatctcatgatatcgagatattctttcctttagattttaatgacgttgtttagccttaagggaaaattcactaagatcagaaattagccaacaagtgattttttttgctatgtttacccataagcgatctttgatttactttaaaagatttaagatactaattgttggcggctgttaagtgccaattttataccgctaacatttgcataaagtctagataataaaacatcatagtgataggtctaaatctcacatatttcacaagtcgtatatttgtatgcaggtgataaacacataagttgggaggagatccagactaaaagtgaaggagaaatctatccatgcaagaatgggcttttaaattaccaaagaaacggcccaaaattgcaagaattggataaggcaggatgaggaggaggcctagaccaggtttggaggccatctggcccagccctggttcggccgaaccctggtgaacggcgttggatctaggttttggtgtggacgctctagatgctctcctaatgacggttgaggggcagttcagacaattcgcatcattccaaccgtcatacctatcctataaatagacttcactttcttcactttcacacacacttccaagcttgagctgaattataagaggctctattgtactatttgtatactagaattaggaagagagtagagtagaagaagtcgaaagaattccggagctgtcagtaatcctctcttatttgttttattctgtttattactctgatatcaatagaattatcttcctgagtaatttagatttatcttgtgagaattatctcttagttcctaaatagcatacgggattattgttcactataatcaactaaaatatagtgattgctttggtgagttataaacactaaagtagatattaattgcttagacgtagtgtttaggtaattgttatccagtaattgccgcgtatcccacagtacgtttgaggtaggtgtagaggtggtgacagcctcaagagcacttaagtcccccctgtccggatacgtagtagagcaacatctgggaacaccggtgtcgagggaagatcctcaatagcggggagtcatgagaccccccatttgtgagttcggccggggcggaggctcgtctctcggaaatcactcgctcctccataagattaccggtaagcttgcacgcagtcggattatacaggttcgggccgctatggagcataacaccctactcctgtgtttgggattatggatgagttttacaaaggtttcttcactccagagagcgcacttgcttcctcacttctggagttcaggttttctgggcgtcgtccctttatctcagtgggtagggtcctccttttatagctcaaggggataccacatgtgccgcctctacctaccctccataggagggggatcccactccactttgggcttccaaccgtaccttctcccggaagctaagcaacaaccggttctcgagtggaacccggcgccgccccccgcctgacacgggggacagccctgtcattccctcataaatgaacgatgacttgcgacagcccttccttgagtgacactcggatgtgacgggtcatacccacccccactccgccgggtacaagggcgacatgaggacatggttgccctatccatcggatgtgacggtgacaggccggtcacagaccgatcacatccgttggacagaggttagctaggcgcgccgcacgtctgcccttaccgcattaaatgcggtgagggacagttggggcatcgcacatttatggctgttcagcctgtgctcccctctcgctctctccctccgccgcgtggcagccgggtgagggcctcggggcgaagccgcgggagagcccgagggggtgacgtcatgccccgaggccccccccccccccccgcgccgggccggatccacgactcgcgtgacgcttgagtagggcagcctgtagagtcacgtggccggagggaaagtaattcccctctacttcacatacccccgggcccatatcttcgacagtagcccccggcgctatatcagatatcgatttcctgggatcattctgacatggcgcctcacgactcctcgagctggggttgtgggcccggcagcgaacccaaaaggatatcaccgcgtggctaggttggcgtgctaaccacaacagcggtttgaccgcctctgacagcgctcatgatgaagatgcttgaggcgcgataaccgggggggtcagtcaaaccacgccttgattctcttgctcgctactccagcggcggtagcggtgacggtttgttcaacttgcgctcatggccgttgcgcactccacctcgagtgtgccactgacaggcgcactaaaggcgggagcggatacaacgagcgacgtgatgagcgggcgcgggatgcgaagagacaaatacgggcgcgaggatcgtgggggcagttatgggggcgtgaaacgaggaggcgagcgcgaatgaggcgaggataaaagggggcggaggcggagactctgccttcttactttcgccaaccgcccactcgtcctttcgcttctcgaaccctaacattctcgccacttcacactgtctcgtgctccacgctctccgccacttctccgccggttgccatggcccaagacaccggcgacgcagtgctcccttcctcccgcatcacggcagacaggcaccttagcctacctcgcaagatcatgccgaacggtgccgtcgtgcgggcgggagagtcatggccgcggccgtgatatccggagcgatccatgcacctcttgtccttcaccatggcgggcttgattccgccgttctccagattcttccatgaggttctggatttctacgaaattcacgccttgcatctcgcacctaatgccgtgatgacgctggccatcttcgcgcatttgtgcgagatgttcattggggtgcgaccgacgatgcggttgttccaggccttcttcatcccgcagctgctgcaaggcgcggtggtggggggatgctacttccagccccgaccaggcacagcgggtcagtacatcgagagccatctccgcaagaaatgggaggactggaagaaggactggttctacaccgcgttgccggaccatccgcgacttcgagttcccgctggccctcccgaaaggtctaccgcatggctagcgacgtcggagctaggcgaggaatacgacgcggtgtgggatcgcctcaggggcctgcggagcctgggcctcacgggggcgatgatctttggtgattacttccgccgccgcatcgcacctctccaggaacgatcccgtggagcgtgggaatacactggtcccaacgaccccatgcggacgcatgtgggcgatcgctgggactggggtgaggaggacacgaagagggtgattcggcgggtgctgggcctagactccgccgagccaacactaatcccagatgggattcttcccctctgctgcaaccgcgaccgggagagcatcctagccgtgatgtcaaccgtcggcgctggcaggagccggtccagctgaggcggcgccagcggtagcgccgtcggcacgggtggcggtggtgcgaccgcgggcgggagccgggccggcggtctaggcggcggtggctcaagggcgcccggatcgagccgcggacccggagacgattccgctggcgaccctattcccggccgccctctcccccgcgtggaggggatgccgagcgcgcaacggaccgttcgccagcgggccacaagcgacctgccgagcccgaggctggacggaaaaagaagcgactccggaagatgcgcgcgagcatttcagcttctacgcgatcctcaggatgagtattgccttcgagatacgcccggatgtcggtcatccacacgaactgacgaggggggttggggttgaccctctcgggccccgaggggcgcgggttgcctagagtcgggtcggagggcgtgtcattggcgtccctcaaagggctcagtcacgccgatggttgtgcgagcctttcctcgaaggtccctgggggagtggggctcgtgccgacgcaacacgcgacaactcgtcagcaattgtgttgtcgcgtcggggcacgtgccggagttaaagtccgtcgaagtggcgttccatgcgccgtacctcgcggacgtacgcttccatttgcgggtcggtgcactgatactctttggatacttgatttacgaccagctgggagtcacccaagaccaggagacggcatgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaagtcctagcacacaagaagacaaacgaaaaaaagcggaagactagggcgacgaccacaggaacttgacggcaggcacgagctagacaccaaagccttcatcatccaggggctcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagtcactcagttgctcaaagctactttgtaaacacggtcctagagctatacaatattattaaccaaggccgtgaacccacacgaacatgtcttaacccaaggcctacgatgattcagaccgaactggcaacccgaccctgggtcccagctagtcccaagccaacccaggccaaccattccacattttagctgttaggcaggttttaagaattaaaacactaacttgggtacattgctcggcttgcccataaccgagggcgcggctattcgaataggttatactctgatcagaggtgtacatctttacacacaagacacatcttcctcacgtgtaaccacgtgccacataccaccacggtatacggacggaagacatgacatagtttccaacccatcctagccataaacaagagtaccgacccaaccccacctacggccggaacccccgggacaggtaggcaggactgagcccctagcagcaggacaccggccctatgccatgacatctcgactaccgggccgcagctcgagtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggaggtgtgaatccaattacacaataatccaaccattccatagtgttcaggtgatatgaatatttccaaagtctagagttgtaaaaccacctaatgttgcctaattaaccagtgaagcatctacctaaattcatactagtggtaccatgagtagagtgtccactagttggggttttgtttaatctagggtgaacaaggtaataatatcaataacaataataaggtcataacaaaggtaaataggcatggctagataaaacagtgataacgcgggatatttaaataaagcgataatgcaataatttaaatcaaaataattttataaactgggattcaatatgttcaaggatgatgtgacttgccttgctcactttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaaaaagacttgaacggtccaattccgagttcaaatggccaagttatggccatttgaagtttatatgctttttaaatgaatatttgcgaatttcttcatttaaactttaatttaaaaagggtttattgcgtcagccgaggggacgggcgcgcggaccgggtccacgggagtggggcccacgcggcagcctcacagtccatggtggaccgggtgcacccgggctcacaccggccggcgccgtgggccccacacgtcagccgcacccgagggcgcgggcggctgacagccgggccccacgcggcagccactcggcgcgcccgagggcggccacgccggggcggtcggcgagaggcggcgcggcggagcggcggccaagagaggggagggaagggggaaaggaggcgacggtccacggctcaccccggggcgacggcggcgactgaggaggcggctggagcggagggaggcgatggcgcggctcgggtcgacggggacggcggcactccggcggtcggcgaccgaaacggagaggcggacgaggtcggcgaggatgcggcgaagccgaaggaggcggcgccgaggtgggaggcggtccggggcgacgacggcggcagaccggagctcggcggcgacggcgaagagagagagcgacggcgcgagctcgattccggcggggagacggtgcggcaaggggcggaaacgggcgagggaggcgcggggagggtttaaataaggttggaagggggagagagcggccggaggggaaggaaaccggcgcaggaggtccggccgccatcaatggcgccggcgagatttgcgggggcaaatccgcccgtttgaacgcgagagagagagagggaaaaatggggggaaagggaaagggaatcacggggagtatttccccccactttattgcacgcggggatggcgggagacggcgggattcacggcggcggcggcgctagggcgcgggggaggcggcgggagcggctggaggaaggggatgacgggtgggccccacccgtcagcgaggatggcgggcgggcctgcccgacagcggcgcgcgcgcggggagaggccgagtgggccgcggggagaggagagagagagaggggggaggagagatgggccgggccggcccaagggagggaagggggacttttagggttttttttataaaatcattttaactttgtttatttcttaataattattatttgtgctctgaaaattccactaaaatttatttatgcattttaggcttttaggaaatttacaaaaatcctctaagccttatttggcttttaactttgcacattttaattgttggaggctttcacacggattttaattattctaggcatcatttaagggatatattttagagtcgttttgggacgtgacacggcaaatgcccattccggctgccgccctcaatcccgcgaggagcccttcatattatgccatgttgttcatggctcggaagtcgagacgaacgatgtatttgagaacatccccgtttggcgaggtcagcgtgactccggcacctgcaccttgaaggttgagggagccatcaaaatgcataacccagtgcccgccgcgaatgtcggcgtttggatcctcttcttctccgggggggaaggggacattggacgaaacaggttcgtccaccggggtccattccgcgatgaagtcagccaggatttgtttcttgatcgcatgccgcggttcaaagtgcagatcgaactcagccagctcgatggcccattttaccacccgtccagtaccctcccggttgtgcaaaatttggccaagagggtatgacgtcactacggaaacccgatgcgcttggaagtaatgacgcaacttccttgaagccatcaagacggcataaagcattttctgggcctgcagataccgggttttcgcatctcaaagtgcctcgctgacaaagtagacgggccgctgcacctttcagcggggccggttcatgttgtcaggggctgatgactcggagcgcgcctgttcggaggtcccggggggatcccggactgcctcgggatcataaggctcggggccacctgccaaagcctccgctcctcccttgggggcctcggggttctcccgggggctggaagctttgggcgctaggccttcgggggacgaggggccatcgcaagccgaaggggcctcccgttcgccttcctcacgctcaactacaagggcggcactcaccacatggggggtcgcggccaagtagagtagcaatggttcctccggtcccggagccaccaagatgggggggaagtgaggtaagctttcagttgattgagagcttgctcagcttcctccgtccatacaaatggcccggagtgcttgaggagcttgaataggggcagcgccctctcacccagcctcgatataaatcgactcagggcggccatgcatccagtgatgcactgtacatccctaagcttgctgggggggcgcatcctctctatcgcgcgtattttctcaggatttgcttctatgcctcgggaagagattagaaaaccgagaagtttgcccgtcggcacgccgaacacacacttatcggggttcagctttacgcgcatggacctaagactatcgaaagtttcggccaggtcctgtagcaacgtgtcctggtggtgcgtctttaccaccagatcatcgacatatgcctctacattgcaccctatctgattacttaaggtaatacgagtcatgcactgaaaagtagggcctgcattcttcaatccaaaaggcatagttgtataacaaaaggtgcccacaggagtaataaaggtggttttttcctcatcttccctagccatacgaatctgatggtaccccgagtatgcatctagaaaacacaaaaggtcgcaccccgcagtggagtcgactatttgatctatgcatggtagagggaagggatctttagggcatgcctagttgaggtcggtgtagtcgatgcacatccgtagcttgccattggccttcgggacgaccaccgggtttgccagccactccggatggatcccctcgcgaatgaaatcagcctccaggagccgtgccacttcctccctgatgaaggcctgccgctccgaggtttgacgccgcactttctgccggacaggtcgcgcatccggccgcacgacaaggtggtgctcaatcacctccctggggaccccgggcatatctgacggcttccatgcgaaaatgtcagaattcgcccgcaggaaggagacgagcgcgccttcctatttggcgtctaaggttccgccaatcttggcggtcttggacggatcgtcgccaagggggatttccttgacgggcaccttgtcagctgaggtgaggcgcttcttggaagcgcgggacgcaaaggcttctggggcctgcggctccgtggccaccaccaggttgtctgcgcgctgctccgcgcatgcgagggcgaccttgacatcaccaaagatggtgatgggactagcaggacccggcatcttcatctggaggtaggcgtagtgggtggcgaccatgaacttcaccaacgcgggtctgcctagaaccgcgttgtagggcagattgaggtccgccacatcgaagtcgatccgcttggtgcggaagttggtggagtcaccgaaggtcaccggaagctctacgtggccaagcggccacgtgtgccctggagtaacgccaatgattgggagcgacggctggagcttcatccccggggccttgagcgcgtcaaaggcagccggggagatgatgctcagactggcccccccatccacctgcacactcttcatcttgacgttgtggatggtcggggagaccaccagggccaacttcccccccccccccccccgagcgagcaccgtcggatggtcgctctggtcgaacgtgagcttcacctccgaccagcgcgccttccggaccgcctcatgcgtgggaacaacggccagaagctctcgcctcatggccttgaagcttcggcgagaggtgtgagcgcaagccccccccccccccccggtcgagcgtggcgacggtcccctgaggtatctggaaatccagatcctcaccatctccgccatcatcggcgggggccttgtccttggcctcctctcgccggtcacctgttgaggtcgcgggggctttgccctcccgtcgaccctgccgcttctcctcatcagcctttcggaaccgctcggccaaattcttgaccgagcagcagtcgacgagactgtggcggtaagtgttgtgtaccgagcaccacttgtccgccgaccggccctcgccggagggaacggtggggctcggcttatcgccggtggcctttcctttccgcggggcccgcgtgggctcgtctgctgcaaggacatggccctcgtcatcggagcgggctggtttccttttgcctctcctatctcgccgcttagagtggggggcagattcgggagtagccgcagctgccgcaccggtgccgggagagttccaggcccacgcctcctccttccgggccaccttgtccgccagctcgaagagctcgatagtagtcttgggctccttggaggcgatcttctccagcatgcgattatgccgcacgccgttccggaatgcatatacaaccgcgtgggcttggatgcacggaatggtgttgcggacctgacagaagcgctgtatgtatgagcggagggactcatcatcctcccgccgtacagcgtgtaggtccgcctcttcccccgggcagggatatgtgccctggaagttcgtaatgaactgctggcacagatcctcccaggagtgaatggagccggggggctgggtcatcaaccagcgacgcgcctgacccttgagtgccatgggaatgtaattcgccatgacccggtcgtcaccccctgccgccacgataaccgtggtgtagatctggaggaactcggagggattgatgctaccatcatacttctccgtaaggttggggcgaaacttcgggggccaccggacattccggagactcgccacaaaggccctacaacccgtcctcccaggggtgagtgtgggaggagggccgcctcgtgaagaagagcatggcgctccagatgaggaggcgccttcccccatacgggcagctcggcgctcgtctcggcgtcgctcgatgttgattcgagcgtcctgcgtcccgtagaggccgtcatgacgcctccggcttcccgaggcccccgacgatgttggaaccgtggaccgtctcgagatcatggccgatcgacgagctcttctcctcgccgacgaggagagggtgaccgaggtacgcgatgtaccagcggcagtggatcgaccacccgtggccaactgtcgctgggcagtagtgaccaagttggccacgtcgtccaaccagcgctgaataggagtctccggccccgggtttaccgggggatgccgcagaagggtgcctactacctgaagcgcgccttggggcgaaccgccgtctccatagtcaagacggcggcgtgccccgacgcgtcgcggcctccctccgccagggggcggagagagagccgaatcacccgaacgagtgggatcctccctccgcgaaggttcgcgacagggaggagttgcagaaccatggcgacggtgacgaggacctcggctctcgccagaaaattaggatggaagaaagcgacttcctctcggaatgcgcaaccgcccctacctggcgcgccagctgtcgagggaagatcctcaatagcggggagtcgtgagaccccccatttgtgagttcggccgggggcggaggctcgtctctcggaaatcactcgctcgtccctaagattaccggcaagcttgcacgcagtcggattatacaggttcgggccgctatggagcgtaacaccctactcctgtgtttgggattatggatgagttttacaaaggtttcttcactccagagagcgcacttgcttcctcacttctggaattcaggttttctgggcgtcgtccctttatctcagtgggcagggtcctccttttatagctcaaggggataccacatgtactgcctctacctaccctccataggagggggatcccactccactttgggcttccaaccgtgctttctcccggaagctaagcaacaaccggttctcgagtgcaacccggcgccgccccccgcctgacacgggggacagccctgtcattccctcataaatgaacgatgacttgcgacagcccttcctcgagtgacgctcggatgtgacgggtcatacccacccccactccgccgggtacaagggcgacatgaggacatggttgccctatccatcggatgtgacggtgacaggccggtcacagacc

SEQ ID NO: 41406 - DNA, 2512 bp, Oryza sativa
cccccccccccccccccccgccgcttccacaactcgcgtgacgcgtgagtgaggccagcctgcagagtgacgtggccggagggaaagtaattcccctctacttcacatacccccgggcccatatctccgacaaccggattgcaagagcttgaagtatcgcgttaggaataatgttaatctttccctagacacggtttctcaccaataaatcctcactatcctagcctatcctttgcttggtgtccttggatgaaccggaggaagaattaatcacacgtgttcccttggattcgatacccttggaatactccgtaggggaagtgctacatcggtatatccgtgcgcttgcggtttctatctgtaattgtaagaaataccaacactaatgctaaaaaaatcaaatgaaattatgagattggaccgtgatggtaaacagtatatgaagcttgctcacctcataagctattaaaattaagcattcatctaaatgattttcaaaccatgtaagatcaattaagaatgtgagtcaaaacaaaataaagaatttaatagaagtttctagatgagtcaaaatagttggccatttgatgggtagataaaattgaagctagactctaatggaaatttcaaacaattcaagtgaggttgaggtggaaaactacatgaaaactaaaggtgggaaaattcattcaccagtactctatgttgatattcgcaagcagtgcatattgttgttagatactaaagaaaattttttcattaaattttgttctaagggagtactaggcttaataagtcatatattgatataaattaaagataatcaattatgatttagctaacgaaagcttaatattaggtcaaactagaaaagtgggcgcgccgttggcacgccatgttaaaaattaatactcctattttgaatatgtttatttagagtatttttatgtgtaggtagacaaactttagtaacttgaaaattgaaatttagactatgagcagtctctctcttttttttctgggtgtttgttcttagacacaaacaaatgctatggtcacaaccctgagttaaaaaataaggcctaggtaagttgctggatagtaagagctagcaatattgcactgtcataaatatatagtatattttaaaccttgaattatattatggtatcttgtactactacataacacaatataagtgtataggtataagcattactactaacactatattagatgtacgcaagagatcttgtactactacataacacaatataagtgtataggtataagcattactactaacactatattagatgtatgcaatagacatcatactgatactgatgtgctaccctgatttctagtcatattttggaatggagggtgtagattctttctagaagtaaaaatcattgaagagacttgctaataggggttgtttggaactctttttattgtcagcttgtcacagtagatggtattttcacaaactccgattcagacgaatgttatttcgcaagtactatttgaagactgaacttttagcgagcttatgcagacaagtgaacgaactaaaaacactgcaaccattataccattacatatggtactacattaggagtattttctagcagcaattgatatgctttcttgggacagtttgtacaaatgccaactacaaaacttcctgcattttcattatgataacaataaatactcaactttcttgggacagtttctgcaaatgccaactacaaaacttcatgcattttcattatgacaacaataaatactcagccacaccatttgcatatcattctctagcataggattaggggctagcaacaaaattgaccaacgcacacccaagtatatacaatggatttgggagtggcttcaactacaccactcccattcatatgggcacttttctcaagctcaaatgtcagccacagccactctccaagagtctgaatggcaacactaactcctttataaatgatagactggggactataatcaatttatacatcacgaaagcagtcctaggccctagctagagtcttgtaaagcatgagctcagctcatctcagaaaatggaagcccgcaagacttattcggcctgtgcttgtttgcaggataagcagacaagcagtacccactgttgaatctgcggcctcacagaaagtaatctggagctggcctctttgcaggaacccctcttgattcctgaatgcacatataggaaaattagatgctaatcaataatgtgtcacagacgtaatgatcaaagtggctaacacatatatgtggggcagcttcaaatacacagaaactcccggttgctcattcatttactcactataattcttaaggctctaaatatcaaacactcgtagcaagagatataagaacaaaaaatggagggtatatgaaatttcttcttgatgaaaacaccagaaccaattaattcttatgatctactccctccgttccataaataaaggga

SEQ ID NO: 41407 - DNA, 18141 bp, Oryza sativa
gcagccctcaaacgttgcaagcaaaaacttaaaatcccttatattatgggacggagggagtactatacaagttagagatttatcttaagtaaaaaaattgaagattcatgaccaattgccaagacaatctgaagacagctctagctaattgtatatatttctgcgagtccacattattaatgtccaataagctagatgatataatttcagtaaactccaagaaacatttaccagctatatagatcaccaggacaaagcctcatgtttggcaaggaaggttaaagaacaagccaaatacagttcgatacataattactaagttttttcaagaagaaactgtatgcactcaacaagtaacatcctatacccatccgatgcaactttaatcactttaagtaggcccatgttgtgataaccactggataatgcaatcaatagctcatacaagacaaaatacctagaacacatcaatttcacaggaattgcataaaaattattatacaccacagcctgaagcaaatcacgtcaatgattctatcataatataggtgttgcagtaaagaggttggggagttcagaaataatcattaaatcgtggtcccggtagtcacagtggcggtggccagtcgctgcgttcatgctctcgcttgagagccctcaccatcgttcctctctcagactgagggagactgcgatcttcagtctgcaactgtttctttgttcctctctccctgcaactgtatcacctgggcagtggcgaaggtgaggaggacggcgggcaggctgagggagaccatggtgaggaggcggtggactgcggcaggccagcagcagtatgaagaggcggaggtggcgagcttgctacggaggcggaggcgcggagcggcggggaactggagtagattggcggcggtgacacagttgaggagaagaaacggcggcggcgactgccgaggcgagagaggagggggttttagcgatttttcaaacaaaccccaaaagcttcacatactacaacgacatccaccacaacgatccctgaccattaatcctccatccaacggctgcaagagggggacgaatgctgcaatctcgccgtgccacgtggaggggctatttgcacgggaatccgcctagatttcaatatttagagatttggatgcatacagatttgacatacattatttacttggaatcttggtagtatttaattaaatccagactggtgaggtaacatgctcatttttttcaaagttttaatggtctctgaagtttagtcatttagacacttatttgtaaaatgtgtagatatttataaagattattaagtttaagttatgtccacatataggggagcaataaccatggaaaaactccaaaataatcttactgcatagttaacgatgcaatttgatttcgtagcatattatgattaatcatatatttaagaatatttcctaaagctaagagtggtaaatagcactcataaaccactcataattatactgcgctatgaactgagcaccaataaaacgcagttttctattcttgtaacaacgtgttgtatgttttctgccgaacacattgataaggttgtgaaagatatcccaggatcgaattattaagctgagcttttactcatggatccatgttttaaatgatcataaactaagtttattttagatatgttatgaccaatacatatgtaaattagagccttaactaatatcctggataaggagaacttaaatttatcaatcaacacccgctaagttaagcttgagtttatttgagtaatatagagaaatataggtttttgttgtctcagtgacgtttgttgcaacacattgccttggaagctatttttttagttgacttgtccgttaatcttaaaatcaagagaagaatgttggttgaatttatcgactagtgtcactgtatatgagaaagaggagaagtggcagcgaggcaataagtagcatatagtgagttggtagcagattgatgtttgggtagcggattgcggatagcgggcgcgattgcagatgctaagttccaatagcaaaattaagaaaaataactataaatttagattgtatatcaatattaacatcaagtccaagttaaaatttaaatttagactacatgtttaattactccaacatttgataacataaaaattatgaaataacatataaatatataagacaaataagacaccgacacttattctatccatatatgaagcacaccatttaaacattatagcgatctaacaaagttaataaacattatagcgatctaacaaagttaataaacattatagcgatctaacaaagttaatatatagcgggctactatagcggtcgcgaagcgatataatggccactaagttccaatacgcatatccgctacttgtagtggtagagatccggtaccgctatagcggccgctataaacactattattaccttaagtggcaggggtgacgtcgaacctctctctaatcctaaaaccttaatacaatcaccccatcgatctctaatcctaaaatcttaatacaaatatacaatcaccccatcgatctaggtactggacgaggtttgtgagccatatctcttgtgtgttttttccttaacaaataagaagaaagaaaaaaaatcgaaggaacaaaagcaaaaccaaacatcgacttcaatggcttcatctttcatctctgataagttagaaccaatttccgcattaagcattggtgaatggtgatcatgtttaggttataggttaagaacaattaagtggattaaactcacctagggttattgtcgcccgtgttgtcaatgtgtttttttcctaacaattattataagcaaatcttagtattaatagcatcgccgtgcccactaattcttttaagtatatatagactcatctgtatgaacttgatttctttctcctgatagaaaatcgatacagtactctagtcccaacaaaagaaaagaaaagaaaagaaaaaaatcacattgacaagctaagatcgagattaggcgcgctgtccaccttcttctccggttggactacttggcttcccttcaactcgaacgcgaagtcctccattacaaacgtcggccgccacagctgctggcgatcctgcttcttctggccaccatccacgctcgtccgcttggtcgcgacacaatcaccgttccgccgccacagctccctcatctccctgacctcgtcgagcagcgcgtagaacctgtccacgtcttcgtcccgcgcctcctcttcgtggccatggccacccccctccggtagcggcgccggcgccgccttgatgttacccgacggcggcgttggcggcggccggtccctcttcctagacctccggtgccgcggctgcaggtgctcctgctccgtcacgatcatctccgccgcggtgctgctgttgcgtggaaaaggggaagtacccgaaatagtatgtggagtgggcatcgtgggatccatgagaccttgagttgagagcgaggcgcgcgttaaataggacaaagcttcgctagctatccctcccttcctgcgtgcggaacgagtttgcgtcaccgctttgccgctttgggcgggcgagcaagcaagtgcggcaccgaccgatggtggtgggcgcgcgtgcaccgtgcgcgatgcggtgcggttggcctatttttatcattatctttttgcgtcggatgctcggaagggggggggggggacctccttacgtacgctgttacgttggctttcctgtaagcggcttacggaagcaacgtcgtccggtctgactcccccccccccctcgcccgtcggtgttaactgtacggtgtcgatcgacatcgatgtcggggatgcttacctgcccgctgactaccatgcgccgttggataggtctcggtgctcacatggttttttttatcccttgtactgctcacatgatcttttttcgctttttaactatacaagatggcgtgatccacagctagcttggtttgggacctttaatttgtatataatagaaaatgttagtcactccgttttatattataaattatttttatttttttcctagttaaacttttgttaagtttgtctaagtttaaaaaaaattggtaatattttaaaaaacaaattagtttcattaaatctagcattcaatatattttgataatgtattttaataatatgtttgttttgtgctaaaaatactactatatttttctataaatttaagttaaacataaagaaatttttcccgcaaaaaaataaagaaatttaacaagaaaaaaaagtgaaaaacgaatatgaaaaaaagaggaacagagaataaacgttgaatcgagattacgcagtgggccaggggcagaatttgtgagcccgtaaaatgtatagtcgtcaatcgcgtacgcggtggccgggttcgatcgcgcgccggcttaaactcgcaactgacgggcaagatcctactgcggtgagccggggggcggcagcgcgccacgcgcgcgggtctcgtgggcctcgtggcgtgggggcgtgacacatgcggcctgacgtacgtccggcaccagcgtgcaagacgtgtgcatcgtactgaaggttgtcgacttgtagttgcccacgtctatgctttcggcgtgctgcagaattgagaatgtcaaatactcgtcttttcaagctgtagtagtaattattcgctgttaacgtcacatctaaaaacagaactgtcaatgagagataaaaaaaaactattcccttcgtccgacgagggcccctttgatttggagaaaaaatgtagaaattttggaggattttaacccaatagaaaaaaaatcctatgaaggccttagaaaaatcatatctaatcctttaaaattcctatgaaacgggtaatcctatacacattttgaagaaaagttagcaagaggtctaacctcttggaacatttcctctgagtctatctgtctcatctgattcctgtgtttttcctatggtccaatcaaacggccattcctgtgtttttcctgtgttttgcaatcctctgtcttacaattgtattcctgtcagaatcctgtgtttttcctattccttcgttttttcattcctacgatttaaaggggccctaaaaagtaaatctaggactacgatatatactagtactatgaatctgtatgtccagattcatattaataggatgtgtcacatccagtactagattggtttttataggatggaggtagtacgaatttacctatgcacttatctatatattaggctgtgttcttcttgctagctttcccaacttaactccctcattttctacgcgcacgttttccaaactgctaactactctcttcatcctataaaaaataaatctaggactatgacatatatatatactagttctatgaatctgtatgtctatattcatattaataggatgtgtcacattcaatactaggttggtttttataggatcgaggtatcacgaattacctatgcacttatctgtgttctttttgctagctttcccaacttaactccctcattttctgcgcgtatgttttctaaactgctaaacatggtgatttttgtaaaaattttctatacgaaagttgctttaaaaaatcacattaatctatttttttacaaaaattgctaatacttaattaatcatgcgttaatgagtcattccgttttgcttgtgagaaggattagtttccaactcactccaaagaaaacagcttagtgtaatataaattaaaatttttattcgatgaaaataatatgattgaatttgcttttaacttattttcatatgattgcccttttattgctaattttggaagactatgctaatttgactatgcgtgtgagaaagtaaagttgaaagactattgagaaagtaaagttgaaagactaattctggagactatgctaatttaactgtaccttatatggttggttagagggaagacaaatttggtctcacattgtagaacaggtagtacaaacatctttaaaagctcgatccggatagagtttcttatatgtcaattttaatataacatatttattagccctaggagaaaaccaaaagttgtataggctttattagggcagtcccaaccctccacctaggatggtgtctatggcattaactacattgctatgtaggacttttaacttacgtggcactatattaattaagagagagagtgaatagaggaagaaactgggtctcatgcaagacaaagcttcaacacgagaacctagacactatcaagttttgcattgggagagaatagtgtcttcataatagatgaagaataaatatgattagtagagaagagagatgatgtatttattaatagcctactttaaaaaactatgggttgtggagtgtagtttctattgtgatgttttattgacatgacaccttagacactacttatgcacactatgggttgagactacccttattactccactccatcaatctttaattggtatctccccatgaaccattcaaactattttcatgacatcattcaagattgttaagaaccctacttgtatttattagctactcatttggcccaccttcttatttgtgcatttttgcaaacgaaaaggtggttatatcaaggttgaaagcccagctcagtttttgctgctgacaaggtccctgaaccagtaggccgacatcttggggtacctcctgagggtcctgaaatccacgtacaccaggccgaacctcgacgtgtacccgagtttccactcgaagttatccagcagggaccaggcgaagtagcctatgcagttggcgccgtcgtcgatcgcctccttcagcttggtgatgtagctcctgtagtaggcgaccctcgtggtgtcatgcaccccctgagcaatggtcacattgccaggatcatccatgcctgaaaaccgaattatgttttgttgtgctgttcttagtgatcacaaaacaatgtgaatgaaaaaggaagttacaaggaaaaaagatgtaccattttcagatagaaacattgtggggttaccatacttctccttgacataggtgacagctttgtacaaaccccacggtacaatgtaaagccagtcagaattcgcctacaagaccaaatggttttcagcgatgcacacaactgaagtactaatcgatatatgattcgtatcagcggtagaaataaccaacagatggcgtacccttggtccaattggcacgccatcgcgttcatctgcagcaccaagagaggcaaaggatatcaggaaattaattgtcatcacaatggaactttcattatttagagaccaaacccttaattttcagtcttggggaccactgaagcataacagtttattaggtagttaagtttttttttttgagagaattaggtagttaagttaagttgaagagatgactcacaaataggtgcagcatgccagtcagacgagtaactagggagagtcgtggcgttcggctgctgatcacggacataataagcagtatactgattaatgccaacatagtcgattgatcccttcaccatgtggacctcatcggccgtgaacttcggaagccgttctttgacaatcacttgcagcgatttagggtattcaccatagatgattgggtgaagaaacctacaaaggtcaatcaacttgtttcagatatgtgcgtagggattttgtatttttgttgtgtaacgtggtgtgatctgtatatatctcatcagttataaagtctaaacagccttaatatcttgccatctaggagcaacatactccggcagtttgcggattcttggcttgaataaagaaaataagaaaaaggttaagaagaagcagaaatgaatttgaagcaaaaataccatccaacgtggaagtctcttgatctttgagccgcagcttggtctgccgttgaattggtaagaccttcataccagacaaaatccagaagaattccaatcttccccttttgtatatgctgaaaagtttgttaagcatttttaggactatttctgaatttcatgctactatttgttttatgggctaactggatccatgtcactataaatgcgctatattagaaaaatgtcattattatttgtgatatcagctgggtgctaccgaagctttataaaattaaaaccatgccatcatcatcacgtattatgtcatcacatagaccaaaatacccttacacgtgaaacccacatgtcagttctatcttcttccaccacccaggcctgactcttgggcggggcaaagagggcgatggcctaggccccgtcctggctaggggcctatgcctaaatatacatgagtactatatgagccaaagtggtatttaagattagtgaataattccgtactatctactactccttgttatctacataatactaattagtgaattaataaagattctagattcaacaatcaaaattgtatgtatagatagattcttgttgataatatatattttcataattttaggtgctgaaaagttgtaattttacttaagaagcatttttatggtgctaagtaaatgggaaaaataaacaagatcagtttaagtgttgatatttttctatttctaagaatatatatatgaaatgttatgaatgattatttctctctaagattagatttgaaaacacactttgaaaatgaagaagttgttcagattgtagccaaaataaatcttaccaaattttggcaatttagcaatattgccaagttttgacgggatttcttatgtatttactatagtttggtaaaaactaaatgaatacatctttaataactttaccaaaaaattgatatggcttgaaatgacatcaatctgaacaaccctaaaaaatgtgaatatacatataacacatctctctataggggagagattgatggttaagggtcatgttgtcaagtttgccctagggccctcaaaattgtagagccagccctgcctccaccctctcctcttctgtcctcccaccacccacattccccagtcgtcctcatggagcacgcggctggggagcacacatggtccatcctcgccgagcgtgagagtgggcggcctccctatccctaaagctcgctgaggaggacaagaaaagaagagaaggaagaagatggaggaaagaaaagaacatgacaacaaacataacggtagtagtatgattttaattttataaaattttagttgcacctaactaaaattgcaaatagtaataatatttttctaatatggcatatttgtaatggtatggatccaatttaccctagttttatatctctagtggtacacttttacatatgtaaagagctaacaaaatggtcacttgttttctcataatttttttaaaatcacccataaaaagaccacaaaccggtgactgtttttacctgatacttgtgccggtatctctgaacagcagaagcatgggaaagaatgaggtgatgggcaacaatgtaaggctcggtggcagagtttccagccgtgcattttgtgcaccttcctggagcaaaatttccatcatcgtatcctagagcggcaacaactctcggttcgttaaatgtcatccagttcttcactctgtcgccaaatgtcttgaagcaaaactcagcgtagtctgcgaatgcttccctgcgtgattcaaaaacaaaccagtagatacatatattggatcatcttgatctacagtttcaggaatgcacaatctgctgctgcatggtgattgttaaaaaaacaatgtatgagaaaaaaattattgagagttgccattggaactcctgtactttgcaggattttgagcggcagttgtatctgatcttttgctagtatgaatatataccacaaggatctgcaattccgatgatagtaacttcatttttctataaaattcaaatattgataaaaaaaattatggtgaactatcccgttggttccaatgagtgtctaaaaattgttcagaaaaacgaacgtactgctgcatagcttgagaagagaacagtcacatgtcaatgtataagtatttggatcaaccttagtcttgaatctaacaaagcaatacttacactatttttctgttcaacagtcctccatattgcacctctagtgcctctggtaagtcatagtgatacaaattggcataaggtgtaatgcctgttaagcagcagagcaacgttcagctttagaattgaaacatgtgccacgtatcagatgattttcattttcatttttatttttttgcgggtgaatatcaaatgaaacattaacagtacgtggcatacctatcttcagcatatagtttatcaatctgttatagtatgccacacctttccaatttactttcccagttccagctaggacagtgaacacccatccaagagaaatataagttagtttgcatcactttcagaaatcaagtccaaaataataaaattgtactcgtagattaagacgagcaacttaagggagcttacttgggaatattcttgaccatgagattgagaagcggtacgcatcgaaacccatacttttcatgatgtttacgtcctcctgcaagagcaaagccaagtttaattctctgctctcaggtcatctgttttattctatagttcccggaatcaggagtacaagcgaatgaataaattccatgcttgtctgatagaccaattattaggtaccacttctaaaaaacgatttttccggacacattggtttcattttttcagttggatctaaagaatttcacttctaaaaataatgagaggcctgaagatttaaccccgctagtaaaagttgacttttaaaaggcggggtttaaaaacgactgccatgaaaaatacccttattttcgctgacaatactctttataacacgcatgtgaaaattaaaaaatccatctgcaaaagagcaggaatgctattaaataacagcaacgacagtagaggggacaacagtaatgtctctcccactcacctccctctactcgatctggtcggcgggtggtggcgacggaagcagttgaggggtggctccgacagcggctccaggtgcctattttctaaaatttttatgatttttcgcctaaaataatcacagcaggcggtcttcttaacatggtcacatgtgaaaatcgatttttcataggtgttctacttaagagaccagcatgtaaaattcaattcacgtgcggtttgtgcagccagtagtgaaaatttatcgttactagtggttgctctaatctcttgcgaaaaatgaaattgaccgccagcgattgcttgttttgtcgtagtgtactaagtgcaaggggtagtgtagtgataagcaaaccttatataaggaaaagcataagattatgttcctaaatgtacaatcagcatgacaacagaccaaaatttccaaatctacaattgatgtttgatttatacaagataagtttcggttcagtttgactttgcgttgttcttctagcaaatcatgcaaaagttgaatatgttcataattaaagcaagcctttcaaaccttaatataagagaaatttcaagcatgaaacaaaagtcgcataccaaatttatgaaatgtcaaataagccagataatactataatttctcaccatgatgaaaaaggtacggtgtatatatgatgtatgcttaatactatggaatataggtgagattgaactttcttttggaaaacaatgtggttgaatgtttattgtgaaaaataatcataaaacatttagatcggttagaatcataaagagaatcatagaaacagaaaataagttgcacgtcatctcaaaggaaaacgtgtatactgtggtgttttcagctatctgtttttacttttccctgaatggtacgaatctgttatcgttgaaatcatgacgtgtgtgtagcccttctaccttgccatccaggataccgtactcttcacaagagattcttttgatcactatgaagtagtccattacaaaaaaagatagaacacccacaaaaatatcaagagcgagaaatgcattttgtcggtgatatgggcccgggggtatcaggtttagagggaggaggctgccccctgatgccacgtggccctcccccgaggggagtcaggcctgaggtagggtggcggccactccttccccaaagactagtcggaggaggctgccccccgatgccacgtggccctcccccgaggggagtcaggcccgaggtaggacggcggccactccttcccagagactggatggaggaggctaccctccaatgccacgtggcccttccccgaggggggtcgggctcgaggtagggcggcggccactccctggctgagactagagggagaaggccgccccaggcgccaagtggctcccccctgaggggggatcgggcccgaggtcgggcggcggccgccccctcccgtgactaggggtcgggctcccccgaccccctctctaggtcaccacgtatggtgggttaggtgtccgcctccaggtgcccacctacccgcatttatggcgtcccgagtggtgcggcgtgcagtgcactcaaccggtctgtgaccagtcgaatgaccgatgggactggctagtgcgcctgtgcgctgctcgtgtgtcaggcggcgtgcagcctgacatgtcccatcaaatagtgatggtgagaggttctcatcctcttatcccagccggagtcggtcctcccgctctggtcaaagcaaggctcccgtttcccggtgtaataggagcccagaagtcttcacccattaaatggtgactgacaggggcaaccccccgtgtcaggtggcaagatttgacaggccccatcatcaagacgacgtgtgcttggcttcccaagtcaagagacaagacatacatttaatgcaaagattataatacttctccaccggagctaggttaggttgttgggcccatgtggtaaccccttgaggtataaaaggaggtccaggcctagtggtgggggggggggacttccgagcgaactggcgcttgggtctcgcaaccccaagcacttgtgttctacattcaatcaatcatgcacaggagtagagtattacgcttcttagcggcccgaacctgtataaacctcttttgtctcatcgtcttagaggggcctaactccctcaggatcacacagctccgctcatcaagccctcgaatctcacccgctgcccccggccgaactcacaatggggggccttacagttccctggtggaggagttcattctccgacacatttgtagtttgaaatcctccattgccagcccccctagcttcttcagcttgttccaaaagccagaagcttaaaaagaagcccaaattattgtacaatctcaagaagctagtcttggaaatgaaccctattgttcactccgtctcattttaagtgcagccatgagtttccgaatccaactttaaccgtttgttttatttgaaattttttttgaaaagaaataaaaaacataaatcacgcaaagcactattcatgtttcatcatctgataataataaaaatattaatcataattttttttaaataagacggacgataaaagttagacacgaaaactcatgctgcatttaaaatggggcgaaaggagtataaaataggaatgatgttttggacttttcaaagtcaacaagctaggtacaactttgactatttaactcttttgcataaataagaaaaaaaaagttataaaggtgtgataactaatttgaaagtttttgttacgacgcacttggctttaaacaatacttcgttgttaaaattaacttttcttgaccgcccggataccataacattattcttttgtgactggaggtaagcattttaccttgtagcgatggtactcatcaacagtaacatctgccgtagcattatttgctatttcacctggtcagaaaaataagcaaactctagtcagtctttacaccacgactcacaaggtcgcatgtacacgtatataggattagaggcgctctttgctctgttgttcttcgatcgttctccctttttctgaacaaaaagaaatgttatacgtgttctaacactaagcatgattcatgtacttaagggtaattcaatacggttcagtctgtcctatttatagggcagaaatgtcataataccagtgttatatgccttctacaccttttattttaaaagaaccacacgttccgttccctttgtttcatattacagctttataagtcccttgtaagtcaaatctcttttcaaatatgattaattttataaaaagatagcaacgtctataacaccaaattagttttattatattcattgtggaatatgtttatagtatatttaccatgtgttgaaaatatcgatatatttttttatataaatttggttaaactagaatagatttgacttcaacaaatttaaaataacttataatacaaaaataatataaaacagagggagtttttaacttgtttgttctaagctctgtaatcagttttgataacagaactgttgccactgtacatatatccttgtgagtgaagtgaagatgatcctaaatttaacgtagggggctcctgcatatatgcagcttagagcttgtttagagcttgtttagagcttgtttattttgaatgccaaaattttggcaagatattaacgttgtcaaaattttagcagaatttctcatatattaaccaaatttaccaacaaagtaaatatagatttttttttgataaaaatagcatcaaaatgaacggttccttaatttgctcaccgggagtcttgacgaaggcgtcccaaatgctagggccgcggccatccttgagcgccatgccctccacctggtacgccgacgccgccgtcccgaacacgaaccccgccgggaagctccgccggctcagcccgcccgtgatcccggccgcctcctgatgatcggcgccggcgccgccgcgaatgccgtcttcgcccgcagcttgctccgccgcgcgcgcggctccagctactaataaggccagcagaagcacaacgacgaggcggtggcccatggttaactgctctgccgcactgtgaccgccggagaccggagtgccggtgctgcacggtgtgcgcgcggcgcccgccggctaactagctagagaagaagaagaagaggaggagcgagcgcgagtgctcgctgtgtgggcctgtggcgtagacgtagtataatggatagctcagctgttttcggccattatagggggccatacgcgcgttagacggagatggttgtcagcacccggcgccctcagtttgtaccatatgtagcgtgggccggacggggacgaagctaccgtagccagcggtgcacgcgtcagggcaaaacgggtaacgacgcgcgcaagtactgcttagctgctgcctgccttcctctcgtcgtcacgcgcgcgccactcatacatgccgcttatagtctctttcttttctttttttacttcgctgtctttttgtttcttttcttaaaaaaattacacagtacaatggagacactcattacacacacgcagtcacccctataaacgcacgcacgcaaaccctacacctatgagcatcttctaagattggaccggcaaatccttcgggattaacgaagtcaccacaggcgcattgctgtcgacgggtacgtcgcctaccactgaaagcacaacaccgttaaatcctgaaaaatttgctcccatgaggagtcaaacccaggaactcaagtgctactgaggctcttgtaaccactaggctacatgtgtttagagaacggcaagagttatgcatgcatttttctttataaaaaatatagtatcttcgaaagacttagccggtatattttgagattgacgaaatcatcataaacgtctcgtcgtatataaagaatagtgagttgtaaattaacacgagtacccgtaagtttagaacttgaatatgaatggattggtttaaaaaaaaagccaattgaggctttgttaagaaaaaaaatgtatttttcattttaaaaataaagcttcgcaacaaaaatataattttatttgttttaatacttaatagaattttttttgtcaaccttttaatctaacttttataaatattaattttttaaaaactcttatcccatgcggtggaaattgaggtggcaaagaaaaggttgcacccacggttaaattccgtggtaattcagggattcgcgatgtcaataatcatggtggtgcgtggcatattaaatcgctattgtcgcacaataggaaatctgctattgtccttgtcaaagcaacattgaactgcggtctcgtaggattatttccatgtgcctttgccttctcaacctatatagtttatcttttaaagagtaaattgtattgatattacacaaacttgtcaagtgagttcactttagtacacgaacttataaaatattcgttttggtgtatgaagttatctgatacatgcaaaacaaggctaaaaggatgtcacaaccattttttaacaagttagatgttgattaggatgtgatgtgcacacacgagatgaacatgatttcagcgtccttcgcatcatttttcggtttttaatgttcttctccgtgtaatcttttgaccttattaaatatttatatatatatatatatatatatatatatatatatatatatatatatatataggacactcatatggggcaccatggtgcccgggcaccatggtatctaatgcacaaaatcactcaaattttttaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaacgttaatacctaggtaattgaaaaagtttcatacttatttgaattgggtatatactcaatttcaacaatggtgcccgggcaccatggagcaccaaacaaatttactatatatatatatatatatatatatatatatatatatatatatatatatatatatatatatatatatatatatatatatatatatatgtgtgtgtgtgtgtgtgtgtgtgtgtgtgtgtgtgtgtacgtagcattcttcttatatacgtgtttatgtagaatcttaattaacacataattagtaagtgtagtcttgttttgttcttttgatcttagttggtacgcacctaataaatttgtatatcaaaatgagtattttacaaaatttgtatatcaaaatgagtattttataaatttatgtaccaagtaccttgatgtactacttgataaatattagatggtttgtatgtaattgaaaaggccaagtatcttgctcttttttttctacactgacggattagcaatcagtgccatgcagagttttccggagacgtcgggagcactgcgcaaaactaatgaagatccggtaaatattttaaaaaatattttttcttttaactttgtcaatgtattcggtggtttttgttacgacacccaacggtaagccaggtaccaaaaacggtaacaaacccggctgccatgcgacagcttcttggttcttgtctcgggttggtttgattttgctgagcttcacgtgtggtgtggtgtcgggtgttaggtttacgatcccaataccgttcaaaaactatacaatgataaactggtaaaaccgataaaatccaaataaatcttgttaaaaatctaaaatgcagtttttttttttttgaaaatgaccggaaaaaccgagcatttgtgtttatgacccggacaggtttccaccgtaccagaactgtaaacactggtcagcgtaccggatctgtaaacaccggtctgatgtctgcgggatagcgctgaagaaagttggacccactcgtctcctgcgctagtccgaccaaaggccaatgtcctttacattttttaatgtgtgtcctatcttgaccaaatcatgcttattaacgtat

SEQ ID NO: 41408 - DNA, 18849 bp, Oryza sativa
gaataagacgagtggtcaagcagtataagcaaaaagtcaaaatcccttatattatgggatggagggagtatctcacattatgttttggatgttatgtagaaaccatgtctcatgcaagacatgttttcttctctttcctcatttattcatttgccacatcatttttcatactaggtagcagcttatttaatgctatggacaccatcctaatcattgggttggaaatgacctaataccactggtgtttcctgacaaatgaatttttttcttcgttaaatatttgggattttgcacatcctgcatgatttccaagaccatcaagttcacatggatccaaatcatgaatatgttaataataagtagcattaaatttaagtatggaatagcggggcttgatttgaaagattagtgtttagtactagtttcttgatgatgtagagtttatggaaatttctagtgtcttgggttgggaatggccttacgtgaagtcatggatgcacacaaaggaataaatcctagtgcccaccaagaactacactcaggtttttaatattgatgcccacgaatattactcgttctaaaaagagacggagactaacgtcaatttcctgccaaacaatttattatacgaaaagaagcaatctgcagttgctacgtttgaaattgcttccaacacaaagtaaccacggtgaaagctgaaacaaccaccatatcgatttgtttatagagtgcatatacataacataagagaacaatctaggcagtgttgtaatataacttgctgggttttctctctttctttttaagtatggcaattggcaagaacaataataattcagccaacataatggcagaatgaaagcaatgtacactggaaatcgccatgagttattgcattggaagaacgtgttcttgcagtccataaaattaaggagcgctacagctacttgacattctttttctactactgccagactacattaagcttcacaatgtgtaataacctgatgaagggaacccaaagttgtgcattgtaagctaacatatcatgccaagctatgttcgaccgtagaacaatggtaactgtgtgacctggcagacgtacctcaagctgttgagatctccttgaacttcccatcgtctccacttgcactgccattaccattttgaataagcttctcctctgaaggtagatttttcatgatttttctagttggtcctgaagcattccataagtaccacacacgcgattttggaggtggcacagctcctgccaaaggagcaaccaaccccggcttcccttcatctataacgctgtcaactatgccataatccttggcttcccaaggactcatgaaatagtcaaactttgtatcctcatcaatctaaaataaacagcatgcagtagatcagagaacagcaaacttttgtgctaaagcaatacatcagtaacaagttgtcaaggagtacctgctcttcaggcttcccggtgattcttgacagtattttgttgatctttatcttctcatacatcatctctcgtatctgtaatcccatctctgtgacctgccagatggcacaaattaacatattctattgaaaaaaaaaggatgacccatttctgaaagtagcattgcatttcatggtagcacatatattgccatagggcacaatggtcagaaattaagccaaccgagaattattcttttcaaaaagcaatattgatagttatgattttagtcttaatatgatattatcatataaaatggaggttatgattttatttcaggagtgtttggttgaagccaaagcttccaattgtttcccacgattccttaggcaatttccgagcaagttcgtctagtaaaagagttaaacaacataaaaaagcttaccttcccaccagcaccccctgatggttgatggatcataattctcgcattaggcatgcaaaatctcttcccctttgtcccagcagctagcaaaaatgcacccatggaagccgccagtccaaagcagacagttgatatatcagccttgcaaaatttcatggcatcataaactcccattcctgtatattgatgtgggcatgtttattgcatcatacgataccagtatggcagcattaacacaaaactaaatatttctctggtgatcggcataaaagttatcaagaataattgtacattcaggaacatgagtccagttcagtttaggcagttggactttaaaaactcaagtacaaagagcctaaaacggtaaggggcttaaaagggtcaaatataaaagaaacagagctgattgaactgactaggttttggtgaacttgagtgaagcagattgggaagacagtaaaagatttaagccactatattggaattatgttacaagatggattcactttcatatttcagtaaatattctagatgttttgagatattctgcaatttattcccaagtttgcatggattggtgataacgaactgataagattgggttcatatcagaattaaacatgtacagcaatgtggcacaaacagtgaacagcccccagtgtctcctaaaggcataaggtttatcaaacacaggttatataatatataaaatcatgattttcatggagatattgcacaacatgcataagatccaatctaaggtgctgaacctgaaaccatttatcactgttactgttgagctcggcactgtacactgttcactcatgaacaatctcaggaaagttaaagttgttctattgctgacattaaagcgctttagaatgattatgaatgcagatcctaggtataaaaaagagactccacaaaaagcatgtgtaaatcttgaaacgaaaaaagagaacagattattaaacttcaggtttaattttcttgtatttgatgaacttgtacagcaccttttcagtatgtatgaatttggtaaatgcatcagcaaaaagtatgcagcataagacttcactagagagaaaataggagcttttttcaaattcctaatgttggagcacgcatttccttatatgcaaaacatcgtattgcatataattggcttggatagttatcaagttgatgccattatcatgtagcataaaacttatcattttgttattgccagattatcatcagcatatttgacacaccaaagattaaaaggacaggtaaagaataagaaatcaaaattatgcagaaaatataaattaactaaacaaaaatcaaaatacagtccatcagttctacatttcatgtgcatgtttagtgtttctattacacaagacctgtccaacgaaaaaagtgagtatagttatttttcgatttctgaaccatggctgtggtttaaaagttctatcagagaagttgaacttgaattgatttcgttaactaattcttgattcattcccataatctatgtgcactgagtggtatgtcacatgcaccatttagagctcacaagatttcactcatgtgttttcacaaggtttcgctggaatttcagaacaccccgtgatgcaaagtgaaatttatttcaacatatcctggtgcaaaacatggcataaaacgaaacaaagcgatcttcaacatgagtaaagtgcaattttctccaagtaatataaagaactcataggcagatatgtagaccagagacatttgtaactgaatgcatcaccaatgccgcataacccaatcagataagaggccagtttattatatacaaggacccttaaattgacacagcaaaatgccaaaaccaacactactttatatgccactgccttttgaaaaatcaaaatcttacccttctatctacttgctactattgtaaattccatttgattaccaatgtaaggggaatggtatctgcgtattcttcctcaaaattagcaagaaaatcttctttttaaagtcaactcggccaaacagccaaccttggtcctgttaatcagcgagcttggtatcataaatcagttcattcacatgtaaacttgttattctttctgttttgcagccaccttagaatccactagattaagggcacaaagacacattatacctgagccaatcaatgataaaactgaactcttcccaccccaaaaggaaaagaaaagaaaagaaaaagaaactcggaactcatcatctaccacaataacaggatgaactgatgccctccattggagaggaagaagaaagatgtaggacagaatgtcatgtgcggctggccaaataaaaaagagggtatatagtatagtcaggacaaaatgatctttgcacagctccatcactgcttgactaacagaaattgggaaataatagcgaataaggtaaaggctcttgataaaaaagaaggcaaaatttggatagtcagggcaaaatgatctttgcacagtttcattactgtttgactaacagaaatcaggaaatagtagcaaaaaaggtaaaggttcttaaaaatcattggcatttaaggttagataaatcttgtagtgttacagcaaaggatccaaaacttttcatcaaatataatctgcaaggcatttacgttacaagatacttaaaatgaagttagtcaatttctctctatcaacacaaagagcacaaggcacaagttattacaataagaggttgagaacacatacctgctgttatggagcctccaggtgagttaataaacaatttgatgtccttagttttatcctcagcatccagcagcaagagttggctgatgataagatcagcactcatatcatccacctagtcagcacaaggcattgaaaacaatagatacattattttgcacagtcagttatggcataataaaagtgctatttattacacagaacaaatattttcatttgtgtacacaatacagtgacatgaaatttgttcagagaacagtaccatgaaggtgaagcatagtgcttgatcagtgggcaaatcattaataaaccgtcagattgtaatgtcaagaaaacatgatataacaagaatgtgttagttcaaacagaaaaaagtgttccctgaagtcacttctgctaattattcctaccaaaataatatggcccatacaacaaggaaaagaaagtaaaacgacatacgactcaggaaagagtttgattctgaccctaaccatctcaagcatttaggctgtgttcggagctccaagttcccaaccactctccctcgttttccgcgcacacgcttttcaaaatgctaaacggtgcgttttttgcaaaaaaatttctatacgaaagttgcttaaaaaaattcaaattaatccatttaaaaaaaaatagctaatacttaattaatcacgcgctaatgaaccgctccgttttccgtgcggggagatgggtttccaaccccagtatccaaacacagccttagtttgttcaagaagatgcaacattaccaaggtgacatctaatcattcaacaaacagcactcatgtaaatgtaattctcagcatgaaagattcttgattcacaaggttggcaaaaaggaaacaaaatatatcccatttacatatcttatgcacattctgagctagaaaaagtattaagaaaaaaaaaatcaagatgggaacaactagaacaatttggacaacagcaacaacagaatatcacataatgtatactagagggtgatcatagcatgccatataaaatcttggatgcccattaagtgttactaaaatgcttctagttctttgcaaactacataagtttgagacaacataagtttatataagtcaatacacttttaccacacgcatataagaagccataatcctcaaggaaacaaatatgtgacaatgggcataccaaagaacatattgggctacattttggttgacataattgaattgcaaatctttcttattcctaaactagtgcatttcgttttttttaaaaaaaaatggcgaggaaattacacttaacttttttcacaccataaaattcgcaaacatttcgatattaataattgaacaagaactgcttaatgggtaataacaacacacacagtgcgatttgggggggggaagaagaaaaggctaaccggggagccgaggaagacgatgcgctggcgaaggagcatgttggtggtgtccagctcctcgaggcgcggcttccttgccgcaggccgagccgccgacggcccgggaagttcccacgcggaggagagcgtccgccgtgccgccgacgccgatgcgcggaccgtagctcttggcgccgccttccagcagcacgggttgggagcgaggaaaagggacgacggggacgaggaggatgagcagggagaagcggggagggccgccatggctgccgctgcctccatttcttggctcgcggctgcttctgctgctgctgcctgctagtgtgtgttatcctgcgcaggggtttggagaaggaacagattggggacgagaagatggggcccagatgccagcggctcgcaagacttgtactactccatactcataaaagtgacaatgtttaagtcaaacgttaataactatcaagttgttgttgagtttaaaaatataaaaattatatgtatagatttgtattgaaaaatactttcataaaagtatacatatatcacttttcaataaatatttttatagaaataagaagtcaaagttgtgttttggagatcgtgtcgctgtcctaaacgacttcctttatgagtatggagggagtacagtgcagtgagaaatgagacaactctatcccctaaggtccctcaacttgtcatcgggatacgaaccgtaaaactagatatgcgggatccctcaactatataaaaccggtcacccgaggtcccttggtggttttcaacccggttttgtccgacgtgatagctgagtcagcatgggacccacatgggccccacatgtcagctggccacgtcataccctctcccctcctctccttttctcctctctctctcactcttctcgtctgggtaggcactagtcaactagggaggacggcggcggctactgccttcggcggcggctactgccttcggcggggagaggtgggagaggacgagggcgtcggtggccggcgacaggcgacacgacggtggtgactagcgactggcgacgctctgccgccactgctctcgcctgccgttgctgaggccgcaagcgcgaaggcgcatgctcctagacttagcccatatccgtgaatgacacgatcacgacgtattatgcatatccacggttttgatttatcagctaaataagcttgcttatcgatcaaattaaagagataagctggggttttgatttatctgaacgacttctgctggtcatgcgtgcggaggaaaaggcagttccaaacccggcaacataggaacaagttaaattattgtcaccggactatggcacagcaacaaaacgaactaacaaatcaagtttatctctatctattgcttcttatctgcaggaaaatcggaggaggtcgctccagcgtatcgcaacggcggacacgcggtgtgcggcgcggcaccgacctcgtagacgttattttccaccttaaacaaggacgtagtcggtgagcgagaagacgcgcgtgcgcttcggcgccgctgcccaggttcgccatggcttgcagaccgatcgtgttttttcattcaaaacgaaagcaggagggaggaagagagggatggctgggggttaccttttggtgagacgagggagcgtcggcacctctggtgtcgtcatcgtcgccgccgcgccggagaagagggagacggggggttggatttggaggcaaaggaaaaggggctattggagggagtcggaacgaatcgaggctgccgccgtgctccccttctccctcgtcgccgtgtttcccagctgcagctaccgcctccgggcgccggccaccgtcgcgtcaccggccaccgagcgccaccctcctctctcccgcctcgcttgctggcctcccgccgctttgcctcgcccagaaagagagaagaggagaaagaggagggtgatgacgtggattacgctgacatgtggggaccacgtgggtcccacactgactcagccgtcacgtagactgaaaccggagtcaaaaccgttgacggatcttttgtgatcggtttttattagttaagagacgcgggatatctggttttgcggtttgaggatgattttgtatctcgataacaagttgagggaccttgggtgtactttttccattgctaaaacactgtcgcaggctcaaaatccggtccacaccaatggattgggccattggggttgaggcccatccaaacgataatcatacttgggatttttaaaatttttcttttttattaaaatattaaaaatataatttttgtttgacaaattaaatatctagaggaaaaaatcacccttccatatagcgttaaggggtctaaatgtaaattttttaatttatatacagactcgttttaattgctcaaacatttttagaatagtgtcaagtcaaacatttttaactttgactattaatagaaaaaaataaaaatgatctatcatgtaaaattgatgttattatatatttatcattaaacaaattattataattgtgggttgtcatttgaagcttgttactcatggagagtgatctcatagacggttggtgtcacccacaagtttccgtcaaggttgtgaattgacccgggcaagtttgtgaaagtattcctcacctccacaagggaacgaggtaagtgagtaaaaaaagttgtgctgaggtctcagaggtagccctagtagagcaatcctcacttttagttatctctagaaggttctgttggatcttggtggtcactcgacttatagagaaggacctaggagtgttagattgaaggttgtggtcctcttctttgatctttgcacaagtgaggcaaggtgttaatctcaacggcgagtaggatccgtgtgattcgaacttggggaaaaaaaattctgtctcttttgtgaatgctctgtgcttgcccttatgttctatatactcctctagtctactgtgaatcatattggttgaatagggcctaaagttctttttgatttggagttgtttctatgttttcatagttaccctttgaactttaaaagttccgggctaccttgagctaccagaaagtttcggtgttcatcaccagaaagttttgggccctgtttaaatttaaccgttgcgattatttttagtgtttttaaggaaaacctattcactccctcattagactacatcttcagctttcacttccttatctctctctctccttcctttctcttttctctcttctccggcgaggcgtgcgagccgtgagcggtggcgtgaccagcaggcagagtgcacggtgatgatagaggtggcgcactgtgatgacaaggtcttaggacggcatcgtgtgtctctccactagatggccctccccaagtcaccatcaccccgatccactcggctcgccatcgacatcaccgactcggatggtcccatgcgacgccgtaatcagatatgttcacaacatgcccgacccaacgtcgacgaatgtgcacccgatctaacgccagcgaatcgcaatggctgtgcccaacgcccaatccgaagaaatctgctcgcatgggccgtccccgactccagatcagttgctctcatccgttgccaccatcgtcacatttgctcgcgccattgtcgtggacggcacattgctcattgctacccttatgctgtttttttccttttaatgcattttttactccaaattcatcaattgtatgtaattttaccaattcatcaattatgtgtaatatttttactcaagattgaacaatggtgtttgtttgttgtcgggggaagagagaaaagagaggaggagaaaggaagaggatgaggaggaagagaacatgagccacatgcagctagcctaagcaaaacatacatgggtaattttgatcatgccatgtaaaaaagtggacccctcttgcctcgttagcatgaaaatattaatttaatgggcatggtgtctcatgacaaataactacatttctagtgtgctcctctaaaagtgacatttgtgtgttgtactatagctaaaaccacaaagtcgcgatgtcctatagcaaaatttgtcaaaataaaaaaatcaatcctttcttgctgatatgggcaaattggtcttatctgtctacagcttacgagttaaagatttgctccggtccaacaaaaaatgcaacaaaattgtttccgatcgttggatctcacagtgtccatcctgcccagttagatcaaacgatccgaaatgatttagtaccgtgaagtactggtacattgaaatattttttactagaccggagcaaatctgtacgggttaatatgtacatggagttagctggtcgtgttgatgcaacaataattttagaacaggggccattttcccgtgctcaaaaagataagatgagatgttcccgttccaaactagacaaaagatgtgattaggtagaaggccacacagtacatgacactgacagggattttttattcatatcatcatagagagcttacctagcggttcaaccaaacaattgattgattaaccccgccccttcacccggcctagctaccgctccaaaaaagaccaattcaatcgacaacagacgtgtcgtttctagttcgtacacgtaatcacaattcagaacacgtagccacagctctagctttcactctctttatgcaactattttagtaataatccaaaacaaagcacgtagtactacataacatatggccataatatacacagtagctagacacctcatctctatgcaggcttaacgcagtagtacacatcaaccaagcaagctagctaattaagcaagcatgttgccggccggccggagaagtcgccggagttgtagtatatatatggattattggttttacatgatggagcaggagtcgacgttctcgtcgctgaacatggtcatgtagcggacctcgggggcggaggggtcggccatggcggcggggttgccgcggacgaagccggcgggggccttcttgtcgtaggcgccgccgacgtacgggtaggtggtcatggtgtacgggacgtagggccacatctccgccgccttcccggtgctcttcacgcgctccagcaccttgctcgcctccacgtacccggtcaccgtgcaccggctctgcttcgggttcaccgccacgctcgtcacccctcgcatcgacttcaccgcgttcttcaccctcctctcgcacccctcgcagtccatcttcaccttgatgttcaccgtctacacacacatattgtataagcaaaaacacatcaccaaattaattaatgaagaagcacaagaacttcacaaattaatttatctctgtgcttaattagccaacgaaatttgagcaaacatgcatgcatgtagtatatataaatcgatcaagatcgagaaaattaaaacacctgcagtggccgcttcttccttagcttgagggcttccttggtctctgtcaggctgcacatatcagagaggctgtccaatacacccatggttgctctctgttactgcaccggcaacctgatcttgctcgcaacaagctagctagctatggaaagagtaagctaggctaattatttgctgcttgaatcaatcgagtgagaaagagagtacttggtatagctcgtgggtgcagaattgtgggggaagccgggaaggaccatttatatagagagagaaagtttcaccctttgtaagcaaaaaaaaatttaaaaaaaaggaaaaaggaataagaagaagaggagaggatggatcatttatacgtacagtgtggctggcactcactggctggctgattttgtatggttaggatggatgccaggtttttcttcttattttgttggtatggtcgcctcgtattgatgcttgaaggttacactaaacgattgggagaaccactgagccttcaaattaaatggctgagttgggaaaaacatgatatccttcctgctggtgcctggatggcgggttcacatcctctgccattaaggccaaaggcaaagtttgccgttgctgtcatccatctcttattctaagagaaaattagaaccatgccattataaatttgtaaaatttgagatatgtcatcttaacccacatgtcattaactcatgtgggtcctacatgtcattgagataccgatgacatatctcaaactttacaaaattataatggcatggttccaatttactccttattctacggctctgcatgtttttcccaacttcaaaattgattaacagccaattaattaatgaaatcagttgtgctggaccaatttaaaagacaattgattgattgttggtattgctacacgtacttaaaaaatcctcacaaaacttccggctaccttttaatttaactatttctagaaatctatatttgctcacaccatgtcaaatatgtgtttataaaagttttataagagcgctttttcctatagccttttctaaggaatagctgtgcctattacttttcttttgtcaaaacaacaaaaatatagtcttgtacaatgaaattttcattgttcccctgaatgaatcgataccaatggttcaaaaagtgaagagtgtgtcgctagtttttttttcctgctttgcctctggcgattgttttctttacatttctgtagagtaaattctaccaaattagctggtagtaagtcacggaaggacctgacggttgatcgagggatggagggtgtggatggcagcaacggcatacattgcctttggcttcaaaagcagaggatgtgaatccctggatggcccatgcgccatcattcataggccggtcggtccatgcactagctagctgaattattgttgctcattgtttaatttcataattttttttggtgtcgttttaggggagtttagatatttgttttggccgtggaaaagcacacagtcgattggcatttttttttctttctttcaaattcttgccgtccctatttgagtgtcggaattaaatgcttggtcttttcttcttcttcttcttacttttttgtttgcgaggagtattcaaacgtttcatataaattcacaatttggatgcttcagtttgttatgtgcgacgacacacccatataaaattatagaattcttcctcttttttttttggcgttgatcagaagcttgtctcttgttaattaggttgctgcgggggtcatcaagttgttacacattcaagtgttaatttgtcaggagatagaacaaattacgtagtatatattcgaagtgtgatatattacaaagcctcctcaacggccaaaaacaaaaacatataatctgttttttatttcagcttagcagcatgcgtcatcattcatatgattcgattttatttcaattacttcaaggaaaacatgaatatactaccattaaaaaacatatttaatatcttacaaataattagatgtgagacaataaccatgtactaacttttcttattgattataacagtgtaaacattatgatccatttaacaagtttgtgaggtccactagtttggggacaactgaacctctgcaataacgctaggtgtcccgactgtgacattccaacgcagcaataaaaaataaaataaaataaccttctgaatgaattgctttccatcggatcttgttccttggatcattctgaaagatgtccctggtttctctctcctagtttcagcaatctaatcctgaactagatcttgatgcatgtttctaattaagactaggaaagttaagtagctaatgtactacaaatatataaagtgatggtaccttaatccttgatattataactttagtgatagtttagttacaaagggagatggatctgccgtagccaacaattgttcgtcttgtgaatataaactttaccagtacagtgattgcttttcattttctttgggttcatttcacggcggagttgttttcaatcagcacgcacgcaaggttcttctttgcaatgtctttgtacacctgtcccactatatactcgtatctactttcgctgcttttgcaattttaaacctttattcacaattgaatactttctgaacctaaagaaaatgggcttaaagttctcgagaagctacttatttgctaagttttctctcatagcaattctacggtttttgaggaggtaccatgaggtaccaaaagtttagtgtaaaatttggtagcttatggtacctcatagtacctaggtattaagaggtaccaaatttataatagaaaaaatggtacctcatggtacctactcaaggatcgtaaaattgctctttctctgatgttgaaatccaactagggaacatttggaagtgaggggtgccaatcctatcgaaattttcgaagaaaaaggaaaacatacatgcaaaacggattaagattgttaattgttgatgtctcaaacggattaacatttgtggagagaaattctagagtgagcagcaagtaccatttcttcaaggcactcgcgttgggcatataaatttgaggataggattctggattcgcatatcgttctattttaatttttagctgggaattaggccttgattaatttagtgtacatgcgtagcagattgtaaatcattgtaagagagggttagcttctgctatttgttggtaatatggctgagtagaaacgatggtttttgatgaatcaccattattttcctatatgcaggtcattttcagagtaactcattggctccggtcttaagcacaactacaaaggtgtgatgaagatgaagagttttctaaaagttgcatgtcgaaagttggagactacgattatataactttttgtcaattatggttggagatttacaaatagactttaataattgtgatctcctatgttaggctggattctttgtttttctttacggtgtgtcctatttatttagatttacattatgttcttgaacgcttatatatattaattgactataactcttttgagtaaaggccgagatattatatttcattattaaaaaacagagagttagcacgacttagggggtgtttgggagagagggaaaaataagtctcctctctcctaaacaaccccttaaattaagtgactgagagagtacatactttccgttatgcatgcacgcatatttgttgtgtcggtataaattaaaaataataaatatccatgataccacatgattggtttaatttgcacctgattttgttcttttaggcgtccagaaagttgtgccaggtttttctttctccgaagcaaagcaaagctcattccgatatattccaatagcgattcaaagttattcttgaaaagtgaagcactgtgcttagacagatgacatctaaattcttgacgattgtccactccagcaagggacaagaatctgccatatagccacctctctttcttctggagtgggaaaaacttttgtagaccgatcattgcattgcgtctttgggtgtgagcacggggtggcctagttttttcttgctctgggccttgtccttcagcaatcactttacacagccatccctcttgatgatctatcatattctcctttattttgcaccgtatatgtgcatgactgttgggaattaatgtatattctccttccatcattaagtgtctatgtgaggatttttttttctttcaagataaataataggatattaggttccaacatgatagcacaaaatagtaataataagtaggtcggttggaaaacagcctcaactatttccgtaaccatatttctttttagaaacgaaataaaagacgatagaattggaaacaaaaagtgttgaaaatatttgaaaataaaaaacaaaagtacatgaacaaaaacatactagtatcgatagaaaatcaataattagtactgaatatattgaacttaaaatcatgtattaaacttacaatacaatatgatatgaccgattaaattcatatgtaccttcccagaatataagtcatccataattatggagagtcaattgtaacttttaactaataattcaactaagtaataatatgtatatttaatttaatgcatgtggtgccattatattcgtatataacattatgttaatattatagttgttcatccccatcgtttggcttattttttgaataagccaaacggcatattttcaaatgaaaaatattttatgaataaaacttttatatacgtgtttttagcgatctaaaagcaaaggctggaaaataaacttcgatgaaaaaaaacccaaaatcaactctaaatttaaggttaaaaatttaaattttggctgataatcataagcataatagcgaaaaaatgaggcccattgataatatactataaaaaacctaatggccagtataattttgaagaccgtgtaaaaacatgcactcattacatcttcttttggaatggatagagcaaattataaactctcatttaggcatgtactcgaattagggatttggttgagattgataggcatgtaaaatatgggccaaatagagacatggaccatacataatggggtatttgaaaaaacataattgtcgtattataaacatggtaatttccaaagcgttttttttaagaaagacatttggcgcgctttattggtatgaaaacataattagatcatttgctcgaacgtttagcaagaagctaggggattcaacccaattacaagaattctttgagatgaaagcatgtctagctaactcatgtgctacaccatttgcctctctattacaatgctctatagtaatattatctaaacccaatctaagtatatgatattcatgaaaaattacaaccaacgttgtaggagagaatccaccatcttgcatggcctccactacttgcaagtaatctgtttggataataaacttatcacacccaacttgctcagctagaaagagtccttctctaagagcgtatgcttctgcaacatgaggcaaatacatacacacgcttactatgaaacatcctcgtgcatctcgaacaattgcccctgttcctctagaacctgatgttggaattaatagatgggctaaggcctattggaagattaattctttgaaaaatcacaaaagcccacctcatgggatggcatgtatgtggagtttagtaccaccttgcttattccaggagatggggacctccttaaaagggaggatgccctactagccacttgaagcatgtgtggtggagagaagaggggaaacacacgcgggcgggcggcacacgtgcacgatgttacgcgtcgaatggtccgcaaaattggcttccttttgcacttacgcgcgacttatccggttcgggacctatctctatataaaccgagccgctgccttcacgcaacatacgtgaaatcaatctgtctactctgtactgtgccgtcgctcgtagactactccatcccgctcgccggcgtgcatcggcgatcgggagagcaggtttccggccggcgtgcatcggcgatcgggagagcaggtttccggccgcaaccgcgagtagttcctgccgagcaaccggtctttccgccacctcggtacgtattcgacatgttgcgcatatttgatttgttcatattttactgcttagtttacatatgtagatctaatgatgcgttcaatctagtttacatctacaatgtcatgatttatttatggaataaattaaatcattatgtgcttataattttaacaatccaaaaaccttattataggcgctgtgattttactatggctggttttgctgatacactgagaccggataaattcaccggtgtgcactttaagagatggcagctcagggtcactctgtggctgacagctatgaaatgcttctgggtgagtactggcaaacctgaagaaattcttactgctgatcagcagaagcaattcgaggaagccactactctctttgtgggatgcattcttagcgttcttggcgatcgtctggtcgaggtatatatgcatatgaccgacgctaaggagttgtgggatgcactgaataataaattcggtgctattgatgctagcaatgatctgtatatcatggagcagtttcatgactacaagatggctgacaaccattctgtagtcgaacaggcccatgagatacaaaccatgactaagaaactcgaactccttaagtgtgtattactcgacaaatttgtggccaggtgcattattgcgaaactacctccatcttggagaagtttcggtactgcactcaaacacaagagacaggaatactccgttgaggggttgatagcatatcttgatgttgaggagaaagctcgggaaaaagatggtgcgtctaagggcgatggtgggtagtccagtgccaatgttgtgcacaaggcccaaaataagagtaaggggaaatacaaagctcaacagaccaccaacttcaagaagcagaagaagaacaacaacaatcctaatcaggatgagaggacttgctttgtgtctggccaacctggtcatctggctaggaagtgtccacagcgcaaggggatgaaggcacctgcagggcagacttctaagtctgctaatgtgaccattggcaacactggagatggaagcgggttggtaatttacctactgttttttcagttatctactaactggtgggttgatactggggccaatgtacatgtttgtgctgacatctcattgttttcttcttatcaggtcgcacggggtttcaccgtcctaatggggaatgggtcacatgcttatgtcatggtgttggcacggtagatctgaa

SEQ ID NO: 41409 - DNA, 3394 bp, Oryza sativa
aattcctaagttttccattgtcaaaggttctaagtgacatagttgtgtgcaatcgaagcaacctcgcaagcctcacaaggctgccgaggagagaaacttggcaccactagaactcctacattcagatctttgtgaaatgaatggggtgttgacgaaggggtggaaaacgatatttcatgacgttgattgatgatgctaccagattttgctatgtgtacttgttgaaaacgaaagacgaggctctagactattttaaaatttataaggcagaaattgaaaatcaacttgacagaaagataaaaaggcttaggtctgatcgtgatggagagtttttctcaaacgagtttgacttattctatgaggaacatggcatcatacatgagaggacgcctccctattctcccgagtctaatgggattgctgaaaagaagaaccgcacactgactgacttggtgaatgccatgttggacaccgcgggactacctaaggcatggtggggggaggcattgttgacctcgaatcatgtgttaaacagagctcctaacagaaataaggacaaaacaccatataagatatggattgggagaaaaccatcactttcttatttgcgcacatgggggtgcttggcgaaagtcaatgtaccaataacgaagaagcgcaaactgggatctaagactgtggactgtgtctttctgggatatgctcatcacaacattgcctatagatttttaatagttaaatctaaggtacctaacatgcatgttggtacaattatggagtctcgtgatgctaccttctttgagagctttttcccaatgaaggatacacatagtagttcgagccaaccctctgaagtaattcccagttcaatcacaccaccagaacaaactgaacatacacatgaacatgtcactgaggaggatgaaagtgaagctcctcgaagtagtaagagacaaaggacggctaagtcctttggtgatgatttcactgtgtacctcgtggatgacactcctaagtcaatttcagaagcatatgcatcttctgatgtagactactggaaggaggctgtccgtagtgaaatggactccattatcgctaacgggacttgggaggtgacagagcgaccctatgggtgtaaacctgtggggtgcaagtgggtgttcaagaagaagcttaggcctaacggtactattgaaaagtacaaggcacgacttgttgctaagggctatactcagaaagaaggcgaaaatttctttcacacttactcacctgttgctagattgaccacaattcgtgtgctactttccctagcaacctcacatggtcttctcgttcatcaaatggacgttaagatagcttttcttaatggagagctagatgaggagatctatatggatcaacctgatgggtttgtagttaaaggtcaagaaggcaaagtgtgcaaattgttgaagtctttgtatggtctgaaacaagctcctaagcaatagcatgagaaatttgacaaaacattgacatctgcaggctttgcagtcaatgaggcagataaatgtgtgtactatcgccatggtgggggtgagggagttattctgggcttgtatgttgatgacatactgatatttgggacaagccttgaggtgataaatgaggttaaatcattcttgtctcaaaattttgatatgaaggatttgggagtagctgatgttatcttaaacattaagctaattagaggcgagaatgggatcacactcttgcagtcccattatctggagaagatcttgaatcgctttggctacattgatagtaagccttctccaacaccttatgatcctagcttgttgcttcgcaagaacaagagaattgctaggaatcaactagaatactcccaaatcattggctcgctgatgtacctggctagtgcaactaggcctgatatctcctttgctgtgagcaagttgagccggtttacctctaattcgggagatgatcactggcatgcgcttgagcgagtaatgcactatctgaaaggtactatggaattggagcttcactattctgggtatcctgcggtactggagggatatagtgattctaattggatctctgatgtggatgagatcaaagccactagtggatatgtcttcacactaggtggtggtgctgtttcgtggaggtcttgcaaacagacaattttgacgaggtcaaccatggaagcagagctgacggcactggatactgctactgttgaggcagaatggctgcgtgatctattaatggatctgcctattgttgaaaaaccagtgccggctatccttatgaactgtggcaatcaaacggtaattgtcaaagtgaatagttctaaggataatatgaaatcgtctagacatgtgaaaagacgattaaagtctgtcaggaaattgagaaactctggagttataacgttggattacatccaaacagctagaaacctggcagatcccttcacgaaaggactatcacaaaatgtgatagacaatgcatcgaaggagatgggtttgagacccatgtgagttatactatggtggtaacccagtctatgtaatcggagatcccgtgaattagaacctgggaagaacaaaccattagtaaactagaggagagtaccaatctataccctctctaagtgaagatgcatgtactctcgtgagctgcaaggcaggttggctatgccttaatgagttctgttggctttaattagcgaagatgctatcctgcagagcattcttgaaagaactcacatttgtaagcttgactgttggttgcattctatggagattttgggtgaatcttctaggaagcttactaaagacctatgagtatgacttatacacttcacctgaggggtagtttacagacggtctagtaccagataagactctgagtgaaacttgcttgcacaagacttgcaattcaaggcgtagtccattgttcaagttgtgagtaagtgtagcttggagttctaggtggatgttcaaccttaatcggtctccatcgaaccgctggtatataaacagtacattggaaaaggcaaatctcaatgggattttgagatttggtgggggattgttggaattaatagatgggctaaggctcattcgaagattaattctttggaaatcacaaaagcccacctcatgggatggcatgcatgtggagtttggtaacaccttgcttattctaggagagggggacctccttaaaagggaagatgccctcctagccacttgaagcatgtgtggtggagagaagaggagaaacacacacgcacgctcgctcgcctcgcctggcctggcaggcggcacgcgtgcacgacgtacgcatcgaatggtccacaaaattggctactcacccttgc

SEQ ID NO: 41410 - DNA, 19621 bp, Oryza sativa
  unsure (1)..(19621): unsure at all n locations
tacatgttaagttttaagagttagtgggcatcaaatttatagtaagataggataggatttagtgtctgttttgaaagatgatgtggttcgatgcatgttgagaaattagttccaattatataagaatagtagatatggaaatcttggtaaattctcatggtttcttctatcactagcatccagctccaactaccatttgctatagaaaaacattattgcagacgattttttaaactccttaccatatgcatcctacaattttaaatatatgacatgtttttagacatacatcgaccatttattttattaaatatataagtagcattttttattcggacttattttattttaatactttataggcatgacttatatttttatatatgtacacaatttttttacaaaagaaggatggtcaaacatcagtcaaaaaaccaatatcatattatatttaaaaaatggacttggtattttccatgtaagagatgaatgtgttggtcttcactccctcagctctagcaacatgcttggcccagtctgggtcattgtcaacatgtgtgttactttttatcaccgtaaaattatcagagaatctactccatatcactaagtttgtcccagtttaacaatttgtcattgacattatctcttctgtaatataccgttgaatttataaattattctacaatatgccatgccattagactgatgcttttcttaaaaaatacccttaaatacatactcccctggtcaaaaaaaaatccaatctagacagggatgcgacacaacatagtacaatgaatttggatttgtgtcacatccctaagtaggttgagtttttcggactgagggagtacaatgttaagaattgaactacctcatttgaagtttaaaaaaaatatgaaaattcctatatggcctccttacacgacatggaagtttgtacataagtttttaagtttttctggtatatttattttttatataaaaatattcttatgtgttttatgagagagaatttacttacacaaaagataatatcacaaaaatatcttatgtagcgtatgaaaaatgatttacattaaaaaataacaacacaaaacgtattttatgcagcatataatatattaattatatttaaaaaatttagaaatgcaaaaaacttgaaacttatatacaaacttccatattgtgtaaggaggccacatgaaaattttaatatttattttgggtacttttgaaaagaatatttagcccaataacgtatcgtagaataattgataaagtcacaagtatattatagcaaaagacaatgtcaatgataaattattgaactcagacaaactcagtagtatataaaccatatgcagtttggaagagaaggaaaaggaaaaaaaaagagtcataaacagtctaattgaaatataatccatctgttctaaaatatagctaagcttaagctaaacattagacacacactcatcgagatgcatagctaaaagatatttagggatggaagagtagtatcatatcatctgtaacattgtatggattttttaaaacaaataattaattatataaattcagtaattaaataagcaggttactatccctccgtttctaaatatttgacgccgttgacttttttaaacatgtttaactattcatcttattaaaaaaagtaattattaattcttttcctatcatttgatttattattaaatatactttcatgtatacatatagttttacatatttcacagtttttttaataagacgaacgctcaaacatgtgctaaaaagttaacggtgtcaaatatttagaaacgaagggagtatgtaataacttgttcacactgataaaagctatctaaatcaatatttattctccaagtaactctcatcattaattcattaattgcgtgttgtattatgacttatccaacaggttattggcgtgtggttgtgagctattgaatggtcgatacactgcaatttgctctaccacatctagtctgcgcgtgggtcactcattttattgctgctattttacatgtaacacgttttcttcttgtctgctaattcaagggtgaaaagtttcactgtgtcacatcagatatatatcgatacacatttaaagtattaaacgtagactaataacaaaataaattatagattccgcctgtaaactgcgagacgaatttattaagcctaattaatccatcactaataaatatttactgtagcaccacattatcaaatcatagagcaattaggcttaaaagattcgtctcataatttacacgtaatctgtaattagttttttttcatacttaatattctatacatatcaaatatcaaacattcgatctaaacaggccctaagttagggggatcgagggccatgacttcaactaaacatgactgatatctcaaagcgccatatcagcattcgtttttcttttccttagacctgatctgatcgattttgttgatttgctgtcactctctgattctttgttctataatttgttgattgaatatgtcgtcttgttgtgcatgtgtacttttgaccactacatgtttctatctgggagagatcctttgcttacaaccgcaatcttgacaaatgttgaattagaatgactagctagaagtgcacaaataacaggctaatctatctataattttaaagctggcacgtctcactgcaacctaattggttgagttgttacgcacttgttcgtacaccatccatctaactgttagtgatataccctagaggcaatcatagagatgattgtatcacatactatgtttacatatttatccgactttgttacttgaaatagataactcattattggttaatgaatatgtgattctttcatgagactctttatgttgtgtgttgctatttctaaaggatccctgatcaaatatcatatgtggaacaaatatgtttagatgatcagcacatgtactaattgatgatcatgtctcatggatcatggaatagagataccaaattaataatgtggacacatgttggtgaacatgttgatgaatagacccaacatgagacactgcaagagccatatgtgttgtgtcatcagtaatctcatttagtgttggtgttgaatccttagacctgatattatcatggttcccaacatgtgtagtagcttacttagggactgctaaacgctactctgtaattgggtagttataaaagttgttttcgggtatgctatgaaatatgtagtgagatatgaataatcaagatgggatttgcccctcctatggagagatatctctggacccctcgatgttgtaaattatggaagtgcatggcatgccaaaggtgattgaggagtatatcacaagttatataatctatcaacaggttcgagtgaatgattgagctattagagtatggcacatatctagccttgagcttaatcgatattgtgaggcaaaggggttcatacaagtatacactagagattcagccgatatgatctttatgtatgcccggtgagtcaatatgttctgctagaggccgctgttgatgcgtggaccgaaaaggacttttcgggttacagcggagtgtacatgaacctacagtatcgcacgcttaataggctagaataaggggattggatggagatccaatatgagcttaattcggatagagatccgaataggagtcctacgggccttggaggcccgagtaatggatcctatatatttgtaaggggtgtgaccggcggaggtattgcatcacgtgagaaaccctagccgtcactcccctccccgagcaaaaccctagccgcgcgcgggtgctagcatatttgcgcgtggcgttccgtccctgtacgtgtggataccagtagaggcaccgctggtttgtagtgctgatcggtgtgggaatacagcgaggagaacgcatgaggagaaggtcgagccggtgcgatcgactacttcctctacatcgacgcgcgctacttcgcgagaattccttcgacttcttagcgccttcttccgttgcgtagcgcgtcgagtggtaacgatctatgatctaatacttgcatgattcctggtttacgcgatagaaaattttaatttatactatcgtagcctatgcgtatcccaacactaaccatgcatgcatcttttgcacctagggcagcgaaggaggaccggtaaatatcagggccacatgacggtactaaattggcaaaaaaactcattcggtttggggggacggtgggaagagatgcaagaaacaaagaaaccccgagagaacattcagaaatttcaacgatgaaaaaaggttgaaacccagaaaattcgaagaaagaaaggcaagaaaaatgaagtaaattatattaagtgatagtcattcacaatgaacggaacaagagaaattttcttagagttgtagcttttccaaaaaaacatataatgtattttttctagcatgactggagatcttcgaatacttaaaagatagtgtaaatttcccaaaacttcaaatattttgactaaactatcatagaactatagatttaaaatgtttatcataaactacatgtttaacatcaaatttatcacaaaactacaaatctaagacaatgtatcacaatactatatatttaatattaaactaatcgcagaactacatattttagagtttaaatcctaacaccattgttatgttagagctataaaatgtagttttataattaaattggttctaaacctatagttgttactaaaatgttttgttacatttcatcattaatgtatagttatatgataattttgactttaaatatattttttgatacaccgagtttaatctatagttctataattatgtaattttgtgaaatttactctaaaatatattgcatgctaaataggaaagtacccattaaaatatcatatgatacggaagataaaaacaggtgtcacagcagtactgaaagatgaggagagatcgtgatcactactctccctgtaagatgtgcagtgtacaattataatctaatcactgatgaaatgcgtccagcaaattagtaggagtaatagactgttggagagtgttgaccctaaatcctaattatatcgtgcgtacgtgtagtgaggctcggcaagttaatctggccatactaagcacgcagtcctgtaatggtcggcagcgaccagcagcgacacacgtacttaacctgtacagagtcccgaaaccaccgggcgggtccattaccagcgcgacgcgacacgtccgtcggtcggtcggtcgcccaaaccgcgcgtccgcgaccgccgaccacgactactaaattcgggcccagaaacttcggaagcaccgatttgcgacgcgtcgcgcgtactagagtccaattggttaccctataataattagccaaaatcaaagtaaaactaaaatttaaattcccaaacttaattttgatgtttattttcagatatttttgacatatttttgttagcgttgatttttaatatcgaagcgaacacatatataaaattttaccaataaaaattttaatttttattttctaataaatcgttttggtttattagagaatatggataaatgataaatacatagttttctgacaatgaaaacggtcaaaaatatcttcacccattgcataactcgaaaacaccactaaaacagtagacgtagaaccaaaagtactatactatatatatattagaaaactgaaaatgaaactacaaggtaactaacgtcagaatatgaacataaacactagtacagattctatcatctgtgacgggttcaattatgcgtgtactatatggaccgtcagaacaaagtcatctcaatcggacttaaatttgcaccgttatagatatacttactctaggcccaaatacatatagcccgtcaccgataacactcatatgtgacgggcaaatatttaggcccgattgagatgacctcgcatacctcaatcgggcctagataccgagcccgtcagagatgagggactttaaagcccgtcaccgatgactcatatcggtgttgggtttttgttgatgcccgttagagataacttttacttaggttatttttttatataactttttttaatagtttgagtttgaatttgaaaatatgacaacttcaaacaattttttaaatactaaattatttcaaatgaaaaaaattatcaacaacaaagttgtataacataccaatatttacaacttttatttttattttggttatttttctatataacattttttttgagcagtttgaatttgaatttgaaaatataacacttcaaaacaatattttcaaatactaaatgatttaaactaaaaaagtcatcaacaataaagttgtataactcatcaagatctataacttataacttttattttggccatttttctatataacgttttttttgaacagtttgaatttgaatttgaaaatatgacaacttcaaacaatattttcatatactaaatgatttcaactaaaaaagtcatcaacaataaagttgcataactcatcaagatctataagtttaatttttgtcatttttctatataacgttttcttgaacagtttgaatttgaatttgaaaatatgacaactttaaacaatattttcatatactaaatgatttcaactaaaaaaagtcatcaacaacaaagttgtataactcaccaagatctataacttttatatttatcatttcttcatccgataaagtgctagtaacattgttcacaaaatttacatatatgttttattgtttacaaaactagatgagagatatgtgaattttatagccaatgttactatcactttgtcggatgaagcaatgaccaaaataaaagttatagatcttgatgagttatacaactttgttgttgatgactttttcagttgaaatcatttagtatttgaaaatgttgtttgaagttgtcatattttcaaattcaaattcaaactgttcaaaaaaaaatgttgtatagataaatgaacaaaataatagttatagatattgatgagttatacaactttgttgttgatgactttttcagttgaaatcatttagtatttgaaaatattgcttgaagttgtcatatttttaaattcaaatttaaactgttcaaaaaatgttatatagaaaaaagaccaaagtaaaagttatagatcttgatgagttatacaactttgttgttgatgatttctctatttaaaatcatttactacctgaaaaaatatttgaatttcttatattttaaaatacaaattttatatagttcaatcaaacccggatggagaaatgaccaaaataaaaatggtagatctcaatgagttatacaactttgttttttatagcttttttatatgagttcatttagtatcataaaattcaattcgaaatttattttttcctagaagtctaatttgcctcctacttatgataatacttgctaaatatatatttgatccaattaactcggatttactggtgaaatatgtgatcaaaatagatgttatgtgaatgtggttgtgttatgtgaatgaatgtatatgaatagaggatgctagggtgtgacatcctagcccagggcttaataggattaatagaatactcataccaacaaattacaatttctctctcgaaagccaatttccaaagaactatgaggttaacctagagcaattctcggataggtgacctaccaagaaggcacacaagtgaggttcggatgggtgaccgactgggaaggcacacaagtgagggcaaaggcccgaggctaacaaaaaaacaaaatttatttttttttggattatattcatctgtgatgggctataatctaggcccgttagagatgagagtcatccgtgacaggcttttgtgttggcccgattgagatgtctcatccgtgacggccggatgcccgattgagatattttgtcacatcactgacctttgcttagtgacaggggcctgcccgaaagagatgatgctttaagcccgttagagatgactaatcccgttatagtgaaaaatccattcaagttacgatataaaaattataaactatctctcctttaaaatattgtcaaattagggttttgtatgagataccataactaccgtattataaaaagtagttctttgtatgaaatatgagataaagtaattacacttacacatattagtagatatggggtatatagaaatacggtaattgcaatctataaagcaaacggtataggatatataattttatggtatatttgttgtcttatttcctccatctttatcttgagggacaattagtatttagtagcatccttttattatttctaatgacattcttcaccaactaaagatagcatattgtatcatatatattcatgatagtttatattatatcatatgttcctcacagtttggactctaggaaattcgtcgtcacgttagaatagattcgaggatgtaatatcatcagttagtggtattgtttcaatgtagattgggtaacaaagttaacttttcttcaatcaacgggtgaattataagaatttttaactaacacgtcaaaattgcctagttaattttaattctatcaaaattagatatttttaaattttaatttaatcttaatttcattttcccaaatttatttcttaatgtatataattttttatatgtatacacttttaatgtaaaaaatacatacatctttgtaaacgtccgtataaaaaaaagagaagaaaacctagaaaaataaggggggaaaggaaaaaaaagtaaaaacgaaaaaaaaaacttccacatgcctctctcctgcgccctcccgccgtgccccctctccatgtgcgccatatgcatggttgcaccgcgcgccggggggggggcggaggggggtgtacgcgactagtcagcaaatagggttttcgacgcactcacctctacgaatgcacacattcataccctacccctataaacacatccggaatactaagctggcgtatagtgtgattgatgaagtcgtcgcggatgccttaatattgatgggtatgttgcctacgattgaaagaataattagtcgtaaatgcgagcgctagcgtcaaatctaggatttgaatcctggtgggctggttaaaaaaaaaacctaaccagctgagttacgctcacttcgcttaatcgtgaatttttatttttcttattttctttggattaattgagaatgcttagattgtaagactatgcttcttttcctattacttttaattatatactgacatgcttggatgctaaggtcatgcatgaaaatctaattatgattggtctgttacatatttacattgcttaggtgcctcacacggtttcgttgctgagaactgttgtccgtttcctacactaaccatgcatgcatgaatatttattgctacatcacatttccgaaaagaatccttggctgtttgagattgttatcggtttcatacacgatgacaattcataagcatattttttattggtacgtcccgtttcaaaaagaatagttgttcatttgttgtttccttcttattttcatccaattaacgtattcttttttgtttgtttgttttgtttattttacttttctctaataacgtggtaatttctaaatcgtgggaatgaacatggtggtttctttttctattctctctccaaaagtctaaacctactttattttttggtttttttccaaaatcctaagacatatttataatctttgtgggataaattccgaaacctagaagtcatagttgcatgcacgtatatagttcattggtttggtcacgtggtgggtaagttaattactcttggtattggtgacagaagaaatactctctccatcccaaaatataaagcacaactgttttttttttcatatatcataaggcgtgcatggatgcataagttaactatcacctcttagtcctttaaatttggttcattttaaatcttctaccatcaagttccccaatcacatttcttgcgtggatagatgtgattcaagcgaggagataatcaaatttttttcttcgtctttatgttagaagtggttaagccttctattttggatttgagggagtaggtctcaagacttttggatgaagggagtattactttattattaataagttaatagattcaggtatggtataatatggtaagttttggtaacggttcgtagaatagtaaaattcttcctgtatctatttttattttattattattatttttatcagttagaattttcaaattaatagttcggtcaaaaccaagtcggagataagtaacaagcaagaattttaattactttctcatccctactagactactagttctaatccggttgggggcaggactctcccgaaaatgcttctcttcgaacgtccgatcagatgaaaaacattggacgcctacggtcagctcagtccttacttgctaatttcttatttctctctgttgacgtcaagaaaatgctgttgatcagcagcctggtactgtcgtactgtaacatgcatgcatatatctagttgtttcttttcattcttttctcctctctttaaatattttctcttctaaattacttatctgatctacgaaccgatcgcaccgttgtattcgttgcaattaaatctttacaacaagatatcacatgattatattatgtcaaaagaaaaacgtatgtttcaaaccgttaaaacaaaatatttcatatgtgatagtgatatgtttcaatatgtgtcttaagtgtgtttcacaaaattcctgaaactacctactactactctctctccacctcatgcatgcatacatgcatgtattttagcaagcttcaaaatgatttttctcttaaattacctattcaatctaagatccgatcacaccattgtattcgttttaattaaatctttacaacaagatatcgcttgattatattttgataaaagaaaaacatgtgtttcaatcagttaatacttgttgtttcatgtgtgacagcaacatgtttcaacgtgtatcttcaccatgtttcataaaatatttaaatgttccagttgctgatttttttcaccatatatataacatgatgttttacttgttggtcaactgcaacatttgaccatccatttttttttaatttaaaaatgtttcacctaatgtactcatgatgtttcactatgtatgaatcaaatgttgcagtgagttaaaacatcctttcgctattcgctgaaacattattttcatataaggcgaaacggcgtccaataaaacattttcgatctacttagtgaaacaattccaatacttggtgcaacagcgtgcaacatttaaaaataatttaataataagctaaaaaaaatttcatcggattatattcatgtgtggtcttgttttaaagatttaattgcaacgaatttaatggtgcaatcggatcatgatttggataaatattttgagagaaaaaatagtttaaaattcatttgatacatgcataatggatggctggtgtacctgtgcatggatcggacggttgcggaggcatccgatttttcgtctcgcgtcgtacgtccgacgcgtagcgctctccggactctccgcgtgcgcaccgcgcctgacgacgacgatcatggactcatggtcatggagccgcagccaggccccgtttggaccatttctcgtcgcgagcaagtaggcaaatcacgttgctttcagtagttatggctagatagggagagagggcgagaaagctagttggcggggatatgatgttactcgttttactgacttgtaatttcgctctcaattgagtacaagatcgcgcaggagcagcaacataagccaataacaaacggagcctacggatatggagaccgcgaagtcatccatcccctgttgacagttcttcttgcttgagtacaagatcgggcaggagcagcaacataagccaataacaaacggagcctacggatatggagaccgcgaagtcatccatcccctgttgacagttcttcttgcttgagtacaagatcgggcaggagcagcaacataagccaataacaaacggagcctacggatatggagactgcgaagtcatccatcccctgttgatagttcttcagttttaccgaaacaacctaattttattttacaaaagatgcaaaaaaaaataccgatgtcaaccggtggaaaggtaacaccgttttgtcgctacatggaaaggcgaggagccccatgtcgacaacccacctggtgaggattagagcagatacaatagaaggctataagccagttgcaaacatattttaagaagataaatgatgagagagaagagcagcgggctatagatctgtagccagctgtagcacggactccaagacgcagtgtgtgtatgacaggtaggaccagatattaatagtgtagtatataactattgtataaataagctatttattagattagctatagatgaattgaagctagtagttggctatactattaaacttgctcttacgcactctatgactctaacgccggcattactgagctcacgctagtcttctcgtgcctatacgtggccaccctagctgttggtcatgctcgcctcgagctcacgcacacgcaaccgtacgtccacgctcgccctaagcccatctatgcgcgctctgttaacgatagttaagtatcaatgtcgacggcaactatcataataaataaatggagaactaatattttttacgtatggcaataataaaaaatataatttcacttgtcttagagaaataacatgtatgcaaagattatacaccaaaataaaggagaaatgagccaacatgcaaagaaacacatttctagcgaatcacgtaagagcacatggattgatgggcccaagtcaggccaaaccgacttaaaatgtgtccaatcaaccgtgcaccaatcgaagggcccacatgtcagcctcaggacaaggtcggtagtgaatggtggagtccctggttcggccaaaccaggggtgtacccctcgccaccgtcttccacgtggtgcctcctcccgcactcttgatagcggttatgcctaattcccaaaccaaaaccgatctaagcaactgtcattagaagctataaatagaggagagttccttacttcacagcacatactcaaggagaaattttctctatctgcattgtattctctacaatattagtggaaataggcttagagtaatcttcggttctatggttttctcggagattccagtatgactttagtactttactgttcttgtaaaactatagttgaattaatagaattaccttctttatattcttgtgttcatagttcatatactgctttggtagttttgtgttttatgattaggatatacttcatttatatgattcacttgattaggctagtcgatcaatactacggttacagtccaataaccttagcggattacactaattcttacttgttcatctgaaaggtgggagtcacattttagattggtgtgtgtcacactatccaattatccttattattctaacccctgtttacactatggtgaattaattatagcttgattaatgatgtataaactttatctttacaccatcatcttccctgcaaaaatataaatacgataccctttgaataaccctaggtgaaatactacagcggtatccgtacacctgcagatttatctgtgatcgtaaaaaataccagcatgccacagcaatcagactcacacgctcgtgtcaatcatgctcaccccgtgcatgctcgctttagatgcacctctcgctttaatagtacgtgtgctcgtcttaagctcaccaacgccaatcgtaggtccgtcccgctcccactcccgctcccgtctctgtctcatcgctccgatcagcatcattggcgcttctcacgttgatggctcaagcaccattgccgctcaaatatggtgtcacgtgctcacttgcatgcccgcacatggacacctagagtagtcaaccaggtcaattactcaaggcttgtcacccttccatgcaacgacatatacagcgtggcataagtgcccacatgtcaactactttttcccttcccttactgacatctcccctggcaaccttccctcccaactccacagtgccaccgacttctcttcctcttcttctcacattctcggttggggttttagactatttgccattgtcctgaagggcgtattctcaaatgccattctctagaataactttgactttttgctatcggagaaagaagatttcttgttcgtgagccatttttcagcccatgagaagccatgtcaccaaattcgaggacaaaatggccgccttgccctcctcctttctttcttctttgccttcactcaccttcatcatctccctctcctccggcgtgctccctgtcaatgaaggtgtacaagcagacgaagccacgtgagctccacgtcgagggtgcggccgagggtcatggccttgcagtaagcatccgcgagtgccatacctccaccatcggctcgctgtcgaggggtacgatcgtcgtggccacgatatcctcttccactagagccaccaacgacccatcgtcgagggctccacttacccgctggtgttgatcactcctgcctcacccatcaccgacctcgtcctcacggggcaaagccaccgctagctatcctctcctcttgcgcatacagaggagcggggtgaaggagacggctggagctcgcgggccagggggtttatcagcgtggcaatcctcactggagcccaagcacaaggcaaggagcgagaatgaaagacattgagaggggcaaaacggaccctttcgtcctcggatttggtgatgtggcttctgatgggctggaaaatggcaaatgagcaagaaatcttctctcttcgatggtaaaattaaaagttatttggaagaatggtatttgagaatacggcattcggaagagtggcaaatagaccaaaacccctcgctgccaggtccggacggacgtgatgatccttttagaacaaaggataaatcctaccaaagaaaacatttcacgtaatttggcaacattgaaaatctttaacccttttagaaaacttaaatatctttttcatcactacctccatatttagatattttaggtattaatcatgcttctaaatcgaagatttaagtatgcttcgatctgcaagctactttttccatcgtggaaatatacaaattgtagtaatggtgtaatggtagtatggtacagagggggaaatcactacaggttcatgccacaggttcacaagttttcaatttactactataataacttgcgggtttaaaacatgcgcacaaacatgactgagaataatatttcctccgtttcacaatgtaagactttctagcattgcccacattcattatgtgtttagatttattaacatctatatgtatgtggttaatgctagaaagtcttacattgtgaaatggagggagtaggtgttaccaaatcatgataaattacttgtcaaaaaataacagctccatgagttaatttgcaaagcaaagcaagtacgatacaaaaagtgggcagatacttccatcaaacaactaacccacaacatggtgcacactatgtatgtctacatatcagaatatatgccgttctgtacttcaaaacaagagaaaatatatcccatatttgggaagaaaatccatcatgcaaaggtttcatacaaatgctatgctccaggctagatctaagaaacatagcagactaaccaagaggagaacaaacaaattacagcagaataagatcacaacagaagaaacttaattttgttacctgtgaactatgagttaaacattcaaggcttacacctcctgatactggtgtaaaattgtgaaccatggcatacacagcaagaaaactctgtacaccaaacttatatatcaacgtcacccccagagctggctgaatcaccatcactgccgtcactatcactgctgctgcttccactaccactcccacttccactgctactactgctgctgctgctcccgctagagctagaggtttcctgctcatcctgctgcccttctgcattgacttgagctcgcagggcctcggctgcattgagtccctcatcagcctcatcactgacatctacatcagcaatttcatcatctatgtcaagctggtttggtatgttgatgtcaaaaccacgaacagaagctccttgtccagaggacatgttattcggtgagccattgtcatcatcaccaagtatgtctaggttctcctcttgatcatttggatcaggcgaaaatgaaaatggatttgtggtaacaggttggtatgtagtgctcctgttattgtttcttagacctgcaactggcaaactagaaaatgagaacaaacgataaatcctatccaagaaaacatttcacgtaatttggcaacattgacaatctttaacaacccttttagaaaacgcaaacatctttttcatcactacctctatttttagatattttaggtattaatcatgcttctataatcgaggagaacaatgttcaagtatgcttcgatctgtatgctactttttcatcgtggaaatatactacaaattgtagtaatggtggcagtatggtacagagggggaaatcactacatgcgcctctgagttgtagaatggcatgtatttggtgaactaatatattttttttgcagaacaggtcaaaacggcaattagaaaggttaaactgtttttgcattgtgccatatctttcctccagcaccatgaaatttgacaagatgatatcatggtacaaggaccattccaagaactgcaaactacaacatcaacatcaagacccgaacatagaatttggtgtataacctacatggcaaatgccttgcctttgttttaacaacaattacgcgaatgtattcatcatctctagtatcagagcaagttaagaaactaaaagatcctcatgattaagaacaacattgcaataaaaaaagggtcacattacctggattttcaggttcaccaatgtcaatgcgttcaacctcaacctataaaatgatgatcaaaggtcagaagtcagacgatgattaaatagaagagtttcttaaacttcaagaattccactaaaattgtacaacgtgatatcacagaggttggccaatatcccccagggcccagggtcagcatatcaataacattgtcagcttataaatctatttatgaacttataacactttaggatgctttcttcaggaatctagtctcaatatatataatctggagtaaactgggaatgatatgagaaatataacaaacttatgagcctatatccaagtcttagaaagtatgtaaagtacattttagattgggacaaggatgcatctctcatgcaaatcaaatgttcagagattgtatctctactttgagctcactaaaagctgaaatcactttgatacccaaaatatagcagtatattcagtagcaatggcacagttgcatgataatgatactatgttacaaaagctcccatccgaacacttgcattgaacaggcaagggccctgacaaaatccccatcagggataatgatactatgtcacaaaagcttggggttaatggatccaggaactgaaacgaggaacttagcaaggactgtataaagttttctttgataaaaagaaaagcattaacatgataggaaaacaatccctggcccagtccaattgtcatgtgatacgaagttaattaggataattgaatatggtccattgtatcaagccatcaaatttccatattcaaagaaaaggaacagaacttgctaccatattttggcaaaaaaaaaaaactttcatcggtagtcagagctaaccatactgtattctggcataaaagttgtgtaaaggaaatttctactcactatccaatgtttggccttctgaaatataaattatgaagaataaaaattaacaatattcacttttcaatcagatgctcaaagactaatgttttcataaaccattaaatactaataacctaaaacatactatgaaattcaaatattaatcactttaccatatcacaaatataacataatcctgtggatgcttacgggtctgagagatgttagattcaaaagagcttatgaactggctaggcttgaatttagacaaacatgaaattttattgtggcacatatataatgttttatactttctacatgaagacaatcaggtaatatggtctacaacattccaaaaagcccgaattgtttaatatgctaccgataaatattactgaagggcctatatatgagtggttccagtctcccagataacaaaaatctcttggcaaatgttttgtgtttgtcagtctaaatagtgtgcatcatatattgtctcataccggttattcaacgttatcactttttttcctccaatacctaaggtcgtaacaaattatataacaatgtatcaaaatttatctagggcatctaaaatgctgaaagaacttacaggaactgagtgtacagcaggtttactcatggccggtgactttccaactttcggtaatggaggggaatgtgattcgcccattccagtagtagccgaagtggctgccgaagactctcctggaactcggacatgccttaatctcttgacagcccgatgcaaccgctccagacgaaaggtttcaccatcaaaaaacaagacaccatcattatccttgtactcttcttggcttccttcaaatgtcacctttggcttgccaggctgattgttgtggaattccacagtaaccctgttatctttggtcttctgcagagacccagcttgagtcttatcaattgatgctggcttaaattcatctgtcaacacaaatataagaaaagggttcaacacgacatagcctgatatgtatttataatataaaagaataaggatcaacacattagagatatttgtagaaatagttttcaggcaaaagaaaaatggttatttcaaacttcataatccaataatggacttaaaatggaagggaaagctagacagcaaccaacgaagtggtgactcattggatttcagcaaattgttatgctaattcattcatgaagagtacccaggacaggcatgccctacatgatcgtggtaacctttttcaaaccacgagagggagagaaaattaactatttaatcagttttgggagcatcaattttgattcctttattaccaatgacttgttttggcccaatgaaaaaaaaattgaaacatgtcacataaccatcaagagggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41411 - DNA, 30161 bp, Oryza sativa
  unsure (1)..(30161): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcaaagatggagcaatcaattaatcagccaacgagtcaactccaggagtcattatcttcatctttgcttcggagcagatattctacttcaacaacttcaaatatttcggtttagacgagttgggcaacaacatcaactctcctccaattatttgtcttcacggttggcctactacgcaactgccgatagaggatctcatcgttatcatcggctgctacatcgttattgactggatcactgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatccttgtcgtttccgtcgttgcgaaggttcgcgagtgcgccggaagtattcaagaagattaattgaagaccgattattgcaagttgaagacaagttgcaaaggagaagacgtttggcttataccccagttgagctgcctgtgggagtggagccggagcttcctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacattttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgatagaaggacaagctatatgctcaggggctcatcaactcaagcgtgaggattatatctccaatttggacttgttccggatacattccacatggattcatagttatgagtctattttctatgctcaacgactggaccaattattattccccgtaagggctatcaaccgaatacttgcgccattcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttataagtcaaggtgctgtttgggtttttaagcaattgattggatacaatattattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccagtactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatctgctacatattaatattaagtcgcttggttgactacaattatcgaaaccactcggtgcatctagtcgatgcacctgactttattttttcagccctccacagtcttctgatttagaaaaagtactcgggagatcatggcgaagatgattgaagcactcggctttggagtaatctagttcgagagaagattatctttctgactgtgaaggtctcaggggctactgtggagattatgggtaccccatacccacacggcatggttatctgactagttataggggataacttatatgtatgtaatatgtaacagatcataacttgggtgttacgtttccttgtatattacggaacggcctaaagtcctggttggctaatattgtaaagtagatttaggaaaccgataccgtattggttaaggtttctatctcgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccacatccatccacttttaagtctcgtgcgctaccccgttttattattgccgaattcatgtttcgacaacatgacgtctcaagtgaacagcggcacgcaattcaacagcataggaaagttgagatcatacatggttgcagcgtatgaacggcggaaggaggtaggccgccggatcaggcggtcatggcacggcacaagagccacccaactcggtaggctgctatgcagagctaattcgtgagacaagttatttaggcctaattaatttataattagcatattttttactacagtattatataggataatcatagattaattatactctatagatttatctcataaattagtccagagttatgaaatgggttttatcattagtctacgtttaatactctaagttagtgtccaaacatccgatgtgacacggactaaattttagtccttctaaattagtgtctaaacatccgatatgacatggaacaccactaaataccactaaataatgaggtagtcatattgtacaatagtaatctgaatgtgacacaacatggccatacatacatcatagaccaagaatgaactctttatactacatactagtctgatcacgcgcttgtttggtcagaaacacaagagttgcgttgaattgactgaaccaacgccaacgccaacggccggccaacatatttgactcccctccaaacatacacacagtattattcctcaccgccctaccttttcagttagcttcagcctcagcttctgcagacagtgcagagtacgccattgttcatccactcccattttgcaagtcagtgctaaccaaaaaatccaaaataaaacacccatcgtttcattcgcaagtactgctgctgtaatcagcatgcaagaatcaatgttaacaggctactgattgagttgattagcagctcgaacccttatccctttactggagaatggaagaagaggaatgaatttccatgcattcattcatatagaaccagcaggtagattaacgagatgttggcagaagagaaagaagtaacaggacacgattaagagtctcctcaagttagacatgctacagttttattcattactaatgcagaccaatatatgttcagtgttcatcataagcacaaagccacaaacactctgacagcgagtgtgttcgttgcttgctcaggcagctagaaaatcagtaaagtgttggtgcttcttcgatctacaattgttattattgcaattacaggaagaacaactagtggtactaacctgactgtactgctatcctgtatgaaattatacatttgtataggctactgaacacgaacaatcaagccatgcatcaccatcttacacttgattacactaacttgtcccgatcgatcgatattgaacagcaaaactaaactaattttttttccctttgcgccggcgagctatgtagcttaggccatggcagccgtggcgggcggttcagatgagggcgccgtgggcggcgtcgagggaggcggccatgggcatggggaagccgaaccatggcgcgtacagctgggcctcgtcgacggcggggcgcacgggcacgggctgcgccggcgccacgggctgccttggcggcggcggcgcgggggcgcccgtgagcctctgcacgaggtccctgaactccctgggctcgacgcggtacaccttgggcggcgcggggcctggcgccgccgacggagaggctcgccacggcttggccggcggcttctgcaccgccctgagcgccgcctcgtgcgccggccgcctcgcgtcggcagcgtgcatatccattgaattgaagaagaagaagaagctaagataagcagagtgagagagaggaggaagaagaagagagggcagagcagaggagcgatgggaggaggaggaggagatatatagagtggtgggttgggcgagggcgtgtggagggggttggattctagaagaagaagatgaagaggagaggtggcgggagaggaagcggagtggcgggagtggcggcgagcggggggcaacacgtggaggcgggcggtcaatggtggcaggcaggcaatggcgatggcattcgctaatcgcgcgtgttgcacttgcattgctgctgcattcctaaccatgcacggctctctctctatatcaaatgaaatctagtatccatctccatctcattggcattggatgcaccgcggcgatggcgtagcatagcagaagcaaaataagtgatgtgaatgatgaggcagttgagttggggcggccacctcgctcttaccgatcaacaagggcaagggcaaggccttgttgatggctacgctctgcctgccttatatcatcctcttatgtaggagtataacatttctttttcattatctacttacaaactacctgaggatgtagtggctggtttaattcattatttaaatatctaaatatttttaaaaataagcgtagtacaattcgttacttctagcaacctaaaagatataaaaaaagagcagccaaaaagtgttccaacacatatactgtagctctcaactctatcctaatatataaaatgggcgcacctaagcgtcgattcgttcagaaaaaagtattgtagttacagagtaacgttcaaaaatcacacgataacgcactattttcgcgaagtgaaggtggcgggaccaaatcccctcacctatgcgtgtggccataatttttttttcttactagtttgcatgatttgtgaagcaaatctaacattcgaaattatatgaaagttatattatagttacataccagttacaaatgcaattacggtataattatattgtatttatatttgatatttacttggacaaaatttattaacaaatattgttgtcaaaatgacaagagcttcacgtcgaaggacgtggttccctcggtggagtgatttgaacaataaataacatattaatttatgaaattttttagggatcccccttacacaaccctagggggatatttatagtcttagtacatgcctatacccactagggttcaatatgtacagagaaatttacattatacccttatgataaggatattagagggacatgtagtgtccatcccaactatattccccttgaaaggcccctggcctggcccataataggcgaatggcaccatgggccgtgctgcttggcgggctccctggcgaagccggtcttccatggggcgaacctttcgtgctccgccttgaggcttcgcccagaggataaacttggtggcgaacccccttgacttcgtcttttggcttcgcctgatgcagtggcttgttgatttaatggttttagcaggttcggccgaaggctctcgtggcatgccttaacaaatatatagcaaaattatccactagatggattttaagtcctacctagatagccgccaggtcactgaatagtcaggtacgtgcagtagaaactctttttttccttagtcatgtataaaagggcctccttttactttgtgactaaagaacatatatattcatgtgaaaccggtgacaaagaagtatatttttaatttctttttctttcccactgttcctactgttctacatttccctcgtgctagcatacgtacaatcatgaaatagaagcacgcatattagtttcattcattcatgcatgcattcaaatatctcatacgcaacctactatttctgcagctagcgagcaaggttttctcgcagcctaaccaccgtaccacaagactattctctctactgttagcttgtctgaatgtctgaagaagaataactaacaatcaggttcaggttgagtacttgagcacgcacgagcggccggcccagtcaacgatggcacacgcacagctatggacattccatttctctctgtacgtctcgttatcattctgaaacgaaggaatttcatatgagatttgcagggcctttaatttgataattaattgaccggttgactatatttcagttgattggcgaattaaccacggacgtacagttaatagtaatactccctccatactcacaaagaaagtcatttagaacatcgatacggtctccaaaatacaactttaacttcttttttctataaaaatattcattgaaaagtgatatatgtatacttttatgaaagtatttttcaagacaaatctattcaaataatttttatattttcaatctcaacaacttaagagttattcatgatttatattcccaaggtttgacttaaacattgtcctaaacgacttcctttacgagtatggagggagtacaagttagtactccctccgtttcgaaatgtttgacgccgttgactttctagcacatgtttgaccgttcgtcttattcaaaaaatttaagtaattattaattctttttctatcatttgattcattgttaaatatatttttatgtaggcatataattttatatatttcacaaaagtttttaataagacgaacggttaaacatgtgctaaaaggtcaacggtgtcaaacatttcgaaacggagggagtataactcaacacgttcagttcaatccggcacgtacgcggatattcggtcaaatttgatcaattttttttctgtaatttcttgtctgcaggctagaatggtgagatgatccaagtccgtcgtcctgctctgaatatgtcaaaacttgcgcttggcctggactttccagaattccagtcgtctctcgtctcttcccaaaaaaaaatctctctttttagcttactttcctttgggtgcattttgtttatcacctgattgttcttcacagtccaagaaaaattctatttttttccagtttagtttcctttggctgcatttttttatcaccagattatcttcacagtcctaaaagaatatctcacaaaaatctcatttttgggcttactttcctttgactgcattttttttggtttatcagaagattactcttcccagtccaaattttttctctctttttttttcagcttcatttcatttagctgcacttttgcttatcagcatgttattcttcagtccaaaatattctccctttttcacctcgatttccttacacatacgactagtaattattcctaatgcactgtacagtttaatcttttgatacctttctctaatcactcccacaagatgtatgtacagttcctggatgtctcctggaaggaggagatcaggagatgaatcccaatcagtctctatctcccttcagggacagagtaatctactactagtatagtctacggttagtggggcccacctcaaacaacgacatgcaagaacaggaggagcccacaaactgataactgaaatcatggtcttcttctcaatatcacccccacctccccttcaattatatacaagtcaccctttattctttttttcctctcttcttaggctgtgtttagttcagcgcaaagtttagattttggttgaaattagagatgatgtgactgaaaagttatatgtgtattacaggttgatgtgatggaaaaggactgaagtttggatccaaactttagatctaaacacagccttatactagtgtatccttttggatggcaaagtaaaagcagaggttgacaagcacatagccatgtacatcaagtcacatgtgggtgtgcactttgcacttcttttctatttggcaggtcataagagctttgtcaaattcgagagctctttggtgaatatatagctgcaactcttgtagaaaattaagaaatagttagttcaagtactatccgtgctactaataaagtatgttttcttcgcactatctacgatgaaacgaactctaaaaacagtagaaagttacataacatatacgtgcatatggtgcacaaacaaatcatctaccaaagcaacaaagtcaaggccaaatggatagccaaaaaatactgcaagtgaaacacatcgtagttcactcgaaattgacgcttcagaaaccaactggacagccaaaatattgcaagtgaaacacatcttagttcactcgaaattgacgttttcagaaaacaaagaaagggaaattttttagtcctagaaaaagcatcatcgaaaaggaatccggtggaatttgcgaatgtcttgagggggagcactgaaaaagttgtccccaagtaggcgtaggcaacaacaattcaaccatggccgtgctgaaaagccaaatcttccctctctaatctccttctttcctctgctttcctctaaatgtccagatggtaccaccacccaagtactccgattttttcagctcggcgattgaggaagatcttctcatcatcaccaccaccgtgctaccctagcctaacctagaggccttcaacctctgctcgatcgatctgctgctgcttctccaaggcgagcttcgtgatcaaaggtccttattctctcatcagctctgctctgcttggttttggttttggttcattcagtttgattcatttgatggatagattggcaaggagtatgagtatcttcttgtttccctttttgcggcgatttgctgctcttgttcgctttcagttcgtctctcatctttatgcgtttcttggctcccggtgaaggaatcacgattcaggaatctcggactccgtgattttcaccagagaaattcttttttttttaacccactcatcaccgtgtaatttttttaatttcttctctgcttcgatttcaccgaagggcagaaaccgctcttccttggacgtaaccgcttctcggatccacacatacattaattttttttgcatttttgtttaggataggattggagccaataatattgtttactagtaggatttttcatttttcaataagatgtcttgttcttggatgttgccatggacagcatgcaaggaggggtagcgatggtggtgacagtgaacggcggcaatggcaaggacagcttcggcaacatggcgaggccgccgtcgaggagcctcctccccctcaagctcctcaagccgttcctcatcttcgccgtgctcgccaccggcttcctcgccgccgccgcagccgccctcctcctcctcggcggcggcgctggcgcctcctacgtccccaacgtcctctcggcaacggcgtggcagcagcagccgcggtgcgcgcagcagcaggaggacggcgggcgggcggcgctggagcggtggacgcggctaccggcggcgagcgcctggcacaacatgagcgacgaggagctgctctgggcggcgtcgatggagccgcgggtgcggcggtatccgtaccggcgggtgcccaaggtggcgttcatgttcctcacgcgtgggccgctgccattggcgccgctctgggagaggttcttcaatggcagcggcggccgggagctcttctccatctatgtccactccacgcccggatacaaccccgacttcccgacaacctccgtcttctaccgccgccaggtgcccagccaggtactacaaactcaaatctcatatcaaatttgattagtttccgtttcaaatgcgagatgatttttttcatttctcaattaaattaaaagattggggggaatttggagagcgttgagtcgggttcgtgtccagatgaatgttcagcttccgtggcatcttggcaagtgcagtgcgccacgaatgcaagggtgaaaatgacatggtgtaaaagtctccctccttaataatcccaaaaaaaaataagaatattcaatcacacttgtacaggctacatacaattagctagaaacaaatttcatctcgttttctcatccatcgtcagcatctctgaaacaataattccagaagcaaacctgaagagtgtatgaaatggattggaaattgaaatgggtgtgcaggtggcgcaatgggggcagacgaacatgttcgacgcggagcggcggctgctggcgaacgcgctgctggacggcggcaacgagcgcttcgtgctcgtctccgagtcgtgcgtgccgctgcacggcttcccggcggtgtacggctacctgaccgcctcccgccacagcttcgtcggcgccttcgacgacccgggcccgcacggccgcggccgctacagggcggggctggcgccggaggtgtcgccggagcagtggcgcaagggcgcgcagtggttcgaggtggaccggtcgctggccgtgttcgtcgtcggcgacgagcggtactacccgaggttccgggagctgtgccggccgccgtgctacgtggacgagcactacctgccgacggtgctgtccatcgaggcggcggggcggatcgcgaaccggagcgtgacgtgggtggactggtcgcgcggcggcgcgcacccggcgacgttcggcggcgcggacgtcggcgaggcgtgggtgaggaaggcggcggcggggcagaggtgcctgtacaacggccagccgtcggaggtgtgcttcctcttcgcgaggaagttggcgccaagcgcgctgcagccgctgctcgcgctcccgccaacgctgctcggctactagaatttttttctactactactctcatcagttacgtatagatgtacgtactgtacgtctctcactcaaatgtctacattatatatacgatgtatactcacatcacagaaattttttgagcggtaatatataaaattttttatactccatccactgttgcggttaatcggttatggatgaaaatggtatggactttcccaaccgtatcgactatcgtttccgtcttgtaccagccgttttatttcgatcatgtgtttgaaaagttactacctactgctttgaatcttcactataataggaacatatgatgttaatatataccgcctccaattcaaaatgtacgatgccattaacttttaacataacgtttgaccatttattttattcaaaacagttacataaatattatttagggcttgttcggttcatagagttttcaaatgaaaggaatagtaaaagcaaagaatcaggatgtcacatgcactccattccttaggaatttttctaaaaggtctcacatcatgcaaagaatcctataaaataatttttgccgtttctcatgtgctatgtagacaaagaacctgacaagcttcatattacacagtgcaagtacttagtagtgggtcccacatgtacatcttttcacttttcatctcccaatctctttctcctccccaaccgaggttgcaagctccacaagaccacaacgcagcgcccagccgttctccctgcgttgcgctccctcgaccgtcacggagaacgcgtgccctcttgtggctccgcctccgcgaactcgcccaggcaacgcactttggcgacgtggtgtcaatttttccgttggcactgaccgggctgaacgacacgtaggcccattgtaaatgccctaaggctacaatccttatgaatttgataggatccattcctatgaaatgaatgatgcatataggaaaagaatcataaggtttgaattcctacaataatcctatgaaaatcctctaagccaaatgagtccttatttttttctaacttgttttatgatcaaataaaatataatcttaaattatacttttacatatttatactaaatttttgaaaaaaaagatcaaactttgtgcgaaaagtaaacggcgtcatacattttgaaaagagctactatataaagtaaacattgtcgtgacttgctttcccttgtgacacattgttttcaaggctctattccggtaattttatctccggtgatttcattttttcgttatcattaatcatttttggctctttcgcttcgattccttttttaagaaaagaaaaacaatacggaaatggtttaaacattttctgacagtttttggccattttcatctatagacggatctagggggtggcccagtgatccagtgacaaaaaaaaatcctagcccaatacatatatatacatatgcgaaaagaaattttaaaaaaagaaaaaaaaagctcctttattaatatattataacgcacatttgattaatttatacttatagcttggttatatttagagtatttaaaaattttatatgaattgaaccacccatataaaattaactagataggccaactgttttcatccctagcttcaatgcttgaatgcccttttcttcttttttttttgaaggaaatgaatgcccttttctagtcaaagctgcaaggctgcaatgtgaagattctatggttgttcacatgctgagcatgagcagagaggcccaaaccacccaaccaaagaaaaaggcagccgccaccacagatacaattggagtggtcgcacttgacatcgccggcgtgtgagctacggccggccggagccctccacccttgacgtcgtcaccggcacagccacggcacaacgactgctactaggagcaatatatgacaggttgacagactggttgttggtctcaacaaaaacacccaccactagcaaaatccttactactgtattattgttgacaaagcaaccactcaatttgctactgttctgttgttgatccatcaacatgtctaagtaagtattccaattgtactgttgcttgcagaaattatcatacaactctccacttccctaccaacttttactgtgaactagtagacccacaaactgaaactgacaggaggagatcaaaacatcggagtacaaccaaccaataattcaaacataaagtactccactccgtaagtactagcgattaagacagctcctcagctggttgctgcagctcaattcatggtgtttaatcaatgaaggcatgaagcaacagttgggagtgatgggagtcccagttctctcacaatgctcagatactaccaagcagatgaacaggttgcaggacatggacttgcttgcagcctcctagcctgcatttgatgatggctcccaatttgtgcactgcagaagtgcagagtgcaggctgcagatcgactgcctgatctgctcccctctgttgagccacacatgtaacatgctgccctgctgcttgtagccgagctgatcagctagctcatacatatgtatgtatgcccacctgttgccacgatctctcttgtgcaaatgccacgcgagcagtgaagcgcaggggatggaacaaggattcgttctctcattgattagcaggactgcagtgccactagttctaaattctagtagcatatgcatgtcatgtgagtatgtgactatatgtgagtagttgatggcttgattctggtgaaaagcttggcaggatcctttcttggtcactgcagcttataatttgcttagactgaaaccgaggcgaaggcacagattcctcactttagtctgtttatgtttattttcctttctgtttatccctgagagagttgtcatgtacaagtatcctcgtatcttcaatattcacggcttctttggtttagcatcctactaaaacgttgatggtgctaaaacctggacaagtttcacccttgccaacttgtttatatgataaagttgtgtttgcttttatgccaatgaaaagccaaaactgttgactaaaatctagaaagtggcaaattagacatttgcaatgccaatgagttggcttcaaactagaaccaccatatccactatttaagctaccaaaatatcagtagggcaagttttggctccaattcaaaacgaccctcagttttcactgaagaattttgcagaagaagatgaggactactgctgtgggtgtaaactagctgcaagaccattggttgtgatctcactatgctagggatgtgattgaagaagagagacaattagtaagaaattcagagctaattgtaaactactagcaagaaaagaaaaggaatgaggttgaagaagagagacatcgttttttttgttctgtctgcacctgtaactgagcaagacaaggcaggtgatggcactgaacaatatattagtactagaaattcaggacttgttcaatagatgcatgcataccaatgtagtatagattatatgaccacatgttgggtaagtcaattcaagtttgttcatcagttgatgtcaaaaaaaatcactggattaatatattttaataagcttgcctatgcgcaggaccaaactgaaaaggtcctagcagttttgcccataataaaggccagatatttttcttaacaagcagaaaccgtgtataggttgagaaatctcctcggatcatcacccagaatcaccaggatttgcaaaatttcttcttttactgacatgaacaacacaataacaacatagcactaagaagtagaagtaagcagggattggatcatcgaattgctcctacaccaatcccatctttgtttgttgattttttttttgtgtcatgttaatctcttcgatccccgtttggacgccacacctatttacaatctaagtagtagagtagtgaggaacatgttacaaggatgcatggtgggtggtggttcacctcataggtccttgtcgtggcgcgcgctggcggcggtggcgccgccgtcgtcgtcgcagacgccgcgcttgccgtagcaatgcaagaagacccagaggagcgcggcgttgaggagggtgttgaagacccaggcgccgatgccgctgcacccgccgccggcgacgccgccgaagtgcatccacacgacgccgacgtggcagaggaggttgcacccgaggagcgcgcactggcaggcgagcgcgacgggggcgccacgggcggcggggaggccggcgccgacccagaagcggaacccgaaggcgacggcgtgggcgagcgtggaggcgaggatggcgagcacctggaacgactgcgagaactcgagccagaggaaggccatggcgacggatgccgcgtgcgcgaacaccctcgccgcggcgccgcgacggcgttgcagcacggcgaagagcccccgcgcggcgtggaggtagcgggagaggtagtatgcgtaggaccagaagaagacgcggccggaggagcgcgtccccggcgggaagcagaggagccagcggaacggggtggtgcggctccgtccgcgccacgaccaccgcgtgtcgcgtatctcggcgagcgcggagagcagcgtgccggcgaagatggcggcggagacggcggccatcaggagcgcgtgggccgcgggcaagggccccagcgggagcggcctccggcggcgcaaaagggcggcgaggatggcgtcgagggcgaggcagagcgcgacgtaggaggcgaggaagccgaggaggaaggcccaggtggagaaccacagccccgtggggctccacctgaaggacacgattgccgggtgctcggcgagccagtaggcggcggtggaggtggcggcggccatggtcgtcggcgtcggcgtcggcgtgtggtcgggtggatggaaagggattcgtccgtgtgtgtatatatatagcctcgagtttatttattggattcggatgaatttgtcggtcagctcaagctctcgtttctgatttttgattttctttgacgaatttattgatttataattagagttctagatggccttttgcataaaaaaagggtgagtttgacaggagactctctctaaattttcatccttttctttaaaaaaacgtcaggagaagggaccggagcggctaaaattaggctcgctgttttgggtttctagaggcacgattcgcgtgctcttttgctcctccttccttacgtgtttggttgttgccaggaccaaacactcttagttgtacatttaggatagctaaaattaatgaataatcttaatttcttttagtactccttttaatctgataactaaaattgagtaatataatctgaattcttatgttaacaaagttgttttaaatagtattctaataaaatttttagaattttttttttacacaaacataccgtttagaaaaacttgcaaagcgtgtaaacaaaaatccagaatacataataagaaaagaacaaggtcttcatgtaattcggattgcttacaactctgaaagtacatatacttcaaagagaaaaagaaattaatttggtacttgcaattgagaaaaaggggcaggatgattcacttacaaattaaaatgaaaagaaagatagaagggttttttttgaaatgctagcgagcactccacctccgccgccgtcggcgccccagccggtggcgcccatgctcctccgtcgcccgcagatcccgacgcccctctcggcggcctcctggccgtcggccgccccagcactgtcctccggttcgccaagaccgagcgccggcatgttctgggaaatctcgccgccaccgcctcctccaccagcgtccggtgtccgcctggctcaagacagcactacccacgtctccgagtccacagtgcccccacgctccttcgtcgatgcggtacgcaggtctccgggagccagctccagtcggcttgctccccaaccaccgccgcgtcccacattaaagtccgtctttactgtgccttcgccgcgacgcgacgcctaccgccgcgcctacgagctggctccgagagagaggagggacatcctccctcataggcgtacgacgccacgccccgcattcacgccggccgagccaggatggacagaggtcaaacctcggcgctggtggagagagaaagggcattcaatccatggccaacggcccgattcaaggcgagaagacggcgctggaaggagagccgccctctccttggaggagttcaaggctagaaccaggggacgttgcttcgtctgtctagcccgcgaccaccgggcattggcgtgccgcgaccccccgcgctgtttcacctgttttcgcaccgggcaccgagcgcgccactgcaattcatcccatctcacctaccgcccgctgcgtctggacgcaaaagcttctcatgctttcccaagaacaccaagagcagacagatctcgctccccgcgtcccacacaccgctcgcggcgcctgcccagagctacttgcgcctcgccaagaacaagcagatcccgtttcccatccccccgccgccgacatgctttgagtgaccgccgccggaatcctcctccaccacgcaagaaatgccagggagcgcctgacaagcgcgcccccatgccgcccctccccctgctccacagttgccgagaagcagagcttctgccaccgccgccgccacccactggtgttatggcgcaattgggtgacccggagacgcgccccctcgaggatgtcgtctttatcccgacgtcgcatgccatcgatgcagagctgtgcgagtgggagagcacggccacggtcacttgggcgatgccccccccccccccccccgcgtctgccactgccaaagacgtcgagcgcgtcattgccgacgagttcggcctacgcgcaggagagcttgctgtgtcactccactatccggaggccttcctcctcaagttcaagcaccgccggcattgcgaggaggtggtaaagcagggcttcgccaagggccgaggtattgaggtctacttcatccaatggcgcagccgaacatgcacctaagaatcggtggaaaccgacctcgtccaccctgttgacgccggcgacacgagggtgatctcgctctgggcatggactccaaacccgagccgcatccacaagcgcgtgtgggtgacaatcacgcgccaaacccgtgatccactcctcgagtcgatcacgatctcggagacgctgccggagcattggcaacaagaggtcaagcacccggttctcttccatattgaggagatccacgactacaccgcggcggctgtcgacctccgcaacccgaagtcctgcaggccggcgacgcgcaccctgccgccgtggcacctaggggttcttgacggcgagcgagccccgccgcgcctcttcgagaacttcccctaccacccgcatccgccgcggaccttcaccttccgccaaggtcgcgcggagggcgtggagaacaacaccgccgccttccagagggaggttcgcgaccaaggtagcagaacggtgagggacgccattggccgagacggcggaagaaggcaagagaaggggcaccgcgacaggcgccgggatgaccgcgatgaccgtcgcgggcgcaacaggaggtataacagcgaccacccagatgacctccgacgtggaggacggcgcgacgacgacaatgatgatcgcgacaacgggggacgtgatgtcgcgcacggaaggggcggcgttcgcggcccagacgtcaacttcaggcgggaacgcacgcactcgccgcgtgcccgcgatcgcggcgacacgggaagacgcgacgggcaacgccatcaagcaaactgcggcggcaaggacgacggggccaacgaccgcgacatgggcaacccacccccagcggtcctcaaccctgtcatgatggcaccggcgcgggtcatccagccgagtttgcccccacgcaacaaggggcctctcctcccgctgcgacgccctcgcgtcgaaaaggggaatgaagcccggtccgccgcgacgatcccggcggcgcgggtcttcacccgcatcaacgaggagatcactgccgcctcggtggagggggcattgcggcaaatactcgtggcggccggcgtggcggtggcgctcgacaaactaaccgcaccgccctccgcaactccttcactgctggaagatcaagtgcggcccatgactccgacggcatcgctgacggcaaatgacgcgcccacaaagaagcagctgccagccctgagcgcagagtacaacgctgtgacgtccctgttcgaggcgatgtcggtgaacaagccattgtcgccggaaccgctgcatcaggcaacgccgacgccgctcactcccacgacgatggatggagatgatgaagtaatcttcgaatccgcccaggtaacgccgaccccaccatgtgccctgttcaaagagctcccccctgcaatcctctccacgcctgcaatcctctccacgccgcaggtgctgatcgaccacgccggcgagctgcagatgccgaactcgctcgctgaccgcgccggcgaccttcagatgccgaccgtggctgctgctacgttgggagaagggcggaggaggagccctaggctggcgcagtagccgctggctggactgccgatgtcactgtgggcgcagatcaacctctgccaacgcatgggactggcaccgccagagggggccctcactgagaaggcgatcgccgacttcaaggcgatgtttaacatgcctctgccgcaagacgccattgatgccctcgcgcagctgttcggcctcgacaaggaagacatgaaggcagcggactcagccctggcaatgtacctgggtccctccgacatcggctgccaggaggagatagccgcggcgtgatagagctctgtcccgcgccccggcgactggagtagaccatctccacgtatccattttactttcctcgttcgcatcagcgtgagacctggacgcgcgccattggcatgatcatgagcagcgacattaccttccaaggccggactatctattcgcagcaatttcgcgaaccgacctctcccctctcggtgccgcaattccgcaccataacgatgtcagtgttagcacaaggccgccacgacgacgatgatagcgaagctcgctggccggcttgccccaccggcatcgaacgcgagagacaagagcgacgcaaacaagaccagccgcccgaacccgaacacgcactccctgggcaggaacgacccttccttggctcagaacgtgacggcgaactccaacgcctccccgaccgccatgatctccagccagctcggccgcacagccaccgactcgccgtggggctcggcgacgatcaccatgtacgccgccgacgcggcgccgacgttcctcaccctcttcgtcatggtgtgcacaccgccagacggcgacatgaacccaagccctcccaggccagttttggtcgacaacgcaacatctaaaaggcaacgcgatgggcgccgtggcgggcgcggcgaccggcgacgcacgacaccgcaacatcatccaccgtcgaattgttggcccaacgacaagttgctctggcccatctccatgtgaccatcctgcttgggccgacccagtgcaccagcaaggcccaacaacaaactgcttgctgcccccatctggaccgccacttcttgggccacccagcgacgccaaggctgataacccgggtgaaaacgccacaaaacaactcaatgggctgtatacagccaaagcagaggcctgtaaagatgtctccctacaatctcaacctagttttatgcactgtgcacaactccccccttgagaaagattgtttctcatgacatatccggtcatcgacatcctctcttggaacgtctgcggtttgaatagaccagccagaagagcgacggtaaaagagaccctccaagatgctaaaccccacatcgtctgtctccaagaaactaaaatgagcaatatagatgctagaatggcaagctccctcggtgggggacgcatacgctccttccagttcaagccggcaacaagaccgctaggaacaagaggtggcatcctgatcctttggaatgatgattttgtcgacctcaaagatttcgcgcaacgaaccttctcactctcggccacagtcttcttaaaagcttgccaaacatccttccttctcacggttgtctacgggccaaccagagatagtgcaaagcaagccttcctgagacaactacgcgacaccaagccagccgacaattcaaaatggcaagtgctcggagattttaatataatctacaaggctttagacaaaaacaacatcaacctcaaccgcaggcagatgcgaattttcaaagataccctcaacgcttgcgaactcaaggagatcgcacttcagaatagacgctacacctggagcaacgaacaagataacccgaccctggtcaagctggatcgtttcttttgcaatgcaagctggaacacaacctttgagagacacctactgcatgccctctctacctcactctctgaccattgccctttgatgctaacggggcaaggagagactccacgaacgagaacattccgtttcgagaatttctggattcagctcccaggcttccaagaggtcgtagcagaagcctgatcagccccacaatcccaccatgaagcacaccatagactctttcacaagctgggacatacgtcaaacagcctaagatcgtggagcaagaagctcatctctcaggggaagctacaattccacatggcgctcgaggttattctacaactcgatatagcccaagagtcaagacaaatgagccaagccgaactcacactaagaaggggcctcaaagatagagtactggggattgcagttgtggaaagagcccgtaaaaaacaagctgcacgaatcacctatcttaaagagggggatgcaaacacgaaatttttccacttgaggatgaatgcgaggaaaaggaaaattttcatccaaaggctacgagtggggaacatgtggaaattaaaccatgaggaaaaagctaccgctatcaaagaacacttccaaaacttcatggcacgcccaagcccacgcttaaaagaccttgactgggatgtcctacgattgccgccgccgactgttccgcaattaatggccccattaccgaagaggaggttcacgcgcgctaaagcagtctcccagcgacaaagccccgggcccggatggcttcacaggagctttctacaaagcctgctgggaaacgataaaagatgacatcatggtggtcattcactccttcaaccatttgcgaagcaatagcctctcgattctcaattcggcaaatgtagtgcttataccaaaaaaagatgggccagaatgcgtgggggactacaagccaattagtctcattcatggaatcaggaagcttatttcaaaagtgctcgccctacgtttacaaccgcatatgggctccctgatcagtcatgcccagagtgccttcatcaagagaagatgcatacacgacaactttatgtatgtgagaaacttgacgaggaaattccaccaaacaagaacgccgactctcctcctaaagctggacataaccaaagcttttgactcggtgagatgggattaccttatcgatctcctccagagaaaaggcttcacatctaggtggaccaattgggtctccaacattcttgcatcttcaacaacaaggatcctgctcaatgggtgcctaggaacgcctataaagcatggaagaggccgcagacaggaagaccccctctcgccgcttctattcatcctcgccattgacccactccaccacctcctagagagagcaatggagttagggcatctatccccacttagggggagagcccccaggttcagaacctccctctacgcggatgacgcggcaatctttgtgaatccaagcgttcaagacatgacaaatctgactggcatcctaagcgactttgggcaggtgaccggcttctgaacgaacatgagcaaaagccaaattgccccaatccgatgtgacaatattgatctgtccagcattaccggcatcttcccagcaggcctaacaaactttccaatgaagtaccttggcctaccccttgtggtaggtaggctaaagaaagtccacattcagcctttgatggataagtgtcgatcgtgcctcgccccttggcaagggaaattaatgttgaccgccaccagaatctgcttgacaaattcggtcctcactgcacagcccatctaccacctaacatctctaaagctgccagatggaaccatagaagaacttgacaaaatgaggaggaagtttctttgggcggggggcgaaaacatctctggcggaaaatgcaaagtaaattggaaaagagtctgcaggcccaaagacctgggtggtcttggagtcatggatctacaacaattcgcatcagcactgcgactcagatggctttggaatgaatgggtggcaccagaaaaaccctaggtggggacggcgctaccgtgcaacaagttagatagagatctcttcacggccgcaataacaataacggtgggcaatggcaaaactgcacgattttggagctcgaaatggctggatgatcaaactccgaaacagatcgccccggatattttttttggcttctagaagaaagaacagaacagtgaacgatgccatatcagaaaacaactggatccgagacatcgaaatatctcgtatcaccgaggcaagccacctccaacagtatgtccgcctctggatagtgattagaaacatgaggccgctaaacgaaaatcaagacaacattcgatggaacctcacagcaaacgagcagtactctacaaaatcggcctatagactccaattccttggggctgcgcgatccatcttcaaccaatcaatctggaaggcctgggcgccgccaaagtgcaaattcttctcctgattggtcactcaaaacagggtttggacggcagacagactggagaaaagaggatggcaaaaccaaaagatctgcccactctgctgcatggtggatgaatcggccctacacctcctggccaaatgtaggctaacaaagagaatatggacataaatccagagatggacaggcactgaccttcagatgggtagctgggaaacttgtcactctgttaggcagtggtggactctcgtagcggagtccccaaataccccccgcaagcctctaaagactatgattatcctagtatcgtgggaaatctggtgcgaacgcaatgcaagaatttttcgaaactctgcgtcatcaccgtcctcaatcctagcaaagatcaaggaggaaggaagagcatgggtcaaagcaggggcaacaaccctacaggagtttggaatcctgggaaatatcacttagctctttttcttttttgcgggctagtctttttcctcggctaaccctgtatatacccttgtttatttttctcctgctctattaatatacacaagacaaagcttttgcctttcttcaaaaaaaaaacttgcaaattaaaaagatgttgagaaaaagggtagagcagttaggattgcaactgaagaatggtcctagctagcctaggagtatattgtttaacgtttccacacgaggatggtcttcgatgaggtcgtcagtcggcaccgtttctttcatttgattatctcgtgtcctcgatttaacaagcacacacttaatttaatccattgcatcatttcctctgtcttttcatggacaccctcttgcgatctgtatgtgcttacaaaacagctgatgtactcatcagaaggatatgtaggccatggcttaattaagtagcagattatgcaattaatctggttccaacaaactagcagatatatgtcaaagcatgagcttggaatatagcatgcatcatcatcaaccgacctagagcctgagaggaaaaggacacaagacatctggctttcaacaagtgctggcttgatgatcatttcttatttgtctcttctccttttgccttttggtgtttctcatcagagtttgagagcacaaaacctgtgtgccaactgcctgaattcattcagtcagtcagtcagtcacgatttgcattacaagaaattattactaccagaagatcagagggcaacgattttctagatgcatgacatgaggtggttacgttgtttcatgatcatccaacgtcgtcgttctagaacgtggatagagttaagtggaatactagaatcaactcaatcaaggaattttctttttcctcatcgtccagagaggcggttgctttttttttccaggtttcaattgtcaattcgtcgttagctgcttgtttttcacttgtttcacctccatatatctctttcatgtatcaaatattgtatatttcatggattttgctttggggttgcaatctattatatctaagctttacccctttttccatcaaatttattctatttacatcaggctagatatttcctttggagctaagggctcctttcaaaggcactattaacaaaatggaggaatataaaaaaaacacattattttgataggattgtaaatatagggctggaactcatattaaaattcctctaaaacttgtacatatattgagacattttcatatgattcaatactgtcctatcctttatttaaaaaaaactgcatatgaaaaataaaatcttatggaattgaaattctataaaactcctattacttccatctcatattataagggatagtcgatttatttgtattgccaaatcccttatattttggcaaatcaaatggggcctaaaaatagacctaagaggagaagtcatgttgtcactgatttaaggtgcttggagtctgaaaagagttttgtgatctgttgcggcagaagcataataccgcaaaaagagaagaggagattcttgatgcctgggcagcatccatgatatgaaagaaggttatattatactccgtattattctttccaaaaacaagcagtggattgttcttttcagaaatgagaggattgtgcttccctaccaacctttcgcttttgagaattaaaggaatccatactgactaaataattaattagcccaaagaaaaagagtacagaagactcctgagaagctcagtttttattggtaatcataaagcaatggggagaaaaaacaatcaatcagtggagcacataagtgtggagttcatcttgacaagaagcataaggcagcaatccacgtactttttctctacctttgttcgcaaacaaaattaacaaccaaaatcacctcagaaacgaacacagtgacggtgctgtagaaagaaattaagaagaatgtcgccttcaaagcatgcacaccacctttttttttctgaagaaaaatgaacctgcagtagtagactagtcaagccatcgttttctgcatgaagaaattagtaagaaaaaccatgtacacagtgagtgagctactctacacaatgagtggcacacacacagcatctctgaattgtgcaatgtcagttgcgccgtcgatggagacggataggatcggagctacctactgtatatactagcaactgcaactttcagatttcagattacgaaaaaagcaagcaagcaggggacggcagacaacatgcggtagcccagacatggaccgatcggagagggagaaaagcggaggtcaggttgggccggcgtgacgacgacgacgacgacggcgaccaagcgctggccggctgactagtaatgaagatttcttcaggcttagccagctaccttaataattaattaggatgccaattaattaagctacatatatatatatatgggattgtctatatatcctgtgattgaaaatcccgttccatatcatttgaattttggactattagatatgctttcgagatttgtgcataacaatgatcttattattttcctccccgtccccttctccctcccaccgcacgcccccggatccgtcacgttttgttcccgccgctgatgctagcccaccgtactgccctcctccacctcgcgcgacattggcggtgccacccatcggagtccatcgcccaccactagttctccgccatccacggtcatccctctaaagtcggtaaactctcccctttcccccctctgctcaccctcttgccatcttaatccggcacctcttgttctttgagtcagggttgttgctgccattcgctaaagattaacgtggttgttagagttgaaagagaaacttactagagcaaatcgtgaaacagatataatgttataaatctgtaagattttaccttaatttttcaatcaagagtgattccgtatatataaatatggcacgtacagtgagtgcaggatcgaccagttatattgacgatgaagttaagctgcactgttaatgtgtgtggctgcaggtcgggttgcatgtccacacgtggaacacacacctggccccgccagctttctatcacgccttcatgagccttccgatgtctcattctgatagttaattacttagcttcttgttaattactatctctgtttcgaaatatttgataccgttgacttttaacataaattttactgttcgtcttattaaaaaaattataaaatatgtaaaactatatatatacatgaaagtatatctaccaatgaatcaaatgatagaaaaataattaataattatataatttttttaaataatacgaatggtcaaacatattttaaaaagttaacagcgtaaaatatttaaaaacagaggctgtactagagtatacataagagtaaaaagaatatgtgagcacagagttaattaaggaggagtattaggtagtagctatagacggttggctggctatagtatgatgaggcgacatcgatctcaacttgatatcgacacgcacgtgttcgtcgttgcgttcttcagcgtctgatgcatgatacactccgatcaattagattaatcttttataaaactgggaaaaattactaatatggacccaaacgcacgcacgttttgatttaattactggttttgaatagggaatgggtccgaacgatgtatttatatatgttaatttcatttatcttggtttctggacatggattcttaataagctctagaaagaaagaaaggaaaaaccatagattctagaagcaggctacgtaggtacgtatggcagcaaactaagacgcatggcatgaggaactttgaattgacccccggctctctaaaacatttgaagcaaggattaatttggaattggatgaggacgagttgattttttttttgttttgtggttttaaggaaggaaaccacgatcgattagttgacacagaaaaactttctactacagtagaatgaacgcaatccgcgtatatagatcgaccaatgatacacacacagcatatgaatcctttccaaaatgaaaaaaaagagagaaagaaatactaagtccagaagaagaatacggtacgatgggcctaatggaagcccattgagaacacacacaacatctgttgggccttcacaagatagattgtcggcccaatacttttgcaaacaaaagcaggtggccgcataattaatttttttactattaggagtactatagtagttacggtaaaattaaaagagttatataaaattagtgagaaaaaaagaaaaagattagagggggacccacccacccatgcgggacccgatcccctcgcccgcctcgaaccttctccgccttcctcttcctcttcgtcttcctctgcggcgcacgcaggcggcgaatcctcctccgtcgacgcgactcctcctccgccgcccgccggtgagtcatccgcctctatcctctctacctcctcgcgagcttgatttgctcggcctcacgtacgtaccctctgcgcgattaagattcttcctactttccagattagattagattagagcagctagatcggatcgcccgcagcggatctccccctccatggatttctcttcttccactcttactgctgccctggttggctgctgcacttcaactgctgtgctgctgctgctgcccatcaccgatccctttaacctagtttgtttctgcccatgcgtgcgggggttactgttcatcgattcgagttgcttgcttctgccgcttcatattcagatcgatctctataggaaacgatgtctagaactaagccccggttcatgtttgcatttatcaggaaccagcagccagtttacatcattttctcttcttcttgtcgtactagagacatgcttcaatcttctcagctagactagattagacttggtctgaatcccaatacctgcattccataccacacacaacggccaaaatgtaaaccgcttctcaacttccaaatcatccatcatagtcagcggttttaatatttcgacacgccgaacctcttcctgcatatccacaccttaaatatagaaaattgtcacaaccaactttcatgtccatatcatagaaatgatattccagataaacgctaggaagttcagtcacagctacataatactaactcaagagaacaaatgacgaatacttcagtttctttgcaaagcagacatgt

SEQ ID NO: 41412 - DNA, 1948 bp, Oryza sativa
aatacaaacatgttaaattatcatccaacataatttacataatgtttcaatgtatatctttattatgttttatgatatcctatatagttttatagttcatccttatttagttagtgcttaaatgattaatctatggtccaaattatctttctcattttttcatctaattaagtcatatcacatcaattatttttaacctttagatgattaatctactttccaaaccatctccttatttttcttcttccaaaaagtcataccaccttactttttacatttgaatcaccattgtacatactatttaaatttaaattatcataaaccacattaacttacttcttaaactgatgttatctagctatcttacaggttatttttattgtttccatactaaattttccacagcaatacgcgggatttcacctagttaatgagatatgcataccacaatcgttcaattcagtcatatttttactatcaatcacttattaatccattcattttaaattactaatcgttacgttatatattagtttaaatcaaacattttaatctttaacgttaatttctataaactcatacagtttaacatcataaaatttatatttttatataccatagaaataatttcataatatatgaatcacatgctaaacaacacatatttttaaaattggcatatatgtagtgctacataatatttatagttttcatagaaatattacttgtcgcatgtacttctagcaggttttcgggaggaatctagaaattaatggtaccactgtacgacaataaataaataaataatgctattgataggccactcggccagatgtcaaaaacctaacgctactcttgatacatgtgggaatatgtgtacatgcataaaatatttcacgcgagcttcaaataatattttatcctaaacaacttatctagcgcccgtttcgtcatggcgcctagtgggaaaactatctcttaaaaatcctaaatgcaaaaattgtttccttgattattgtccagtgtccgtgccattccagatctcaaatctccaatccatcgtcgaatccaaaccctaatctcaaatatgtcctaaatcaaatcctctcgaaaagtctactttgcctcccttgagtctgtgggccgatctcttctccccggcccatttcctctcagcccatctctccctcctcctccatccttgcccgcacgtgcgaggcacgtgcgacgctcgggcgctgagcacgagagagagctcgctctctctttctcttctccttccctctctgctcccgctaccgcttcctgccgacgccgcccaaatcgccgcgccgttgcttcccgcgcgcgtgcgcgcgccatggtggccgacaggccagtcgccgccgccgtcagcgcctgccgcgcctgagcccgcgcctgccgccctgtagccgcgcccttccaaaccgcccccgccgtcatcgccgtcgtcacgacccggccccaccaccaccgcgcatgcttccaagggttggaggcagagctcctcctcccactgtctcgtcgccctctctctccttccttcttttcccaaagtggcaagaggcaagtctcctttccctctttcctttcttctttttctcccccgccggcgtcatcctccctgtcgccgttttggccgctagccggagcgctagctcgctggcttgaccgcccaatgtcggttccgccctcccaaaccgacattgtcgcccctataaatccgagcccctttccccattccaaactcccttgttttcgccttccgtctccaccgcaccattgtcgctccgccctacttgcacctccgccattcgttgccaaagcaccgggagagccggcgcgtgcgaaggacgcgtgaaggggactccgcgcgctcgtcttcttcctcttccccggccagaggccggagagatcactcccgtgc

SEQ ID NO: 41413 - DNA, 6929 bp, Oryza sativa
tcgccgtttcccccttctctcgccgccggttgccgccgccgcaacccgccgccgtcgagccccctccggcgaatccgagccgttggctcgtctccctttgtcccgtgcaacctcccggtgcgctcgcccatgcctgcatcgctgtagatcgccccgccgctcgccgccgccgtccgccatccgttccggccgacgtcgtcgtcttcctctcaccagcccacgtggctgccacgaaggcggcacgtcggtgccacctcggccgcgaccgggtcaagcagacctcggtccgccgctcccctccgccccgctcgcgcacgcggtccaccgcgagccgtgaggctgcgcgtgggcccgccgcatccgcacccaccgcgagccgcgcgcgtgcatcgcgccccgctccaaaccctagcgccgcgtcgcgtgctcctcgctcacggtgagccgagccgccgacaagcaggtcccactcgggatcacgcgaggtgagcccggtccaccgactccctctctcctcccctcccgcgtgcctttgggccgccttctcgggccggccggcccattagctcggccgagtcgcgcctcttctctcgggccgcgccctagccgcccgagggaagtctgtttcccctccctctttcgttgctaattcaaaaagggtttaaataaatccttttcttttagtccaaaaatccgatgatcttagaaattcaatatcttttcaaccatacatccgtttgactccgttcaacttccaaaattcctcaaatctcgagatctatctaatggcacgcttagaggtcaataatagggctttaatttcgccgtttgttgagtcatctcgttcgcgtgtagcttcagagcccgaagacccggagtgcgcggatttcgaggatcaagctcaagatctcgagcaaggcaagtcaactttgatcatcttgcacctataatttaaagggacaattcgaaccatgccacacaaattttgcaaaatttgtgatatgccaccctgacccacatgtcattgactcatgtgtgtcctacatgtcattgagatacgggtggcatatctcaaattttgcaaatatagggtggcatggttccaacaaaccctaatttaaatctaagtatttcttttccacaaatattgcatgaataggattaacacaagtaaatcggccgcggcttgcgagatagcctgccggcccaaccctaattgttgcaattaccctccttgaattattgaacacttaaacctcctttgtcgactgttgtgcttcgatgcacgggacttcgggcacgcgcatcgggacacctcccctcaaatttaaaatatccaacgatgggtaaaacttggggttttacaaaagacttggaaaaacccgacacctgggtcggtgcttgcgaactaaatgaatttccaaaatcgcggatcgaggaacgtaccgggagtacggtttcccgctcttgcacttaaggaccgttttccttggaatttcatccgaacataaggcaagtgcgaccacatgggtggaatgggatgcccctggctgagtaattagctaatcgaggcagccattatgccaagagacatgtggattcaacggggtggtgccagggagaacccccgggcttcctggcacagtatggtctgggacctaacctaatgtcggtttgggacccctctcgttggcatatggtgaacctgtgtcagctttcgaaatgccttgtcatgaaagcctcaaggtctctagacgtggccgttctgcacgggctgggtgatccgggttagtaatgtcgtgtgggtaaagtgtaccccctctgcagaggttattaaactattcgaacagtcatgcccacggtcatgggcggatgtgaggtgattcctagcgtagttttgtttgactactgcttgtgaaattactgttgtggaatgggttcgatgtttggaaaatctgcggctgatgggatcagccaggcccgggtgcccgtttgaaagccgttggccgggtgccaaccttgaatcaattcaaagactgatacattgcacatactccgaccggacgagacgcactacctcatccgtgtcgtttgagaagcactcacttagttgtttcaaaaaggagtttaaataaaatcaattgcaaaaacaacagtctttccttgaagcctgcattaaacacttaattcccatggcttgctgagtactcctgtactcacccttgctctatataaataattcccccccagttgctgaagaagatgaagtggatcccgctgatgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactgtacttctactctgtaataaagagacctctgttgctgtgatattctgtcttcctgtgataccagcactgtttcctgagactggtatcgattaacaggttaatttggagcgtcacgggctagttccgttcggggcgtgacaacttatccaatctatgatccaataacactgttatactcattgcaattaaatgtttgcaacaaggtactatagttaattctttacatatatattctaattaaaaaaatacatgtttttatcatttaggtcggatgtttcacacttcaaactgaaatctttcaactggtctgttactatgttgcacattttaattttgttttataatatgtctttcttaatgttgcatatgaaattatttggatgttttaataagtgcttttcccatgtgttactagttcatttgaaaacattacatggtaattatattttagttaaaatatacatgtttcaattatttgaggtcggatgtttcacacttcaaactgaaatgtttcaactggtccactactgtgttgcacattttaattttgttttcataatataaattttctaatgttgcaaatgattttcttggatgttttaataagagttttctcatgttttaccagttcatttgcaaatattacatagtgttgtttgaatgtttcagcagatattttgtgatgttcttgatctttcacgctttatataaaaatattttaactacaattataatgatatactatttttctccagaacataatcatatgaggtcttactgtaatcatttaattgcaacaaacaaacgatggaatcgatcacataacaaataagtagtttacaagaaaatatattgatacaaataaccgtaataatcaagaggtccatatatgatatatggtccataccaagtaaatatatcacacgactatatatatccctagcagccacgaacacacttcaactaggttattgggatcaagatacttaatgtgttgggcttttttttttccaaacaattatagaatcagttcgtaggatcaaagatactaattttatcaagtatatgatttatgtaaaatttgcaatattgtaaagtttgaagatgataatattagtttggtagggatcgagctaataaccttgagtccaactgcgagctactaaggagtactccctccggttctataataattgacgttttggacaaggttgagatcaaactttaataactttgaccatcaataacttcaaaaatatttagtttgaagaaactagaacaacatatatagatttatctttcaaaacactataataaaagtaaacatgcatttatttattatgtatattataatagaaaaataagttcaatggtatattttgtagaccgtgtcattgttcaaaacgtcaattaaaatgaaacagggagtacttattaatcgtgacgaatatttgcatgtaacagtaacaaccaattaaggcagattaattagtaggactactgtacatggtgtatacaatttattaatgttgttctaggatggatcatttgcatgaatggcagcaaataatgaattaatcccctagctagtagctagctagctgcctactccatgtatagtcttttatacggagtaacaaattaagatgacccctaatataatttttccgttaaaaataaccatcttttatatgaaaaacttgacataggtcccaacacaagctatatctacttaactgtcaagtactgttcatcagccaatatatcattgcatttaattatatatattcgtgatgtgtgtgtacctttaatttgacgaacgtatatatgttgctttctagttgatctcctcgccattagttatgattattgagatattttaaaactgcctttactttactgataacagagttaatctatattgtttatttctttactaactactatcttatgaatcatatttatttatagcagatctatatacagtatagatatcgactactagtagtatagtagtatagttgtatgtatttgttgtactgtattatgtctcgtctcaattctaagaattttttgaacggtgagaatatgcactttcagcacgatgatcactaaaataaacagggaaaatatgtagtgcaaaactaactatgtatcgaaaaaggacgttcaagattcgtccacaccaaatcctggacgtacatttttttgattcagcgtgaattttcagacttccacaacatatatagtttccaccatttttccaaataagcagatactcgtcagtaatgatgttttgatgattgatagataaagagagcaaaaggctagctacatccaattcgctagctagctagagtatatacacgcgtaccgcatttatatggatctgcaattaattctacatggagatggatgtaaatgagtgcttgatcagttacgttaccaaaacgatcttttgataccatttggcgaattaaattaaatggagcagatctaatttgagaatgtatatatgaatggtcgagggacatgcatgcatatcattgtctaaaataaagatggaggtagaagcggtctatctcgggcgccctctgcctctggtggacaaggacgatttgaattgatcgatcgattaattattgaacttttgtcatgactcgagacggcgacggaaaaattgatctgcaggtacggtatatgtatatatctcgtctcagaaaattaattaactaattaaccgcgtatctatatctcattcgatagagatatatatatcgcaaaagtacatgcaatttgtcagtcttgagtttacacttgactacacacgtatacgtgcaagcggtaaatggacgttgctctcagttagtgtatgtggcaacgtgacggccggtaatctagctagctgctttcttactagtactagtactactactttagctacaactttcacaagatagctaataagatagatagattcttctcacttgctcttgtgaaagggagaaactgaaggcatcgagcatgtacatacgttcagattgatccatacaaatacaagtacagctagcatgcatgtatacatatgtacagatcgatcaatataatgtaattaatgcgtatatatatgcatggcgatcgatcgagactgcagacaggccggcatgcctgccgatatccagcttacgactcaatggccagcagtgacaggttttgactatagagacgatggtcaggagagagtgactgtggcagtggtgcacgtaagcatgcggacaagtcatgtcgatcgagtcaaagctagatctatctcatgaaaatgccaacatgcatgcatgttcaaccgccgtatcaacacatagggaaaaatgtttctatctcccgcgacgtcgtatcatgcatgcatcttaataatattcgttaaaatatttaagaaatatcaagattaatatgtgatatatttttttctcaacaaacatatgcaataactataacttacacaaattgaatttaagcttcgtacgtttatagaataatatatctcatattaatttatatatattttatataaagatatgatacgtaaaataccaagagatgtgtctggagacatgcaaatctatctctgtatcgatcgtgcatattgatcgacgacgacgacggtgatgtgcactagctctagtgtactgtacatcatgtcgatcgatcgatcaatcggtagtctatatatatcgatccggaccatcatcctcctgtccactgccacgcgcgctagctacttgttgagtatatatccatcgatgatgcatgtatgataggagaaaattaaaagctactctaggtttgttgttatcctgcagtacgtttattggggatcgatcgatcgacaggccgccgcgcgtacacacatatactaactccttccttaaatgtttgacgccgttgacttttttaaacatgtttaactgttcgtcttattcaaaaaacttttgtgaaatatgtaaaactatatgtatatataaaagtatatttaacaatgaatcaaatggtaggaaaagaattaataattgcttaaattttttgaataagacgaacggtcaaacatattttaaaaagtcaacggtgtcaaacatttaggatggagggagtatatactccatcgatcgatcggtggcttggatatataggatggatgcatcatccatcgatcatgcatgcgcacctgggctagctgcatccagaagctactcatcgctttcatcctgcgggattcctgcccaagagtagctaggactcaactcatatataatttgttcaatttttaaattacataatatgatgctagtagtgatgtttgagtccgttccaacgccataattaaactcacatgtaggatcataagttccccacacgtgtatacttttgctttggatatgacatcatatacctaatcaactaactatactataaacttataacgtttgcttttg

SEQ ID NO: 41414 - DNA, 14053 bp, Oryza sativa
gcataaaaaatacttattttcctaggtgggcttcattcttctttattcaagatagtccatgtatcacaaacccacacaaacctcgaaaaaatgttaagtcatattggaggacatgtggcttcttcatgggcaatggggaatggggaccttggttcccaggtcatcaactttaaattttctgaaaatatcaagtgttcttctgttgtaatcaaataagtatatatcttctgttcttttaagtatatatatattaagttgataaatggctatagcgattgagatgtatctttccattttatcgactaacttttatagcacgcatgatataaattactactcaatcaagagttccgtagaattcttcacctcaaattttgtttgtaattggcaaatataaagaggaagaagtactgtagcagtatataattaagttaggaaggagaggactcatcggatcgatcgatgaccatcgagtcgcgtcgatggatggatcagctagcgtcagacttaattcggccgccgcatatatatgcatgcgacaaacttaatagctactccatccgtttcaaaatatttaacaccgttgactttttagtacgggtttgactattcatcttattcaaaaaatttaagtaattatttattcttttcatatcatttgatttattgttaaatatactttcgtgtacacatatagttttacatatttcacaatatttttttgaaaaagatgaacgatcaaacatatatcaaaaagttaatggtgttaaacattttgaaacggaggagagtactatccagttgcactgtatactccatatatagtggcagtgctagcaaagtcaaactaatttaattaattattaagaagcactcgtatgtatatatacgtacagttgccgcgctcgctgcagcaagttgatgatatcgactagctaagctacccagttagcagccggcaggaccgatatatccgcaggcggctaaagactggagtaattagcaagccagtttgagtagtaactagagtaactaataaacacatgtgcagaaactgagattttgtaatgagtagaagtatgtatctagcttcacgagcaagctaatttaattaaggtagcgtccatttttttttaaaaaaaaagaaatcgtagctagagaaggaccggccgggaaaacaaaatcagctgattaattgacagtatatacagtatagctactgtagtaaattgctttgcattgacgttgaaatctgaaagcagaataatctgcagtccatcggtactctctagctagtctgtacgtagtaatatctctctctgtctactactagtactgcaacttgttttgactgtcattgctggagtatactatatatgattgataataggagtagtaattaataaataatgtacacttgccgccggaatacatccatccctacgtactattcaccagctgcggtcatcttgactccacacttgatcagtagcactcatactcaaactaaccaccatttgctagtacttcctctgtttcacaatgtaaattattttagcatttttcacattcatattgatgttaacgaatctagacatatacatctatctagatttattaacatcaatatgaatataagaaatgttagaatgacttacattgtgaaacggaggaagtaccaattaagccttcttttcctttggtcaaataaagttaactgaaaatgacgttgtacacatacacatccatatacagtttccggccaaaaaattactaacaccgttttgactaatctatgtgtatatcctgatactggccgacatcaacttaattacatcatatcgacccccctgcccaaactatcggacgaactaagctagagtgtagcaaaatcacacggtacagctaccatatattagcttgatccacaagctccccaaattcccattaattaattaacctgcagcctcaattatttggtctctgactcgtgcttaagtatacactatcatgcgcaggaagacagatttacaggtggatggatgatttgtgatgattattcgtgatttgcgataaatggtccctggtaattaattatttgagagtacagacgaaggaatgaattaaaattattaattatccaaaaaaagtagtatttgtaagaaactcatgcatgaaaagtctttttaaaagaaaaatggcaccattatttaagtacttttgcagtgagcatatggtacttaattgagcactgtgcatgtggaaggaaggcaatctcacaacaattaaattacactctgttcatgcagttcagtcgacgttatacatgcccttgaatcgaatcaatatctttgtgtctgtctgtctcttgctggactctgcttctgctaagcttatttataggcctccactcactcatctctccttgcactcctccctgcatgcaagctcctctatctagctagctactctactctactcgatcaagatcaagatctatcatggacgcagcagcagccatggagaagcagcagcagccgggcgagaagaagatcaccggcggcgaggaggaggaggaggaggaggtgatcagcagcgtccggtaccgaggatggaagtcgatgccatacgtgatagggaacgagacgttcgagaagctgggcaccatcggcaccaccgccaacctgctggtgtacctcaccaccgtctaccacctccccagcgtccgcgccgccaccctcctcaacttcttctccggcaccaccaacctcgcccccctcctcggcgccttcctctccgacaccttcctcggccgctacaccaccatcgccgccgcctccctcgcctcctgcctcggcatgcttgtgcttaccctcaccgccgccatcccatctctccaccccccaccttgcactgcctcctcttcctcgtcgtcgtgccagggccccacacacggccagctcgccgctctcctcgccgccttcgccttcctcgtcgtcggcgccggcggcatccgcccctgcaacctcgccttcggcgccgaccagttcgacccgcgcaccgactccggccgccgcggcattgccagcttcttcaactggtactacttcaccttcaccgtcgccatgatgctctccgccaccctcatcatctacctccagagcaacgtcagctgggcgatcggactcgccgtccccgccgccctcatggccatctcctgcgcgctcttcttcatgggcacccgcctctacgtccgcgtccgccccgagggcagccccttcaccagcttcgcccgggtcatcgtcgccgccgtccgcaagcgccgcgtccccgcaccggcctccgccgacgacctgttcgacccgccgcaccagagcaagctggtggccaagatcgcgtacacggaccagttccggtgcctggacaaggccgccgtggtgacgccggagtcgagatcgagcccgtggcggctgtgcacggtgcagcaggtggaggaggtgaagtgcctggcgcggatcatcccggtgtggtcggcggggatcgtgtacttcatcgtggtaacgcagctgggcacgttcgtggtgctccaggcgctgcagatggaccggcggctgacgaggtggtgggcgttcgaggtgccggcggggtcgatggtggtgttcaacatgatggcgatgacggtgtggatcccggtgtacgaccgggtggtggtgccggcgctgcggcgggtgacggggaaggagggcgggatcagccagctgcagcgcatcggggtggggctggtgctgtcggtggcgacgatggtggtggcggcggcggtggagcagcggcggcgccggctgggcgcggtgggagtgaagatgtcgttcctgtggctggtgccgcagcaggtggcggcggggatgtcggaggcgttcgcggcgatcgggcagacggagctgtactacaggcagttcccggagaacatgaggagcgtggcgggggcgctcttcttcctggcgttcgcgctggccaactacgcgagcggcttcatggtggcggcggtgcaccggaccacggggtggctggcgcaggatctgaaccacgcccgcctcgacctcttctacctaaccgtcgcggccatcgcggcggccaacgtctgctacttcctcctctgcgcccgctggtacaggttcaagaacaccaccatcgccgaccacgtcgagctgccggattatcatcatcatcagcccggaaccgccaacaccatagcctccaaggtttaattaattttattatcacaatcgatcactctactgtagatggtagatagatttagaggtacgtcatcgatcgatgcatcaccatacacagtaggagtataatatctgtatgtatcagacgcaaaaacactataatctcttcttcctcctcactctcacgcgttccacggcaagccaatagcccaatactacgtacaatcgccttcctattttatgttaacaagaaaaatgttactaactcactttataggaaaaaaccggaaaataattctaaagcgaggagaaccataaaaacaactatatggagagaaaaacagagaaaaaaaactctgatggcatcaagtccaccactactgcaagcagatatttccaatggcttttcgtagacctgccacaaacgccaacagccaatctatctatctattatattattaaagaaatagaaaaaagagcctccacgttcgctctcatggcctagaaattctcacattaatcggagaaaaagaaaaagcagagtctatatagaaatacaatttaaaaataacgaaaattcggaattaaaaaaataaggaatattagaagaggagactagagtagttattacacattagtagtttcgtaaagttattgcaaaatttaaaattatgttgtcattgtaatatattttaataatataatgagaaaacatatatgctattatatgagagaaaatataatgatgttagccgagcaatctgcgcgggccaccatgctagttatctttggatatcacaattttttacaagcgtgcaccttaaccacgcgtataaaaaatgatttttcatacgacctccttaataaggcgaaaaaatcgatttttttcaagcatgtacttaaagacttaaaacaattgactacacaagatatttgagagtcccattggtcggtctaataagctaaagaaaaactaaaatttaaattttttaacttgattttaagatatttttaacgtaattttttttagcactgactcttaagtcgctaccaataaatatacaaaagttttacctacaaattaaattttattccctattaaatgttttggcttattagagaatatgggcaaccgatgagacactgaaagaaatggtaaaagaaaaaagtgttttggcctcgatcctcatttgcaaaatacaatgataaagtcatcgtcgttgccacgacaatctagtgtcgtggttggatcccccaagccctgtcgggactggcggaactgccaggtcatcatcgtttcgccggtcccaacgaccgtggtagattgaactgcttcctaggcccacgaccattaattcgccgcctcccaagcatgtcgccaccatcgattcgcggcacttggcgaccgccgacgtagtatccatcaggctctgctgcgcctgtcatcgatccaccacttcccaagccggcctccatcgatctatcgcacctggcctccgaggacgttggatgcgccactcccaggtcccatggatgcctcctcttcatatcaccaaccgatccgtaggttagagagaggagaggggagaggtggttgctcctattgttgagattgacatttgagacggatgggggggagctagtgaggagaggagagggagagaggaccggtggattcgatgtgtgggagagggctggggatttggtgcgtgtcactacccttgcgtgcacctagcccgattttatatcaatagttgtttatttctagcaggcagacgtgtattttcacgtgttgttgtctaagagacccgcatgtaaaaatggatctatttttacaggtggtcctcgtaagacgaacacctacaagaaattattttcactagcgggtcttgacagggatcccctatgtatttttgcaggtggatttgctttttttaaaaaaaaacacatcaactttattaagcaagaatagaattaggggataaaccctgttacataaccaaggataaaaattgaaagcaaaagagccacccctgagaagggagggttaactgaactacagaagcaatcttcctgaaataacctaacagcagaaaaaggagcaagtcaacagggatctgtggcgaagccgcgacgactgctatcctgggcctcaaaagatgtgcactccgcttggcaaaccgttaatccccatcggctgcatctacggaaacggcacaagactgaggtttgttgctgagccgtagattttggtgtgtgcgtcaccggactcagcgaaggatccccatgaggctcatcattgaatctaaggagctctaacatcgaccctgtcaaccgaaattgcgcaggtggtccgagctcaacccgaatgacaaacccggtatggtttcttctgttagggaacaacaggaagggtgaatccgaagagcaaccaaccttcaacgatggagcacttgaatggctgcaaatcaacttctgtcttgctgagatgatggagatggttgaggaagaggtggatttgctttcagcccgcgtgcaaaagtcaagagatcatcgggtgtccgcgaaaaccatttgttatagtgtattaagacccgacatagatcatcactgcaccaagctcatcacaatagacaagcaactctaacttattatgacggacaactgtctcaaaccacccaaatatcccaaccgtggagtagaaacttcaaagtgaagtccaccttccatagagaatacaaaaaaaaaaagagaatacaacatcgatctaggatgctggcaacacccgaacactgaacctgttatttacccgaagagagaaccaggccacttaaaactcctccatcatcgctaacaccagtcagagactgggaaaagctagctttcacccgcctaccacaattgcttcgtctgaagtgtagcaataatatgtccctgtttggttaactgatcagtgccaaactttgtctcgatcacgtgtgactagctagcaagtttgatcaatcgaattgaagttaattagcgtttcatgtaacagatacgatgtgccacacggtcttaggctgcgtttgacgtaacgatttggtagagtaacttggtggcacgtgaaataagataaattgttagtatataattaattgagcattaattattattaacttaacaataaactattttttttaaaaaaaatgcatcatgtcgtttagcggtttggaaaacatactatcagaaaggaagtaagttgtcgttttgtgtagctggaaagaactcggtcttatccaataggctcatacgtcgtagacacgttgctttgacgcaacttaacacgagtgtcttggcacattatacagaagtttgtgtggcaaagtgtggagatgtcattaaagcagagtcctaatcttgggatcgatggaatatatatggcgatgagatcgactagctagtgacaccatcttgcagtgaatgaccgatggtgatcttcatcaaagatcacaattgggaccaagatactgtggtccgaaattaagcaggaaaatcacttgccaacggacaaattattttatttaagcaagaaatttcaatccattcctgcctaacaactccacccaacactgcaatctgcacttatgcagtggagatgcgacgtggctgcaatcataaagctttattgtagctaggggtcagctttgtgattaagcccatggttgtctgtagcatgggcacaccatggttgctaggatgggactcaactattcattccccttttgcgtcaaaaagaaaaaaaaatccagtcaaatacttggaccacaataaagtgtacatgaatataaaaaatggatttttcttttacactttaaagtgtaaaaactccaagtatttgaaatactaactactactagtaaagtgtaaacactttatataattaaaaaagagaaaaagaaaaagaataatgggcagtagacgggcccctttggttggcccagtccagtagtacaggtagaaactaaagcccattccattgaacaagaaggagtagaaaagcaaaattgaaggagaaacgtacgagcgtgcgaattggatgcagctgagaaggtgttcgtccgctgcatccgcatccaatccttcccggcgaccgaataccggccgggaaacctccaaaatcgagctggccggcaaggccgaatttcgctacatcggtttcatctatttaagttgagtaagagggaatcatgcgctggactttgaactatgtaatgaacttcattatcattattatgacgatgaactttaaggttgtggagtatgtaggactttagatctgatcgttgttgatggctaaacatatagtttctcaatatttattcatcaggacaatatttcgttagaatattctactagtgaaaaattttagtcttctcaactgttcattagtaccaactaggaaggtggcccgcgcgtatgcgcgggcacttatattattgaaaggtaagatttttattgtttgttcaaagattttgtctcatagattaagggaaaactaaagttcggataatgtaattttataataatttaaggtttctatttttcttaaagtatcttaaaaatccattcacaaatttttaagtaggagatggattaagtacttacgacttttgaatcatgttattttctcgagtaaataataaactatatattgcttgtagtatggctacaaattaaaaatgtgagagcaagatactcaaaattcttgtgattaaatcgtctcatgaaggcgcatgatatagtaagaaagagagggaagcgtatacatgaagaaaagaagaaagggaaaaatgataaaagggaggggaagcataggtacccacgcgtacgtaggtgcgtatcgaaggtggagaggtgggaccttgtagtatttagtttcttctaagatcaatttaatctaatggtttataatattgaacccaccgatttaagtgaaaatcaagtaatagataatttgctttttttcttagaatttctaatatgttctctaatttattagagcaccaagtggtagcttgagggtatttgaaattttaatggacttaccacatgtaatgagaatattaacatgtaatatatatgtatgggatatatgttaatattcattctagctttgtccatgtttatatacatgtagagagaaattaaatatgttgctagcaaaccattagatgtctaattaatagcaaataattttgacacatatttgcaattgttcatagtagctcttaagattcatgttaccactttgattattcgttgatcaccatgattcgcacgaaaaaaatatgtactacttagggtttaggacaacagaaattgatgaattatctgatttatgtgatagctatttgagattataaacaaatgaattaacttctaaatagttaaaaagtcgtttaagaaaagcaccatttataaacttggaaaagcgtggagcgtgcaaatgaaaatgcaaaagatggaatcaataaaaaaaatagggccttaaaactcccttattactcttatcctagtacgaattctattaatatgtgttaatattatgctgaaaatagggaggagattggagaggaatgaatagcatacaactcgagccagagatgggttggcagtgtaacagtgttatgcacatgtgattggagagggaggtggaggggacattgtttttctaatgtttctaaataatgtaggtgagaactcgttgttttctcattctaaaaatctttaacagttgacatatatgtggtggcttaagattttttattaacaaaagcggtagcgttgcagcgatcgtgatcacctaagatgcctcagacacgatgctttgtcacacgtgcgaaaggcaaaggtgtagacgtgcattgtgcagcggaccaaaaagagaactttggacactttagttattaacaatagatatgttgatttaaataatgggtccaccggttctagtgtaaatgtaaattagttaatatatattttaaattgttaatttaatgggtacacaatatgatggtgtagaatttattttaaaatagtacattatttgagaataatagtccaaattaataaaaaaaaagatcccatgatttaaataatgggtccatctgtttaagtgcacgtataattagttaatatagatcttaaattatttatttgataagtacacattataattgtgtaaactttattttaaaatagtgtattatttgaaaataatagtacaaattaatgagtacaccggtttaattggaaattatattgatttaatgggtaaacatataatggtgtaaattttattttcaaagattgtagagctaatttagttaactgtgtttataaagaattatatgatggtatattctttgtttgtaaattatgtttatttagaatatatatatcaattatataaatggaaaaaagaagagagaaaaaggaagaaataattggagggaggcgtacatactacataccaaaataattggaaggaggcgtacgtactgcatacccatgtacgtacgtgagttaggtgggacccatagtatttggtttattttaggatcaattttatctaacggtgtataatattggacccaccaatttaagtgaaaatcaaggggtagatgttttgcttttttcttagaatttacaggattttctctaatttattagagcgccatgtggtaacttgagagcgtttgtaggaagtttaatggacttttagtatataataatagaagatagataatagatagatagattctacctccgtcctaaaataatttaaaataagtacagtgggtatccgtatctaacgtttgaccgttcgttttatttaaataatttgtagaaaaactaaaaaaattagtcacacataaaataatattcatattttatcatctaataacaataaaaatactaattataaaaaaattttaaataagacgaacggttaaacgttgcacattaaccgtgtaaaattacacttattttaaaacggaaggagtactggtcctaatgaacagttgagaagactaaaaacaatctgctacattctctcattcaaagctagcagtgtattcatttatgattatgaggtggagtagctacctacagtttatagaatattgtccatatatattgaaattttcttaactaagggtgcatttgggaggaaaagctcataacttttattttctcatttttcatgtgcacatttttaaactattaaacattacttttttaaaaaaaatatagtaaagttgctttaaaaataattttaatttttttttattttttagctaatacttaattaattgtgtgttaatgtgtcgctttgttttatatggggaagaagttttcaaactttacatttgaacacagcctaaggcggctgtgatctaaagagaagctggggtgagatactctatcattttttgtgagcatactttttaaactgctaaacagtatatttttaataaaaaatatacaaaagttttgacaaatcaaatttccaagtttacaatagctaatactccatttaattaattatgcttgttttcgacgttaacaaaagcgcagccccaacctccattttaaacgtattgtatactaatttagtataggttgaccggcggttggtgtactaatattgcttgtttcaccggtgaaaaataacaggcaaaggtcgcaaccgtcacagcaacctatatatgaaatgaatgcatatatatatatatcgtggaaaatgttaagaaatgcactctataaactaaagtgagtggagtgaagtgacaagcagctagcccatgcgttggttcataaattaatattgcggccccgagggccacgagctgcggactccacacgaaaatgaaagtgatgcatgcatgatatctcactcagattcagaatgcatgcatggcagctaacctagctaagaaattaatctttctttaatttagacaacaaaagaaagagtgaaggagctgaacaaaacaaagaaaacgatcgaggagcaatatttgcagtgacaaagaaaatccaaggtggttgttaattaagaaagtggaaactacatataattgaagagagatcatatctagtggtaggaaggaattgaaggtcgccataagcaggcagttggttagttggggatacgtacaggtacacacacttccttccttgaatcatgcaagtatggcaactacagatgtacctctgcttccgggaaaaaacgagcaattgccaggtcaatcagcaattacaatcgcaaatatatgaaagcattgaattgatgtcaaatggattagcaagtcatcaggatcggagtacagtagcagtatgtaatgggtagttaatcatcatacatatgtgtcaacgttgtcatctcacattaacatcctgcaaatatggagggtttgcctctgtcctattttaagtgcagttgatcttatttaaatttttttattaatatttttattattattggatgataaaatatgactagtattctatgtgtggcttattttttaaaatttgtttataaattttttaaataagacgaacggtcaaatattaaaaaaaaacccacaatcatacttaaaattagactgatggaacagcatcttgttggctacgccctcctactcctgccggccttcaattatttgtccatgagttcctgagtagcattgctaaattactgttactcctctactgtaggtagatcctctgctcgtctattcattcccattcatgtcatgcccccataaatacttgtatacgtacgtacgtacgtggcacactcgtatacatacatatacgtacgcacgcatatatcatacgtgaaattatttggatttggaggtgagatatactagtccagtaggtttgtaagtttgtagttgtagtatataaatggcaggtggaggcagggatgagccggcgcccggccggccggagacctcttcttcttcatccatcctttctttctttctttctttcctaggcctaatcttacataaattattcacacggacaaatctagctaagcacaaggtatgccgccggcgccgtcgcaggagcaaactaagctggcgccggagaagcagcagcacatctccggccatggcgagcaagccgtccggtaccatggatggaaggtcatgccgtacgtcataggtatgtactactgtatcttctagctcctccatggttatatatatatatatatatatcctcccggcctccctagctcttaattagctcctcaccctcagctctgttcttctcctttaactctctccggtttggatcctactcttctcttctttgagcatgcatgtactgtatgtttttattttgaacacaaaaaaaagtaagatggaaatggacatccaacatggctgcagctagctatagcagatgatgacctcctgtagtttagtgaagtgcatagtctcctacatcactagctagatctcttccttttagttagttgctggctccaaatctcagctatcaattcatacgcaatttgtgcgcatatatgcttcagctcgctggatttgcattattgcttcatccatacaccaaagtacacacttcctcttttttttccatctcttttttcccaattaaacgtcaatgaaaaaataaaagcttagtagagaagttagatggtaaatgtggtgaagttatacaatcaaggaagcaagttagtccaaaggcaaccgatgaagcaggcagatggagaggagccatggaggtagaaa

SEQ ID NO: 41415 - DNA, 11242 bp, Oryza sativa
ctgcaagcagttcatcaatcttgaaaacatgttcttggatatgctttgcttggctcgacgatttgttcttccatcttcaactgtgtgtgcttgttgttaggattcacacccctggagcatgccgtctaccatggtcgcctgcctgccaccagatacctccttgatcatggcgctgatgtgcatcaaattcgctctacgggaaatgtctctcttcttcactcagctgcagtaaaaggtatcaacatagcttggcctctgatatgcccttaggattatcctttttcctgtcttagttagttgtctgccagcccatcctgctagaacatccatgttttcactgtaagaaactctgccattcccttgatttattcttttgcgatggatccaatttgtagtattgaacattaagccggagatccttatgttgaaatcagggagaactgtaaataataatagaaaaatgttttagtctgatagctattcaagcctaattgggaatactaatattgcgattagcttgtgatcgctagatgcaaatgtttactggtgcttttattttcttttgtaaccataaattgcacaaggatggtctactctgatgtgcttctcatatccatcaatgtcatgtagtcttttgaaaattttaagatgctttccaggttaaataaaatcctctggcctaagtttcataaaatttcctgtgtcattaaattgctataagtttttggaagcaattgtatttacactatcacttgtgggatcatcttttgcatgtgttttttcacgcattgcttcactatagccattaaaattagtttgcccccaaatgatcctttgcttagtatgataaccactggtgtttcattatgccaattggaaaattgctgtttatatttagatgctgaagcttgattcctctataacagtttgcccatatatttttatgacctttggttttccacctatttattcagggttctctgaagtagcaaaatttctgctttctagaggagttaatgttgatgcagaatcagaaatggggacaccactggctcttgctgctttcagaggatatgatagcactgtcaaggtccttttggagcacaatgctgatgtacgattgctttcatttctctgttggctttcagcatgaatctgttctcctttgcccctaagccgtggccttcgttattttcttcccacttgtacacagcatctcacagttaatgtgtgagctaacccaggcgtgggagaaggggcccacacaacagaaactctgataaagcaataggacaagcatataaaatacactttacagaataagcttcagcacattttttccttcagaattcttctttcttttggactgtcattactttgcatgacaattgatattctttgttttttccagcccaacaaggttacaaacaaggcacttggtgcacctttagacttggcattaaccagctcttctgtgtcctgtgtgaagctgttggttcaggtatagctctccctgctttatatggccgtaggtttctctaaagtggtgggtgtagtttacctctgtataaaagcatcaattataaggagaaaccatatgtttgtttatgctgtacacttgaatttaataggctggagctgaagtgaaagttgaggggccaaataatcatttggtaagagctgctgagaaaggcttaactgaagctattaaatgcatgttggaagctggtgcaaacccaaatgttcctgacagggtaagccttctcctttgtcacaccggtgatatctgcttcagtagtaaacggtttgatactaatttatgaacaaatgccacagtatgttcatgcataagttttttactgtttcctttttatttccttttgccatgtttttattaatttggttaggtatgcctagatatttgtctcatactagcaccaccttggtctgttctaaaggaaatggattaataagtttgctgtttacatgattgtccaggagaggtaccatttcattaaaatggaactaggctactctttcattaatctatattatcactatgaagagcatatatcctgaacatcaagaagagctttttgctacttgttttatttcaaattttcaatatttctatttcattcttcatttgttggacagctcgggagaatgccaatagagctggctgctgagtatggcacacgggaagatgttgagattctctttcctttcagctctgctattccaactgtggcaaattggagtgttgatggaataattaatcatgtacagtcagaaatcaagcaactagaggtatgtaccaattttcttgtgcatcttgcaacaatcctggtcttctgtgcaatgtcggcagccactcagtgtaaaccaatatgttttatggattaacactattactttaaaagcaagattcctgaagcattgcacatttctctgtgcaacttgcaagtgagtaccaggaatctgaaacaatgcattgattggatctgtttttttagccctttcacttcaccttaacttcttgttgtaatatgtttcttcactgctagcatcagatctttgaatatatgtctaattttagatattatttactcaggacgataattttatcaaaaagagaaggtctgacatgaaacaacaaggggatgctgcatttaagaagcaggattatctaaatgcatcagtgttctacactcaggtacattcttcggaaccattcccatggtacatcattggaccatattcctcattgtatatgccgttacttgtgtatcttcatctggcggacacaatatgttattgctactgtgtttctgactccagaagacacagggaaaaaaaactctattggaagattcttttatgatatttgggatttaactgaagattggaggtgtttacactacacaataagaaactagtattgaattaaaacccacctatcgatttgcccaaacaggccttacatggttcaccttgtttctttttctccatgaagttgatcttgttgttcatttacttttccagtgcacaaaatttggttggttatctcattatactatcacacatctccttgcatattagagcataagctgaacagtgtggactggaaacttttgtagcctgaagctagcagtagcagcacccaccaccaccaccacacacacgcatgctctacacacaaagcagtccactgatatctgtcttccattaatccctttagtttaattgggaggagttggtgggaattgcccttttaccgagaacttcaattttacctggttagggtgttggtccaagtcgatcagtgctgagaactggtatagcaataacagcaataaatctggcactgtttggttctttgcaggcactgaaggttgatccgtttgatggcacgttgttctcaaacaggagtctttgctggctccgcatgggtgatggagaaagggctttggatgatgccaatgcatgcgaaaagctacggccaaagtgggcaaagtcctactatcggcaaggagcagctctaatgtttctgaaggtgaactagacaagatatgcgttttgacaattcacttgttccttgtatatcttctactcctgtttgatttggctttgcacttgtgttccttaggagtatgagagggctcatagggcacttggtcgagctttagagttggaccctgaaagtgaagagatcgagaatttgtattggtaagatatctttttctatcaacaaaatctggctgttgttttgttccatgttgtaattggttgctgatccttacagggagtcgatggaactgtgcggttgatccctgaaatgccagctacagatagaagaagcacacgcagaactggaagctccttttgtgttatgaaagatggaacgacgcaaacgctcagtgatttgctgctttttgtgtacatatacttaggctgtcaaaacagaaacaaatgtctggtcttttatgtcgtgtttcgtcgtgacatcttcctggagtggctgttagactaaactagcattatcacattctatctgttgctagtatgggcagaggatgatcaactgtctaagcaagctggaatgatatgaattctctgaaatgttatgcataatataattgtgataacagcatttgcatggctgctaaaccctaactagaaggaagcaggtgttgccatcctcaacatgaggggcctgagaaacaaggcaactgacatgaacatgaactcaagtttattttcacccagctgagctgtagtgctccacaacaaaaacaacagaacttaacgcaaatctgcataacttgctggacacagcaagttttcagctccacttacacgtgtaaaagaatgacagaaaagctctaatagtagtgtgagagtgtataattggacagccctaagtaaccattactttacaatatggtgctcaaatcacaagcttttacacgtatatatatatagtaatgatggattttatctttacatatgattctttaccctatcacccccaccatctaaccttatattacatttcctgctatacctcctcttctgtattaaatggcaactacaaagctacaaatcccatgccctttcaggcatgttattctcccactaggtgttacaaatgctgccccccaattctctctcttaatgtccatggtcctgattgtttctctgctgtcttcaggccacaaaatcatgcagaagaggtgaatgctcaaaccgttgccgttgatccatctgattcatcgaatcatagtccgaagatgcgacggtgacaccaagaggagcagtagcattgtagatgtcatcctcattaacaccagggaaacctggctgagcattaggaacgaggttgctgctggagtgctgcaagcccagtgtcagcgacacattgccattgccgtatctcccaagctctgccaagtgataggccatgaaccgggcgttctcgtctgagtgctgcgcgacagtgttgtggagaaggaggccgccatccacttcgttcgatcgctggtccttcagcatcaggttcatgaaactgtcatcaggattgggctcattctggaagccaacaggcgctccgccaacattcattgctccaatgctggttctcgactcgctcaattggcttgtttcgcaaatccgtgccctggagtttttgagatcctccttgtcttctgaagatgccattttatccttacttcttggtgcattgtcagaggaagagttggagtcttgctctaaatcaccaatctcttctttgtacatgtcttcaatcattggtttccaaaggcggacacgggcatttatgaaccaattcgaaatctggagaacaggagaagcatgaagcagtcaacatgttgaactcttgaagaaacacaaaatgcttctaggataagaagttaaaacatcaaatgtggatcaatggtccagtgcacaaaaaagataaacaatatttacctgactcctagtcaggccagtctgcctagcaagcattaacttctcggaatcttttgggtacctgcaaaattgttgtggaggatgataagagaaaagaaaagagggaatgctggaaagaacagcataaaggatgaaacttacggatggaggaagtgttcaaacagccaagcgcgaagaattgtaacagagttttcaggcagtcccctctgtggtctccaggcgttttgtggaatcataccgtactgttggaaagcacgttgttgccttagctgctgatcaatgtaccggaggcgggttaattttccctccttgccagatgagttctcttcctcgccaagctttttcctgataacattgatctgatcattgatagcatccttcaggcaccgaaagtgccgtgagattgtctgaagagcaactgctgtgtaaggcttcgcagatcctggtccagctaccacatcaaacgatgaaaccacggtttgcatttggtggtaataatgcttgtatttccggtccacctgaaatatatatttttttgagttaaaatgatttgccaatcaattaactaagattactgtgctataagtaaactgtatatctactcttgtatacatataccaaggatcagtcctataaaactattgatactgtaatctcaactcaaagaaattggggttgcacttctgtttaaaaagaaagagaagtacaaaacaatagactcctagagtactcacctcatccaacattgccatcagttttgccattttgttctgaagctcttgcttctcagcagtggaaagctcaggtgctgcattagcgccagattcttgtggattagaagatacaccctcactttttggccctccatcagtctctttgccatctgcttttcctgattcaaccttctctttctgagccttttgttttatgctcttccaaacactcacgacctcatcaagcagttcttgtgctgccttgagataccttgagttccggattgcgcgtgaagcttcggactgcaaattcttcatccgcatgtcttcccctctaaggttgtcatggtaagactgcggcgttaacatgtctggctttatagaccagtacggtaaggaaggcgccatgatttgtgtgttcaagctcagagatagcccttggctttgcattgatggaacacttgatgagttgtgattattcagaacaccaaactcaagctgtgaaccagtgtgggcatcatcatggatgagctcagagccactaccttgtgctccatccatcatatgcatcaacatctcatttttcatatctttgacatggctgaaagagcgttgaccctggtgcgaagaaagcatgtcggactcccttgaagaggggtcttgtgacattgctgacgcatgcccagggccaggcatctccatgcaattctgctgaggctgcagaatgccgctgaactccgtataaggtccagaagatggattgttcagatagagcaagttccctagagctgatgacataggataggatgcactgcctgggtctcttgagtacatggtctgcgagtctctttcgctaccagggcttgaatagtaagtagccatctcgcaattataactacttattgctcgagattactgcaaaagcatatatgtatatgaagaaccagctttgacgttgacttgattgatgattccagcaggacatcaatattttgttatccagactaaacttgatcccgttcaacttccctgcaattgagtacatgaaatggactgataagacacccccaaggaagttcaaatattgaataaggagttctctcctctgagattgtaaaataacagcacaccaatgccaacaaaaataactgcaggcaagtgcttgtaaagcagttcaatggaaaacttcaaaacactttgcacaaacaaagacaagaaagtttaattgagcaaactgttaatatagatacagcagaagcacacaaagaatgccagtcataagtgagtaatcagaattggggctcaggctaagttttggcaggattctatctgatagaaatgcagtcacctgcaaaactttgctcgagaagtgcgataatatatgaactgacaatgtgacatgccgatttgcaggctaaagccacaagtggtcctccatttttaagattggatcaaaaaagttttggactttgtggtcctcctttgctaacaagatgttataagaatatctacttgtgaattcctcttgttatataccaagataaacaaccggacaacaccataaaccaaaatcaaatgactgcccagtgttttcttttcttttcataaaagcaacatggggaaaccacagtagtatcatgaaaaggagaattgcattggatagataaggtttgaacatatgactcttgagtgagtaatgatcatttatcatgatgagtaccttgttgaactaatagactgcaacttctcaaagattctctgccaggctgttattgctacgaacacagctaccaatcaaaatctgcaagagatgaacttacttagcagcctgtttgtcagtctaaacaaattctttttcatagctagatttttagagagtagagccaaagagaaaactccaaggcacatgtataacctacatacagaacaaagaagcacaagattttgatgaaaaacaagcaagatttccttagcataaagtgtctggagtgcagtaactcaacagaagaactactgcaaaaaggtaaaagtaacaggaaatttggcttttgagagcccagcttccatgaaaacattttttgaagactgcttccatgtaaacgtcgaggaagaaagggaaaaaaaagaaagaaagctaggacaatttagtcggcaatcgcaaagcctgttcgtacataagctcaaattatgggcaaagccacaaaaaagtgggttgctttacaatccgagaagaaaacaagaactcataattcggagaaaactaagcatatgagttttgaacacaagaatttctccacaagaatctatacaccaaagaaaggcaagaactttgttgaggttgagggcatggaacctcaaggtcagtcaaaagaaacaatctttgcacctgagctttcggttcatcgagaaaaaccagcagcaagcaaaaaaaaatccccaaacatcaaaagaagctgaaaaattcagatggaagggaagagcagtaccctagctctctaacccaacaaggcaagaagagctcagaaacccaagagagccagcgttaagcaccaaccacaagagcaagaaacacaccataattcagtgaaattccaccatcatcgaactgaagccaagaaccaagaacagaggtcatgcatgcaatccgttgctgatgatgctgcaataaggaggaggaggaggagcagatggtacaagagaaggcaataagaaaatggaggagagacctgagggtgtgctcctgatggggcgcagggcaaaggcaacaggaactgcagcagcgattgacaccaaagcagccagctgatcttcttcaagacagatagataggggagaggggatgagaggagaggagaggaggggagaaagataatcgatcctcccaatatggggacaaaatcagatcccaggattaaaataagtaacaatcccaaaaggaaaagtgagcagcagccagcagcagcagcaagagagagcacagagctcagagctcctctctctcctcttcttctcctccttcttctctcctctctctagcaagcagcagttgtgctagcttgctccttgttgcctaaataaaaaaagctcagaccacccactaacagcagcaccaaatatggaataatgtttgcctcctaaagaaatagttttgcttgttcctttattagttgctgtcgagaaggattatactgacgagctagctaacctcctcctcctcctcctctcaactgttgctgctgctgctgatgctgctgcttggagttatttgctggtgtaaccaccacaagtttcggctacttgtcgatcccagttgtttctttacgataaagcctatgcctccatgctcctcctgctatatttaattaatttattatatctgcatataaaattcagtttttttcttcagaaaaatggaattatattagcatgtactgtcctgcactgctctttatactagatcatgttaccttgtcttcagagatggctataggtagcaaaataattaaaaagaagattattttttttcttggcgaaattaaaagggtactactactatatatataagaaacaggagggtgattgaggctaataagctaccagtataattcagacactgtacaatagcaatgtaatggtgctgcttagtgcatgcatttcggagtggtgacagctaatgggcgagatatgcagaatcatgaaatcattagaggacaaagagatggaggcaaagagatttatcacgtgtgacatcaacgcccccaatgaacttaaaaaacaaacaattagtggtgggccccatccccaattcctctctctctctctatgcattggccattggccattgggtggttcgcgtggtccacgagcttacgccatggcacgggtccaccgcccccaactccctcctcctcctcctctctttctacaccaaattgaattcaattcttgcaattggattgatgaattcaattcaagctacaactcacctgaccaatgacaacaccccagcaacagatttgtcttttggcaggtacagacaatgtggatgtatactatatttaggctaaatttgcatggccaaattaaaggggtttgaaaaattttcttcccaacatatataaatcattggtctaaaaaaaacatatataaatcatgcaaaatgttctagttaacatggctacatgagtggaattatgtgtaagttcatatttttcagtgaacaactagtaatgttatcatacaaattaaaagagctaatctttttatataataaaagactgaaattattgtcccaacctctatatcatactagatgcacatttgtaaacaaaaagagatgatctttatacctgttcacctcaaaggtaataagaaagttcagttgcagtcgttcctttctttttttttctactgtgaccacaatatcactgtacccaccacttatattatactatgatcttagaacacgtgatccgtaatttagacataacccacatgcatcatccagtgaattaggaaagggataacaacactaattaattaagtatgcttgctaacgatggttagtaacctctcttcaaatcaaaggcatgaaatatatgcagcaggggtgcagagaaatgggcttgctgtgcacacattgaggttgggagtgggtgttgtggttagggatatgaagatgatggatggatgccctccatctcctaacaaccagtgggtggacctaaatcaaaaccaaccttgtcttagactttaaattataaatccatccctacctgctttgatcttcctttttatcctacttctactactactagctacttctactgcctaccatatttaaaagaaataaacttgtcctttttactttcttgtaaccacccactaatctgtgtttcaccttttaactgttgtgatcaccagggtagcatatacatattaactgtggaaaacaattaatggcatacacagtatacttaattaaggacgggtcaggtagaaacttttgtagggaattatatattttccataagatatta

SEQ ID NO: 41416 - DNA, 5578 bp, Oryza sativa
cttgcaagttgtagccagttctagaaagcatccattgttgatatcatattaaaatgagtgagcttaagataaaataattggcatgattagttcgtttgatcagtaagttgtttggccgccttggtaagatctccttcctttggtggccgtttatggtttcctttcgtatatgctaagccaagaacatataatccatgaagctgacatccaactccctgacaacacagtaaattaattactataaccagaagtaattagtcatacataggacatggcgataggaactagttcccaattgaggaatagtaattaactcctatatatactaatggctatatattccaattgattgttacaagcataatcttgcaattaggctaactctagctaccagatgatctgaaagtgcaattcagagggcagctgccactatatatgcaatatatgcaaatgctgtttaactagctaattaagatgttgttgctgatgtaggagtgacgtgggggtgattaatcaatattagccacacaaattaggagtacgtagcagggtagcattcagtcgctgtcatggtccttgaatttagtgttgggagctgttagtttctgcttgcttactcagccttccttcctaaactaattagtgtgctgttttctttccatctcttttcagatgcatttgtcgccattataggcctgattgctctcaattacagaggcttctctttgaattaggtgcccctaatgcgccacgtggccgccgcttattggacttgttgatcttagtctgtcaattttgtgttcatatactagtagattactagtgctagtcttgttccatttctcagagacagatcagatctctgcagaacaaaatcacacacacacgcctatggatatatgtagtggtttcaattctgtagcttatgttatcttatccaagctgatttagcctacactttagtttaactttatttacatgtgtgatgctataatgtaatgacttgttcaagctatgagaaaattaatcaaggaataaaattataagcagaaaaggaattaagtactgatggagataagccattgctatcagtatcaactgggaagataataaaggttaattattctctcattttcacagattacacaaagtgcgtgaaaagaataattaacatatatgtgtgtgcgtggatcgtttgtttgatgccgtgtcagtttgtaaatgactccagcgatgagtagtccacggtatagacaatgggcattaaaaatcttgcgataaaatccaaaaagtcgacgtatgattaacttaaattgacttaaccaactagatcacaatcaatgtactagtatagattattgttgtctctaccatgtcatcatccagaccaccaaatagttatatattcagattaaaatataattgctgagcctagaggattagaaacgtctaaacaatacactgattgtgccattattttagatagggcctggacaaacaagtcttgtcaaatgttgactaaacaaatacttgagtgtttgtgccacacaagcaagatccaattttccatttgcttaagcttaattattagtttgttgtgagagaaatttcagaagaaattgctattcaggttgttaatttaattcagcttggcagctctatgcgaaggtatagccatctttgaatatgcagagagctatttgggatcttagaccctgtcaaattaacaccacaaagcccgtgtccaaatcacaccgtgtgtaatcgattaaaagaagaaagcttagacatcaatttgcaatttgctcttgagcttttcaccatgaagatgatgcctgcccatctcaacgtatttctatatattccaccatccttccacagtttatctacctattgatgaacagttcatcaataaagcttccattgtcttaaaaaacagttttttgaagcatatttccttcaatgtttaaactgaattcagatggtagtttgattagggtccaaattcttatacaaggcatcattaattgcacccaacttccagttagcctataaatgatctgcaggtagcatgctaattaaacatttgataaaacactgcaccgtttagcgctgccaaaaggccaatataattatgtaattagaaattttatcacaacctactatcttgaccccctcaaaatgtttctgcaaattaaagagaagcagagaattggcatgcatgaagccagctagctgggacacatgtccttcaattaatctgatgacttacagaggatcatgggctcccataagttagttaattttcagatatttaaacacagctagtaagtacatatcatagtgcgtgtacgtgtgaatcataaacgaaaccgacctaacaaaattcgatcggcgtctctgtcgattgttttcagattttcagagaaaaaaaagaagaagaaactcagttggaaagttgtctctggaaagagaccaacatgacgagcttcggcaactcctaggcctatattgacaacatttcgttgcatcgacggtgatagatgcacgtaaactcacacaactgaaacatcatcttcatccagatgatgatgagatgatgaactagggcatgcagctgtccctgttcagatatatgcatatatataaatatatatttatcagtcatgcgtgcaaccaagagaaagaatgagcttagctagccatacatatgaccaagttttctgaccgatcgagacatctttctctatctccctttcctaccttttggagcaaacacatcgctttaatatttatggacatatatatatgttcacttcatgccactattgtattgcagttccacatatagtttataatagaagagtttcacaatcacaaataaggtttgaatagctgttctatgagcatatatgtcaatgtgactcctctccattcattgaaagaaacatctaaacacctccatggtgtatgtgttctccaagtcaaatgagtcactagggcatgcatttcaactgtgtacttgatacataaatcacatagtaatgagtacccagcatgcatatatagtacatgtgtactagtaatctagaaggagtattaagtacaactactgtctacactttactatactccatgtcaaggacaaggaggagaagatatagctaggatgctactcctatttgcacatttccagtgggtcaaagctttcctctttgttcagtgctaggaagaaccctactactggagatctttggcttttccagtggcaaaagtactacactacagtgaacacacacatgcatgcatatgatacaccaagaaggagaggatgacactgttgttctgccctgtcaacatttacttgtcaacaaatttgctcattaggctgctcctctatctgtgccctatagagctatgcatagccttttggttttggagcatttctgttgtctgttattgttgcacatttggcatctagcacagagcacaccactgaaaggaagttgattttgatatgtgtgttcggttttaagctctgaattagtagctcctgcaagcgtaagacattgacaatgacatttaacaatacatgtagctttccctaaaaaagcagcaagattagtgcaccgaaactcagcttgttgatccactacgcatttaaacgctactgtttcagctgatcaaggtctagttttcatgaaaggctgaaaccatattgttcatctttatttataacagcaacctgattattgtgcagttaacttatgcatgccccaatttctcattgcaacaaaaattaaaaaaaaagaaaatcagggttacagaaaaaacctgggacattatttatggtgtgtggtgagtgcagagcttttgcaggtccatcagaggttcagatatgatcagacggtgcaggtgcacttcaaatatgttgcagctttgccctgttcatcgcaacattctgttaagaaggcagcaagataggagttgcagctatcaattgcaaaactgagcaccattataacatgtgcctccaaaacctggtactgatggtctgatactggaagcaatgcaggaaaaaaaagcttttgctgatacagagatgctgactggttcactgcagggcccattgacacaacatcatcaatgggttcagttcagattagtctgagcatgcacccagctacagggctactaccggccatgtagataggcaggcatatgtatctgcaacaacaccaggcgccatggatggaccgagttcagtgcatcaacagtgcactcttggtactctagctagctacagtactcctgtagggagaaagactgagacatagaggggtgcatgcaattggacagggcgttgttctatatgggctgtacagtgctctctccatttcacagtgattgccattttagttttgtcgtaagtcaaacatttttatcttttatcaagtttttaaatatttatgtggtttggcaacataggaattatatattacgaaagtatttctcatggtgaatctaaagacataaaccttatgatattaaactatatgaatttctataaatttatgatcaatgatacagatgtttagcttgggagaaaggtagaagaacaagtaaatttaaaacagagggaatagctcaattgtaaatgagcacatgtataagtacaaccatcagatcaaataataattagcagatgagaactaataagagtagttgataaatttctgtggcatctaattggaggctgtaagagtactgaactggtccatcttccaaaacactcaaactagcatgctgatatcatgcaacattacaacatacatactaccatggaactgtacaacagccgatcggcaacatataaatatgtgccctcttgtactttgcaagtagtgttatctgttaagcatgctcatatcattatcatgctgttctcctctcaattgtttggatgctaatatgctatcttggctaggatgtggtgctgtatagagtccatttgtctaagataggtgcaaggttctttttctaatatttttttagtatctagtatatgcaatacagcagggtttttgttttgaacttttgatgttgccaaaagcatgtgaatgacagactgagtttggctgaaaaaaaaaaacctactggtctttgccgacagcatttctggtgctcaattagcatgtaaaaaacatgtttttgcaaaagaggcctgctagctaggcagagtccttactgactctaatgcatgcaacaaccaacagtagacagagtccttacaacctctagtagtaatataaagttatagccttttgattactgtcatgagtttgcaggtgtatggtgtatcacagagagggaaagttcattagcacaaaaaaatttccatctttttagtaccttacttgtgtagatgaatagtttctggatatataaccagctaactgaaacaagttagttttattttcaggataggcagctgcttaattagttggcgtcagcctctgtggatacacaagaatatagttagcagacgctagtagcagcgtgaactgaaggatagtga

SEQ ID NO: 41417 - DNA, 3102 bp, Oryza sativa
tgtgaatataaatatatattggggaacaaaaggatgagctttttattttttttatttatctacgactaaggacagagctactgttttgtgagggcatcagcaatggcactaccacaaaagtacatgcaactcagtctttctccaaagaagcaggcagcagctgagttgtctagccattagggaaaaaatgattagccaatcctaatcttgtagccgttctcatgttttgttattgatgattcgtttcaaggcgttatgatgagaggattatattattgcagccggccatggaccgtagtctatggtgtaagggaaccgatcagtgatttgtctcaataattgataaagaatcttgcgttgctgcacctccacaacattatgaccctcttttttcttcctcacagaaaaggcagacgaaggaaagaatggtcatggtttgatcatggtgttcaagctttgcagagcccatctcatctggcccactatgttaacccacaatgatcacattttcttctttctttctcctctgaaatttacctttctttagaagagctttagtttagtttgctgatgtttatgtttgttttcactttgattctttaactgtggtaaaatgtttacacacccaatagagagatgaaaagcaggaagtatcagactatgagtaagttaggataagtgacttacatgatagtaatcgcagatgctattgaaattctacttctgcatttcagagtttgccgattgctcatccatgaagcctgctggtcttttgaatagaggattcaatctacccatgaattttatgaaatcatcattccgcacaagagttgatgaaatatctttggacatatacaaggaaacaatctccatctccaaacaaaacagggcttagctctgcactgtactgctgtgccagatcctgcacgaactcaacagtttgagatgcaacgaactgaacagacctcatcaagataatgagtccaggtgattgcaaaatcttagcctctctggacaacctaaaagtgaaggaacagtgatgaccaacgctgtcagatagatcacctcgtgggactgtgctagcaaaagattagccgatcgaagaacctttttctgtactcggtgacagagagcagaaaattgtgaacattactttttccttcagacatggaaacgacgtgttcctgcgatttcagagatgccattatctgcacaatgaaacgtagatcgaacgcatcatcaatcaaccacaaacagacagagacaccatcgataacggcactcgcaactcacctctgatgttacctcgagaggaagaaggttctcacggaggagcactcgccggcgccggccatcgcctaccaccacctccgacgccgatcgccggcgctccgccgccccaacgtaccggggaaaggtaaaaaggaaactgactactcgatctacgtgacaagtttaggtttcttctccctcgatctgaaccgcacaacgtcacctggacggtccctgacccttataacaggatataaacccagacaaagaagaagaagaagaagaatgttgtgtgatctgtagataatcataatcacatggcaaacttcaaagttacaagtgttcatcttctcaaaaagaaatgaagttacatgtattcatcgtacagaagattggagccatgcatgaactgcacaccagacaacttcagataattgtataggagatatcttgcacactctagtcaccctctgatttcatgaatccagcaaacccataaaagcaagagcatggacgaactgtttcagtattccactggttactgactatctgcattactacgttgcaagctttgacccaatggatcatacatttttacaatcgtcaggttcctcgcttcttctgccatggatcggaggattaacttggagaacaaaacttgaagcatatgaattgtaaaatatattataggacttaacaacaacctatacattatttatccaaggcagcaaatggctagctctaacatttattcaagtacagggcagggtattttgagctccaccattttcagttcaggaaaaaaacaaagagagaagagctcctagaaatctcaaagcatcctacagtatatcatataatttatcttctggtgcatggtttgggtgaacagagtgttcatgccttctcaccagtgaacttatcgaagtaggacaatatctccgaattcactctctcggcctgctcttgctggatgaaatggtgaccttcaatgatgacaacctcaagatttggaacgacggacttgaaagcaccgctcttgacaaagtgctcagttccaaaggacttgagaccagtgtccttgtcaccacaaatgaactttgtaggcaccataattttcgcgttttgccagggtgcagtaagcctccaattcctgcatttgccatatattactgtggagataaatcaaatagaatgcgcacatacaacaaaatgggtccaaattttacgtgtccatcatgcggtagtagttgatgggtcctgtgaacccagacttctgaaacttttccgcgtactggccaagttcttcctcggagatccatggaagcggtgtcgaacgtgcctcaagaaagtctatgatctccactccagggggtgcggtgaggtcatcgatttcaatggagaagaactttttcaggacagttgcaacatcataacgggcaaatgctctttcagctctccctggttcctgcaaaaggcggtttttaattatgttgatccattttgaacgcgtacggtgctgatgatctgctgctaataatacaaagctaattaaggtgcattctgatggcaccatggaagtgaaaaatgtgaatcttttgcaaattccaattgtcctctaaattgtcaaaatctccgatcctcttatgtgtatgaaataaaagatgacatgccatttgtgtattgagtagaagagacagtttcaaactttttatttttttttacaaaaaaaggaactatggagggctttcatgccagcctgaacatttattgctcaaaatttgaaaccttcacaatattgaatagaaggaatacctaagttttacattg

SEQ ID NO: 41418 - DNA, 6384 bp, Oryza sativa
  unsure (1)..(6384): unsure at all n locations
tttcaacaaatctaagcaagggtctatgaaaaatcaaatcacagcatccttaacttaccacaggattggagcacactccatttcattacaaagaatttgtgtcgcgtgcctatcttaaagcagttgctgtagttactagcaaaatgtccatcttattcagactagatcgaggtgatgcatttccttcatcaaattaaagcaccgtaaacatttcttcctttccattccatatgctgtccatttcacatcctcaattttgcaatacaatctttcattcatgtatgtagttaaatttaagagattgcaaacctggaactgcatgatgtagaggccatcgcgccctgcgaatgcctccgagagcgagctaggcccccgggggaagaaggggacgccgaggttgacgacggcgagcagcatgtccgggcggaagaggcagagatgccacgccacctgagctcccaagtcgtgccccaccaccatcaccttggggagggcgaggtgatcgaggagggcgacgaggtctccgacgatgtggaagacggtgtaggcggcggggtcgtcggggacggtggagtcgccgtagccgcggaggtcgggggcgagggcgcggaagccgcgggcggcgagggcggccatctggtggcgccacgacagccagagctccgggaagccatggatgaggagcaccggcgggccgtcggcggggccctgctcggcgacgtggagggagatgccgttcacgtcagcgttccagtgacgcaccacctctccccccattgctgcctctgctcagctccaacaaatatatactccattccaacaaatgtgtctgaaaattctgcctgtttgactttgaaatttacagctgaagatcaccaccacagtttaattctccgatgaaaatctatcaccacggttgaattatccaatgatgaaaattaaaagaatctacagagaggtcatcgtcacagttgaattatccaagaaaataagaggaaggtcggtccatcaggttggttccttgttagcgctgaatactgaattgagcactgtccataatttagtccagcgcatgcaacaattcacaaactctccttgttaccacgaatcaacaacaaattgctaaacgaacaagtagtgagtggagaaaataacgaagcccgtggctttgggtgccgtgcaaaggaaaacaaattcatgttgaaagccaacagagaaatgtttagatcgacataggagacatgagaggtggtaaccaatgaaaagaggaagattttgatgtaaaaagaagagatatatcaccataactgcaacttgacaactcttacgtactaatagatgagcaaaaacagacataatatgcagcagatgctggatttctgtggagacgaacacagaccgggaattgagaatcgacagaaaccgaacataaaacaaagcagattatggaaaaattaagtaatcaatcatttgcgcaagaatactactagtactgttccaataacgagcaacaattaattgcaaggctactcgtcgtcgtcgtcgtcgtcggtggcctcggtctcctcctcggcgtagccctgtttgacgtactggtcgatgaggagctgctcataatcgttcatcttgcgatcaatgaactttgcgatgccgtagagctggcgatatgacgcggaacaattggcgagctcctcgtcggagagaggctcggtagtagctcaagtagactccccgtagttagccggcgccgccccgaccgttgccgtcgctcgccgtgtgctcgccgccgtcgccgctcgagctccgtagcacccacacgtcgccagcctcgctcggcgtagctccgtccaatccgacgctagcatcgagttcccgacaccgcgtagatgctctcaccgccgggaatcggtccctcgtgacctcgtcggcgtttccctcttccctccccaccggttgtcgccgccgcgattcgccgccgtcgaactccctctggcgaatccgagccgttggctcgtctcccctcatcacgaacaaccgcccggtgtgctagcttttgcccgtatcgccgtggttcgctccgccgctcgccgccgccgcccgccgtccattcgcggccgggtcattgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgctgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagcccggtccaccggctctctctctcctccctcccgcgcgcgtgcgtcttgggccgctctgggccaccttcttgggccggccggcccgttaagctcggccgagccgccctttctctcgggccgcgccctagccgcccgagggaagtctatattccctccctctcccctgttcttttcttttcttttccaaaaaaaagggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccaacacctgggtcggtgcttgtgaactaaatgaatttccaaaaccgcggaccggggaacgtaccgggtgtacggtttcccgctctcgcacttaaggaccgatttcttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcatagtttggtttgactactgcttgtgaaattgctgtgtgaaaaggggttcggtgtttgaaaaatctgtagctgatgggatcagctagggccgtttgaaaagttgttggcccgggtggccgtttgaaaagttgttggcccgggtggccgttgaaaaagctgttgatcgggtgccaaccttgtttaaattctaaagactgatacattgcacatactccgaccggacgagacgcactgtctcatccgtgtcgtttgagaagcactcacttagttgcttcagaaaagagttcaaataaaattaattgcaaaaacaccagcctttccttgaagcctgcattaaacacttacttcccatggcttgccgagtactcccgtactcacccttgctctatataaataatcccccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcgggactagttcggggcgtgacaatatgagagcatattagattagaccagagcctattgtaatttatggttaaaaaggaaaatagaagcaccaatgagcattttgatttagggatcgcaagttaatcaccatattatagtattctaaattaggctcgaatagctattagaataacacactttttattatttacagttctccctagtttccatataatgatctccagcatgatttcatatgtggatccatcacagaagaataaatcaaggcaatggcaaaggccgctagactagatgtttcttacagtcatgcgtctagcaggatgggttggcagacaagtagtaactgtaattggaaaaagataatcctaagggtataccagaggctaagcacgctgttcatacctttcactgcagcggtgtgaagatgagtgacatttccatttgagcgaacttgatgcagataagcgccatgatcaaggaggtatctgatgcaggcaggcagctccaggggtgtataacctagcaacaagcgcgcgcacacagttgaacaaataaaagctcgtcgagccaagcaagcatccaagacctgtgttttcaagggccaagtgaactaatcgggcatgattaccctgagcagtgtcaggcggtggcgtccattttgacctcctcgaccaaatactggtaggctgacacctcatagatggtgagtaaatagcctgtagtcatcagctcagatatgctagacagcctaatctccttgtaattttgttgcacgcaaaactaataaccataagcaaaataattatctagtggcatgaggccaaatgtaattagatccttctctcaggtaattaactggctacacagaaatgtttagatcgatccacataggagatatgaaatgtaaccgatgaacagaggaagactgaaaagaagagatgtcaccataactacaacttggcaactcttactaatagatgagcaaaacattcaatggtggtcctgaacagacataatgcaactaatgctgactttctgcagtgatggacacgaatgcaaaaacctgtaatggacaggatcggcaaatttcatacagaggaattgcccataattgattccctccaaatatgcagtgatggaatcaaacattctgatggccacacaagacaataaaatttcaattcattggcaatatgagatcaatccttagaaatgtgtgcactcttgcattggtgatggaacaacttacttatttgacgaggaaaacagaatcatgtaacagcttaggatggtaaagccaaattgattaacatggaccgagaagtgaaagagtagccagattcaaccgtacatacagaaacaaaacagattatgactagagtaaatcgtttgtgttatctgaccatcgagatgggggaatctcaactaagaatactagaattgttccaatcagcagcaattgtaaaactgtacttcactagcataaaacacatccattgactcattcattccaatacgatagctggttcaattagtatagcaaggtgtaatatcaggaaaatatatagctcaagtagcaaagcatgcagtagcaaataagatatgagatgataacacacaccaagaccagagtcattggcgagcagacacttcacttaggaaggaaggataggtggtggatcacacagacagacacagggacacgaagatactactccagtaagcaagcaagcgatattacttagggtagatggatcttgcaccacaacacagacaggttgctacttctgctcctcctcctcctcctcctcctcgtcggagatctccgcctcgtcgaacgcatagccatgtttgaggtactggtcgatgagggtctgctcgtgnngcaacatcttgccatcgatgaacattctgaggcggtggagctggcgatttgaggcagaacgtcgggccagctcctcctcggtgcactccgggtaggtgtaggg

SEQ ID NO: 41419 - DNA, 23866 bp, Oryza sativa
  unsure (1)..(23866): unsure at all n locations
ggtgcactccgggtaggtgtaggggtatctcatcatctgttggataacttcattaggcatcttgtacttgaccaccttcttcctcttcttcttcccggacgcgatgtcggcctcctcctccgccaaggccttctcgcgctcctcaatccagcactccatcgcccccgggacatccctcgacacccagagaggcctcgccgcaatcgcctccttcttcttcttcaggatctcactcccctcacacgggatcgatgacttcctccaattcgggaggatcttcttcttctcgccaccacttggggacgcggtcgcctcctcctccttcaccctcttgatcccggccacgggcgcctcggcctcctgacggtcaccatccgccatcgtccgcgatggagccctaacaagagttgtccctctagaggaagatgtctagataacctaggagcagcaacagatccggcaatggcgaggaggagaggcaatggcgcgcgctgcggcggaagaggcggatgagagcgagcggatcggaaggaacttaacgggccaacgacccgactccactcgtgtcagcccttttattggaaggaacggcccaattccgttttcaagccttttcagcccatcccaccaatcaatacttgtatcatcaagcaaaccggaaagagttactacctccatcccaaaatatttgacgccgttgacttttttaaaaatgtttgaccgttcgtcttattcaaaaaaatttaagtaattgttaattctttttctatcatttgatttattgttaaatatatttttatgtatacatatagttttacacatattacaaaagtttttgaataagacgaatgatcaaaacatgtttaaaaaagtcaacggtgtcaaacatttagggaaggaggtagtacaagggtgttcttggtgacttaagaattaaataaagggtaataatatctttacaagggtaaaactattccttttggagttcttttatcagtaagccatataaagaatcaaataaatcgccttgatttcacacgaataaatgctgctattgcttcttgttgctgcgctgcttccattcgttcacagccgcatcatagaaagacaatcatagcaaaaaattcatatgcagacatgcagcaagctcatgttagcaaatcatcagactcatagttcaatacgctattctttttgtgctcgatcgtatcagagaatcagcatggtacacttgcttattctgtataatcatttatggtaatattatattcatgacttgacatgtgtgcaggcagctcatgtacaaaccaacccagcagttaagcttggtggtccaatagagtgatgcttaacagtaagcctacattcatctcattttccccttgcaagagatttcaaggtattacgattactgaatggcaaaagtgccaactagttcctcttacactttgtcatcatggaaccaccatctggtctccttcggcgacctcccattgcggcaattcctaacatagcggtcattgtcttgagggcgttgctgcaaacaccacattatagcaagataccttttaatgtttttggtcagcgaaagaaaatgggaagggtgttagttatatataataacctttgctggtgaacttgacaacattgacaaaatgctgatgcagaccgaactgacagtcattgcaggtgaccaagaatcatacagtatatctgcagatatatgaccagcagcaagctgttattcttaatggccattatatttatgcataaaaactgtatctcatctctcttttggttcacaatcacagagaaatcatcattacaaggatcaagaagtagtcctgtttctatggagaaggaacattaaaaaaaaaaggacagatcaaatgctcaaagatgaaatcacgagtcagagattaaggtgtctcagaaacatattttcctgaatgaatgattttcagctgctgctgcactgtatttcagaatcagtgatccaagttactcaaattcaatactacacacactcaactaccagctgagcagtaaagttgctccaaaattaacaaccctttggctcaagcagctcatctagactagttagatagtcgaagtaacagattcaagatgctaattgttgtatatataacttaaaacatgaaagcatgtcgccgagtcttgggggacaaaaaatagatttgactacctccgtttgccaaaggatataagtgctatgttattgcatacaggtagacaagtctactgaaaacagctcaaatttggcaacaactaattatacaatagcttgtttgctttaagttgttgtgatttgaccatttaacataatttatgcatccaacagagacaagacacggataccatatgtttccatgtgaagggcaatgatgaaagaacaaacttttcagcacatctacttttaagtgtctcacttcataagctgccaaactataacaatctattgttccaatgcatttgcagctattttagtaaagtggaaatggcaaggttatattggaaacatgagggccaacattatatttgcacaatagtttaaaatatgaatagaagcatgctatcatcctagtttgtactactgtatagatgtctaatcctcattacctttccaggacatttaagaaaacaccctcgaccacccagacacgaacctaactgacatgcatcctaactcccttcaaacagttcaaggtaaggaatgttttaattcccattagtattatatttttactaactttggcactcaactagaatcaagaaatatatatatatcaggcaaaagaaataacagatagaagtataaatcttgtttgtattctctgcatcacaaatcaaagcctttcaagcacaactgcaactctgtgtgatcactacacaagataagatttaaacaagaaatacttactagaacgaattaccaaaaaaagcaaatgcatgccactctgaaaggaaccaaaaaggaaggctgtacatatgtgctatcataccattagactcgtagctaattgtacaagaagacaaaagggtgataagaagttacgtaaacagcttatatagatcaaatttcagaggtggaaggagaattgaggacaagaaaagaagcaaaggtgttatcactcaggattcagtaccaaataaactacataattttaaagcttccctctgatggctaacaatcatagaagtagaagcactggtgacagctgtattaatagcgaggaaacaagacaaacctccaatatctagataataagaaaacttagaaagcagaagcaagaaacaatgtttacaacaaggtcgtgaatttcgtgatcccatcaagattgtctactaacatagtaaaagagaaatagaatgaaaagttaagtcggggcatctcaattgtacagctactctaggaagtggaaaagcacacttggcaaaggtggtggctttcccctaacagatggaatcttagcacctaactgacagctagatagaacatcaggttaggcaaagaacattctcatacaacatgcagttaatcaacatggaagcctaaacaaatatctgctagagagaagaggccgacatgaggaacaacttattttattttatttttgagatgataaggaacaactttacctaaacagatgtgcccgttgctgtaaatgtgtggatgcatcggcgccgggttgagaaaaatgacctggaatgaaagagttaaattagtttgcaaccaaatcgaatgcagggaacagatgagaagaaacgaaaggattaattaaaggtttctatatgagaaagtaatctgttgtgaaaagaaagctcacctgaggcgcctccatgggataatgctcagggaagtcgacctgcagctggtatgtctcgccggcgtagagcgtgcccgccgctccggtgacctcgattacccacctattaggcgaatcgtacgaatccatctccacagattaacaacaatactaataataaaaacccaccaaaaatccccaaaatcaagaacatatacagtcaagaaaagaaaaggaatcaattgtaagatgggatcccgcggttcatccacaggagaagaaacaagaaatcaaccagtagaagacaagatgacgacctttggaggttatcggagaccctgtacttgaacccggagggagggctgacctgccactcggcgagctccttctgcagccgattgcaagcgatcttgctcagcgcctgcgcgcaggtacaaaaaaaaagggggggaaattagaccaaaacgttcacagatagcgagaatcagacggattggggagagagaggaaggagtagaataatacctttcgggaaggagatgaggagctcgtcatggcgttgattgatgatgatggatgagtcctctcctctcctctcctctcctctgccgggaaggaggggagtcgaacaaagtcgaaggagaagaagaggggaggaagggcgctcgggctcggtcggctattcgccttctcttttacgtcgggtcggctaccttttctttctttttttttccttttgcattattattattattctttgcatcattttctagtttctcttttacaaagaatccaattcgctctggcttctgacgtgtcatctatctctcatgaaaccacgtctaaaatcctgctagtaatgggtctgttcggccgttgtgctgccgcaactacaaatacaaaacaatgtttttgttggccgcagtacagtaaaaagaatttgctgttgaacggagccaatatgatactatttagcaaagactattgtatttctctatattactgttattagtgtctagaaaataacctcgggtaatgcaattcatggatttgatgtataactcgtgttacaacaacatatagaaattagttacattttatatatataactatattatcagtagatctgtaccatgattaaaatgatttagatcttctttttcatctatatagtgaatttgatgccttcttttgtatctaaaacatacaatatgggggttgctatctggtgcgcacgtcagctggcaccccacgcacgcattttctttttcttctcgctatctttttccctattttggtgcctctcctcgcgcgttttctttttttccccctttttctgatttttttttattgttagcacacatgttttcaaatttttaggtaaaagttttcaaatcttaacttgaaagttttccaatctgaagaaagtttcaattatagagttgaaagttttcaaaatttgactttaaagtttaaattttgagttaaaagtttttcaaattttaacttgaaagttcaaatttcgagtttaaatttttcaaaatttgagtttagagttttaaattgtaagttgaaatttgtaaaatttattaggtatatggcttttaactttttaatagaaagttctaaattttatttgaaagtttcttacacgtatagatttccttcattctgttagtaaaaaaaaacctttcgagaaaaaggaaaatgtcaccttaattacatctaaactagctagcaagcttagttacgttagatgtgcgcatctcccagaaaataaaagaagtcctatagcaaatggtattgaaaccgcgtgcgcacgatttcgtttggcggcgcgtatgcgcggaacaggaatctcctacaatatatgttgcatttacagcccttatagtcaaaagaagtcagctgagcatcctcgaatgtcaaatagcaaatcttgaaaccaaataaatttgtgcagctattctttaactggtgtgaaaaaaaaatttacatctcttgaaaatagtcaaaatcaaagtagatggtttggatgtcaaatttgtatagaaagaaacctcaattagttcctttttttggattttggtaattaagaggtaagaaaaaaaaaggactttgcatatataggacgacagaaaaaaaaacagtgaaggggactattagaaaacaaaagagatgaactttgcatatataggagtcaccatcaaggcatactatcatggccgaattgtgtgcaaagggcggaatagcatatcagggcttgcccaattctgtttggagtacaacattacatttccagtgcattgcatcaactttctctaaaaacgcatgccatcaacttgatcaaactgttccatgatggtcgacaaattgccatatgcggatatgcccaatacagaggtcattcttgttcattcagtacgttatatcaaaattctgattcgctatacggctctcaatatcccaatttatcacgcgtatgaattattcagtcagaactgcttttccactcccaggtcccaagtagtagaatgaattgtttcggaatttggactaagatttttttagaaaaattgtgtaacaactgcagttgctgttttattcggcagagcaaaagacaaagggatagccaagctactattctggacagaagaactgtaattccaatattagttgaggcgaggataacgcacgcttacgaatggagataattcgtcaagaaagaatatattatagcaaactccaaacagaaccaagaatatattatactagcaaactccaaacagaaccgaatgattttattaatccatctccctctctagtgtgctaatctgttttgctgttgatgcattcgtactaaatagaattcaggtcgaaatctagaaaaagaaaagtactagtaataaagaaaaaattaagcaggtattttctccgtccacagaaaacgaatctaaaatcggatgcgacatattctaatacgatgaatctgantagatgtttatctgttttcggtgtgctagaatgtatcatatcctatactgatttggtgaatgtatcatatcctatactgatttggttttttacgtgacagagaaagtaggccgtatcctatactagattggtttagaatgtatcatatcctatactgatttggttttttacgtgacagagaaagtaggccgtatcctatactagattggttttttacgtgacagaggaagtaggccgtaggaaattaagggtagctagttggtgtcggtgggaaaccagtatcggttggtgaaccaggcatggtcggcgacgaccttgacgccgtcgctgttgcggtgccactcgtagaaggcgtgcgtccggttgacgatctgcagcgtggcgtggccgaagctggcctcccggaacaccgagtagtccggctgcggccaccggaagtcgtcggcgagcccctcgatgttccccccgtcgccgatgttgatgtacaccggcgccgaccggttgaacaccggcgtcgccatcccgttggcgatgtcgtacgccacgttcgacacccgccgcgtccgctcgtacgagtggacgtgcccggcgagcaccacgtcggccttggcgtcgacgagccaccgctcgaactccacgcgcatcgactccccctccatgtagtggtatccgttgctgctgtaccacggcgagtgcacgcacacgatcagccatggcgtcaccgccctgtccacgcgcctcagctccccctccagccacctccactgcggcgtgtacttgccgtacgccgcgtacgacgccagcacgatcacgtgcgccgacgccatcctcaccgagtaccacagcggccgcgtgctccccgacgccccgaacggcgtcgggtacctgttcgtgaacggcttgaacggcgtcgtctcccccagctccggcgcgaagtccagctcgtggttccccgtcgtccagatccacggctggtacgccacgctccgctccacgaaccgcgcccacgtgtcccaccggttgttgtcgtgccccgggtggttgtccgcgtacgacaggtcgccgatgaacagcaccgcgtcgccgccgcacgcctcgtagtggctcagcgtgtcgttggagtggaacgtctgcccgaggtcgccgatgagcccgaacttgtacggcacgtcgggcccgggcttgggcggcgtcgtgaaggagaaggacctggcgctggcggtgtcgccggagccgacggcgtagtggtacttggtgccgtagtcgaggccggtgagggtggcgtggtggatgaatcccgaccggtacttgcgcccgaaggagtagcgccggaaggtgccattggcggtgtgggtgaggttgtcggcgcggaggccgtagcggacgacgttgctgtcggggagcttcggcgtcacccaggagacggtcatggcgcggccggtctggtcgcccagcgtgatgtggacctgctccggcgcgttgaacccgggcggcggccggaacacgtcggcgtcgatcggcatgtctgggagcgcctgcaggctcctccggtacgtgctcgtgacgccgccgcgcgccgccggggacaagaacgccatcaccaccaccaccacggcgagcacgcacgccgcctccattaccatggatgatctaatctaatctaatgaatttgttgtgttctagatgaggagtgagtatatatatagtgcagatggtgcattttttccacgataatcgggatcgatcacgcacgcatgcaacggcattcatcaacaaccttcccgcatttctcgaattccactagcttagctagttgcagggattgccacttgacggaggagcagcaaatagattagtccaagtccacatcgatcagttggagaggaggggcatgcatgctgcatttttttcacgataatcgggtcacgcactggatcatgcaacggcattcacgaatacgatggatggaatgaacgattcatccatcaacaaccttcccgcgtttctcgaattccactagttgcagttgcagggattgccgcttggcgcgtgcacaccggcaacacgcacgtagcctgggggtgggttttcttttttccctttcttcaccacagtagatttattttttttccggagttctattttctctgtggttttattatcgcgtataccggtggattttttccgtggttttttccctaagacgagtatatctaacgtaactaacatgttagttttagatcacgatggtaattaagataatttttttctttttttggaagattttttttaagtaacagattgaaaacaaaattttgaagttaaaatttgaaaactttcaacttttcatctcaaatttaaaaaactttcaattagggtttgaaaactttcaactcgagattttaaaagctttcaactcaattttgaaaactttcaacttgagatttatttttttaaaagttaagatttgattcaagtcaagatttaaaaactttcaatacaaaacatttgaaaaacatgcgtgaagattaaaaaagtaataaaaaagcgcaaaaaaaaggaaagcaaaaaaattgcagaaaaaaggattaaaaagattaaaataatattttcttcaccttatacataacataaatagcaactttcaagagagaactttacagataagaacttgttaggttgttctcctttttctctgcataaagacttttttttctctttttgttatcactaaaatttagtaaaacttcagcttaatttttttttatatatggtgtctctgtttggaaaagtaacaggaaacttaagaatagagaaaagggagacaacaatcaaatcaatcaaatagaagaaaatctctgttctggataatctcactgtttatttccattgaagtacaaaaattctcaactttccttgagaactttagatgcaatctcttttgttacaaacaaagccacatgaaaaatattccaaagaaaccaatccttttgtgactcccttttagattgtactactctctttgctccaaaatataaacatttttaattatatccaatttggtagccaaatgtgttggcaagtgtcccatttggggattaattatctcacggcttaacaagatagactctgctagtagtatttgttattgcatagtaggagtatttattatccaaagctaaagaagaagaagaatggcaatagcatagcagtgatacaaattaagaagtttgagatggttggagtcgattaataattatacatcgtcgttggtgggcatccagtagcggttggtgagccagacggcgtcggcgacggccttggcgccgtcgtggttgcggtgccacgcgtagtgcgcgtgcgtccggttcttgatctccagcgtggcgtggccgaagctggcctcccggaacgccgagtaggccggctgcggcaccgtgaagttgttggcgatcccctcgatgttccccccgtcgccgatcgtgatgtacaccggcgcgtccacgttcgccgccggcgtcgccttgccgttcacgatgttgtagtcgatgttcgcgaacctccggctgcgctcgtacgagtggacgtggccggcgagcaccacgtccaccttggcgtcgacgagccaccgctcgaactggacgcgcatcgtctccccctccatgtagtggtagttgttgctgttgtaccacggcgagtgcatgagcacgatgagccacggggtgagcttgcggtcgacgcgggtggcgagctcctcctgcagccatgtccactgcggcgtgtacttgccgtaggcggagtaggaggccagcacgatgacgtgcgcggaggcgatcttgacggagtaccagaacggctccgtgctgccggcggcgcggtacggcgtcgggtaccggtgggtgaagggcttgaaggggaccgtctcgcccagctccggcgcgtagtccagctcgtggttgccggcggtccagatccatggctggtacgcgacgctgcgctcgacgaagcgcgcccacgtgtcccagcggttgttgtcgtggagagggtagttgtcggcgtaggagaggtcgccgacgaagaggacggcgtcgccgccgttggcctcgtagtgcgccagcgtgctgttcgagtcgaacgtctgcccgaggtcacctgcgtgcactcatccatttcatttcattaatttagggcctgtttagttccaaacaattttttttaaatgtttggacacatataaagagtattaaatataaaaaaaaaccaatatcacagttcggcaggaaattatgagacgaatcttttaagcctaatcgcgtcatgatttgacaatgtggtgctacagtaaacatttacgaatgacatgttaattaggcttgataaattcatgtcgcagttttctgacagaatctataatttattttattattagactatgtttaataaaatatatgtccgtatatccgatgttctgatgtgacatgtagagatttttttttgccaactaaacaggtccttcgtcgtttgtatttgtactaagtactacatttgacagaactcgtacagttgttttttttccaaaaaagtcaactaacatacattagtaacacgctgaaacggttactgcgaggtaggggagtactcctactaatactattttgtcaaatgaacatatttgatattttaaagcaatttatgagtgtgtttagttcctgaaaaaaaattaaaagtttatgagtgtaggaaagttttggatgtgatatgatgtaatggaaagttgaaagtttagagtagttggggacttgggggtgaactaaacacggcctatatgtagaaattttttacacgaaacaaaatgtttaatagttttttccgttagcatgtatttaaaactattaaatagtcatgcaaaactttctatataaaaattgcattaaaatgtcaaatatatccatttgaaaattttataataattaaaatttaattaattatataataatgaccttttgttttatgtgcgttaacgtaatctacatcttcattggtttcaaataccatacgatcatcacagtcaaatggtcatcaattccagctgcgtacatttttggtttttttgatgactttgaagcatgtatagtcaacacggctgacctacttgattgagtacggtactgtaggagtactcgagaggaaattcagacttgagtaatgacactgactgacgttgggatgagggcggtttgcagcgactttggagtctcccgatatatataattaatgcaaaaacttgacaagaaaccattcaacattgaatgcaacggattactgtgagactaaacctaacctaaatcctatcgaaccagtttttgtttgcatatgtgatcgatctactttgttcacaactcctaatgacttgtttaaattgatgtgatgagatgatgaactgaaacgaacgaaatggtgatgaattcatggcgtaatgttactcaccgatgaggccgaacttgaagggggcgtcgggagcgggcttgggcggcgtggtgaaggagaaggtacggacggtgtgatcgaagcccatggcgtagtagtacttggtggcgtgggtgaggccggtgagggtgcagtggtggatgaagccggaggtgtagttgaagtagtcgtacctcgtgtggctcccctccgccgcgcggtccagcttctccggcgagctcccgtacctgaccgtgttgctccccagctcgttcgccgtcacccacgacaccgtcatcgccgtccccgtctggtcccccagcgtgatgtgcacctgatgacaaagaaagagatgagagatggtcgcgcgttgtgtggttgtggagactgaagaagactgaacctgctgcggagcattgtagcccggcggcacgcggaagacgtcggcgtcgagcggcatgtccaccgtcgcctccagcttccgccggtactcgctcgtcaccccggcgccggcgccggcgcacgtccacgtcgccgcggcgaggaggaggaggaggaggtgagctccccaccgcagcatccccatggtgactgtgagctagccgcactctgcttcttgtgctactctgtttcgttggacaagcaagaaaggatacatctcttaaataggagagtgttgcgtgcatcttaatgttgacttgaactaatctgaatggtttgtggggaatatccatagatggtgccattagaccgtgattagattaggagagggtttagttggagatgcggatcaatcttggagattaaggacttgcaagttgactttgaacacaagtactcttctatccctactgatttattcttcgattcgcagcatgtacaaccaaccaagcaagggagggacaaacaaatctcacatcgctttgccttgccttctactgatttgtatgggcgcctactttgactgacaaaacacaccaccaattcacaaaagattgcgacatgtgtgctggcattgcaggcttgcagttcttctttgtcgaaacatcacccgtggatatcgttttaaatgatgtaatgtgaactgcttatcatatgccagtatattccagatgatattaagcataacacaatttatatttgttccgttaagatatgttaaagatatcatatcattcagacctcttcaacaaaggaaacttagctctctacttttttactagtagaattcagtataatgcacatactgttacttgcccatccatgtatcactcgctacatctttgaaacacagtggtggccttgaagaaaaagctagctaggagatcgcaatttcacaacttgatctagccaaaagcatgccacagagaagcatgctgccaccttttggtcgatttggtaaccacttgttcacagatttgcccccaaaatgattgcctcatatcgttttatgtgctgcactagacagcagattcacctttatagattctacttttgtttaatttctgtgtaaaaccgttagtgccagtaactgacagcatcattcagagggttgatccgagttaaaataccacaattgctcttcccttttgtgaaatctgaataagctaccacccattcatctttttttttttttgaaaaccgaccacccattcatcttaactttctgaactctgaattaggagcagtctagctactttcattccctgaatcaactagcatatagtataagttttctgaataatgccataaaatttggcagtggcaatggcaggtcgcgtgtcaagctcactggctatcggcgtcgtggacgggcaagctttgactcgaataagtaatgcctaaattttctttagttcgcattgtactaacttgtaatcaacagaaataaagttgttgccctgcttgacctggtattatcatgaggctttcacatgatgcatgtatcttaattgagaggagaagaagaagagaaagataaggagaagatgacctctcgatggcaactagtactagtagctcactactagctaaggcccctttcattcaaaggaaatgggaaactattctaattcctcgaggggatgttcctcgtttacctaaaaaccatctaaacggttatgaaaaattctagaaaaatttgacaacattcatacaatacatatatacaactccacaaaatcttaagtccaaactcaactcacacgtcaaaatataaaaaagacaaattcagcatataaatagtagcgtactgtttatatctaaatttgtcttttttgtttctcgacgtgtaaatcgaatttgaacttgaattttggtggattagtaggtatcattatactctacattgtcaatttttttcagaatttttcacaactatttacatcgaatttaaaagaaaaagatatacgatgggatatcccctcgagggattagaatccgctcccaaaggaaattcataggaattttaaaggatttcattcctataggaatttttcctatatagccctttgaattaaagaaatgaatcatatgtaatcccataaaatttctatggaatgccacttcccatgcaagtttggagaaaatttagcatgaggttctacctcatgttaagaatactttgagtctttatctctcctcaaattcctgtgtttttcctacgactcaatcaaacggtcattcctatatttttcctgtgttttacaatcctctgttttacacttgtattcctatctgaatcttatgttttttctactcctctgttttttcattcctatgattcaaaaaggccctaaccctttcatcaataatgtcagttcagtgcttgcttgtgtcgattctgcctagtgcgaccaccgttaagttttggctaaccacacatgatatatattcaagactccctcatgcccctcaaatgttcgattcttttttacttttgttagtgaactgactcgatccatctgaatgactggaaccactcattcagtcagtcattcattctgctcggctcatttgatgttcgtacggaaaatccggattcgtaaatttgatattccagtgtttatgaagtacctttgagtgagaggctagcgtgaaaggtattggcatcttgaacatgttcttttcagctgagaaaaagcagctagcgatggagaaagaaacagctcgcagtggctctacatgtgaggtgtgagtcgcccgaaaagattgatcttttttttcttctcagtccaatagtccatggcagaggattatattccgcatgacaatgattgcgccagagactgaaagcgatcttggggtatgaatcgagtcgagtcgagtcggtcggatttcaactagctaagatcgatgatatataattggcctgcaaactgcagatgtgtatatatatattcagatatattttcagaggaagcagcaggcagtgctctgtgctcctccatcgatagatatatcctgcctcctctttattcagaaaacagcagcagcaggaagagattacagtaaactgttactacttacacacctaatggtattgattggcacgattatatatatagttattataaaatcacacgtacgtacgtgtacaaaatcacactaggtaggcaggcatggacgacgatgaagaggaagcgatggatggatgcgaatgaatgaatcatccataataatggcgcttggtgggggtgggggtggagtcgtcgtggttgggcatgtggaagcggttggtgaaccagacggcgtcggcggcgaccttggcgccgtcgtcgttgcggtaccaggcgtagtaggcgtgcgtccggttcttgatgtccagcaccgcgtggccgaagctgtcctcccggaacgccgagtagggcggctgcggccacgtcatctcgtcggcgagcccctggatgttgccgccgtcgccgatggtcacgtagacgggcgcccggcggtcgcgcaccggcgtgcacagcccgtcggtgatgttgtacctgatgttggagacgcggaagctgcgctcgtaggcgtggacatggtcggcgaacacgaggtccaccctggcgtccaccgtcatcttctccaactgggcacgcatcggctccccctccatgtagtggaagttgttgctgttgtaccacggcgagtgcgacgccatgatcagccacggcgtctcgctccggttaacccgccccagctccgcctccagccacttccactgcggcgtgtacttggcgaacgcggagtaggaggagagcacgatgatgtgcaccgacgccagcttcaccgagtaccagtacggctccggcgacgcgctggcgaggtgcggcgtcgggtagcggtgggtgaagggcttgaacggcttcgtctcccccagctccggggcgtagtcgatctcgtggttgccagccacccagatccatggctggtacgccacgctgcgctccgagaagcggccccacgtgtcccaccggttgttgtcgtggagcgggtacttgtcggcgtaggagaggtcgcccatgaagaggacggcgtcgccgccggaggcctcgtagtgggtgagggtggcgttggagtcgaaggtctgcccgatgtcgccgatgagccccagccggaaggccacgtcgggacccggccgaggcggcgtcgtgaaccagaagctgcgcaccgtgaacccgaaacccatggcgtaatagtactttacgccatactgcgtcccaaagcgtaattaataattccactctaattaattaattaatccatatacatataatgttcagctaattatgtcagcttattggacacttgcatctgatatttttcttgacatgaatgtacgcttgcatataaatatttttctaatttatttttaggtggtacttcctccgtttcataatttaagtcattctagtattgtccatgttcatatagatgttaatgaatctagacatatatatgtggctagattcattagcatctatatgaacgtggacaatgctagaatgacttacattacgaaacggagggagtacttcattttgccttgaggcaggtactgcacatacatctacatatgcctgtccaatatccacttgtttgatgccaatagttttttttggaagaaacgccaataatttatttacctatcatattttgatagttcatattaatatattaactttgcaaacaaaattaattaatagggccactccattcgatccgcttgcttgagaatgtataaatgtttggaaacatccagtatatcgttcgactgatcaagacactgcaccactgttcgatccagtatatatttcatagctaatggagcatttctttatgaacatggtctctaaatatttctggagttttaggagaaattaagattgaggtaaaattacttttataccatatatatttttcatcacctgattggttgatatatggagtcggtgggtaaatacttatataaaaatttcaattactagttagaaatacttatacatatgtgaacaggagcattacggaaattttcctcaattacattttctggtagacttgtgacttgtcagagtttgataatatatttttgtcaatagaacagtaatattcataatatatagctctatcgtttgtttttcagcttataagttgtaaccaaaatttataatttaaatcctagtttatttttattgttgtttttaaggtgttaagaacatatgtacaaaagttttacttataaattatatattaatgttaataagcgttacggtttataatcaataatataaaagttgttcttttctccaacaaaagttaggacaaactcttggattttcgtggcatgcttttcgaactgttaaacggtgtgtttcgtacgaaaactttatatatgaaagttgttctaaaatatcagattggtccatttttcaagtttgtaataattaaaactcaattaatcacacgttattatcatctcgttttatatgaaacacttaatctttatctttatcttcatcttcgggagattcaaacaccaccgtagtctggaggtgaaacggttggggtggaacaagtgtgtgtggggggtaaactggtgatatatacctggaggttggtgagggcactacaagaaaaattagctattgccacgaaagtattaccatgaaaaataattggtggcaatatatcatactattgccacgataaaacttttcgtggcaaataagtatattctgttgcaacgatgtataatcgttgtaatatcttttattttcgttgcaacaaaaataagttatcaccacaaataaaatatcgttgcaataaaaactaagctatcaccacaaaaaaaatatcggtgcaacgtacaagccctattgccacgacttcgatttttgtggcaataagcacacaatatttgccacgactcagccgaacctcccaaaatttagcgcgaaatatttctgtgtttcgcggttttgggcgcgtgaaaagatcgattaactcccgaaaaagttagttcagttattagtactatttatcaatctaatctattccattcacacggctgggcagtgctcccgtgacttccaaagtctcacggaggagcagcgcctggtgatttcaccgcgacggtgccgccgtcaaccgcgtcacgaggaattcctccactccgttcagtgattcagctttcagccttcaggtatcctccgttttcatcccctcatcctcctcgaatacacaatttcttttttcacggtctagccaaatttcccaatccgtcggcgctcaccgtcttctgtgccgcctcacttgcgccggcgaccggatgacgcctgcatcccctccaattcatcttcctcatcccgatctgatcctccagccctagttccacaagcaacatgccggagatgtgtgcgggagggatccaagcgaggtgcctggctagaggcgccacatccgccggggaagacgagggttcgctggggaagacgagggttcagtcaacgcatgagagagccactacaatggaaggatgcgagggtacacagggtcggcttcggccccggcgtcgacgaggaagcggagccggaggatgtcgcttgctgcagatgggggggtcggccgcggcgccatcgatggaagttgaacgcagcgccgccgccgtcgatggaagccgagcgcagcgctgccgttgacggaagccgggtgtatcgtcggatgccgaatatgccgcgtcgcgccgctgccgccgccgccgctgggcgtagcactgcctccaccgccggacgccctatgccatcgccaccacactaccacgtaggccagggcacaaagctgccatccaatgggttgtggaggtaattaaattgagttattggagaagatagagagaaatcagactggaagacatgatttattttttttactagtgctattgatttcccaggcataaattcatattatttttgtatacatatatagacgtatcccgtatccatgtttttcagaaaatgatgtatcctatccatatccgtatccctgtatctcggtaacatagagcaaaggatgttgcttgctgcagatggggtgacggccgcagcggcagcgacagtgagtagtttagaacttcagattagctatcttagtaggcaagcagagcaggcagggcgagcattgctagcgtagaatagctcagatgagttatgtttgtttctgaatttctgtctttgtttctgaatttctgtctcccacaaggttaccttggttatactgcacaatatccaaatttgctatacacggtctctcatatttattaatttcttcagtttgtccaatttctcatatgaattttgaaaaataagaaacaccttccatgggaataccaatatatctgttactgtccaatgtctatttttcagctcaaatcctcatgattttgtttagttctaatttatctgttcatatctttgtacaggaatattttttctggtcagcctacagagacaagttctggcaaggtgagtttatgttcacacagtttctccattttccttaagatcataaagtgccaaccatattttccttgtttttttttcattaaatgggtggtttgatactattagtaatattgtatagtgataagcaggaagcatgtcagtagataagagttggatgcgcatgagtagggcaactgcagagtggcaaaaagggttgcaggaatttttaaattttgcatttcaagatgataatcctggggataatgccccctgtccatgtagaagatgccttaatgtggtacacaaaacacgctccgaagtgcaaagtgacttgctaaggaatggattcgatgaaagttacatacagtgggtttaccacggtgaagattcagatgatgacaatgtcacgggaagattcagaagaacgtaaggaaagggaaatgctacgggaggaattctcaaaatgattactacgcaaagcgtagcatcggaacaacaggtaatgattgccaaaatgttcacattcaccaatatttgatatcttatatatgtcaaatgtggaatcataatatatatatttcttgttttatggtgtgaagtctgatctggcaatagattgtccaactgagaatagagaaccacatgacacaacaaagaaggctcgaagcattcagaacaacacagttgtgaaagcactttttaacagcgctaatttgcaaggaacaacaagtactacccggcaaaatatttcttcacaacatcttaggaatgttgctagaaattttgtacggtcccgaactgatcaggtaattacaaatcttcagcaagctgctatgttgaaatgatcttttgcaaaaaattttacaatatgttttcctgctcatggtctgtttgtaaaaaaaataatttcttattgtgtatggccaaatcctgtaacaggccagaggagaaaatggaagaatgaatgaaagaaatatctaaatcagctcggggtttggtgtagcatccaggtaatgatctggtacttttgctacttaactcattggattgtattagtatttggcacgtcccctttgctgacaaaaacagttgcctgtttagtttattagtatatggggcatctaagcttctgttactgccccataggcctttgttttgtttatctgagctaactaagataagcatgcatgccatataaatgattagcaacacagtactatatatagccaccacatatgtaacaaagcatatatatttcagtgggtctcacaagtcagtaaataacaggggcatggcttaaaaaatgtcagatatagtgagcactaatcacatttgtttatgtttccatcaatccaaagaacacacatgtccatacagtggcatgatagttatggcatatgacttctaactcaatttaatcatgttagatactaaaattagttgcactgcagactctggcaatgtcctttatttgaagaaattatgaagttttggtaactatacatgctagcagaaaactagataaaatagctctgcattttacatggtgactttctttactttaaatacgacttgtaactatatgtccatacatttgtacaggaggaacaatcaactctgttactgttgaatggctggagcaaaccacgacaaaatcaaacaagtgatggctagaaaagctagtttcgacaacaatgttacaaactcattagtttcagaacttttagttttatcagacaacttgtatttcagcatttggaaatttaacatactcatattgtcatcattactttgggtatctgaaatatattatgtcttattcgcggaaatatcagacatcataattcttgtgcgcatgagttgcaagggttttgccatttaacatatatttctactcatgttgcaatagtaccaaatgatccatccaattactgatgtaacacaatttcttttctataaaagctagaagaaattcatttcattgtaataatacttattgccacaaaaatattttagtggcaataacccatatgatatattgccacgattaatgctatgtggcaataacatatattagatattgcaacgaaactattttgtggcaagcacaactaatgccacgcacgaagtggtggcaataattatttgttgcaacgatgttaagtgttgcaatatgtttttttgccacgattattttgtggcattatcaaagtttgttgccactagataaaaattgttgcaataacctattgctactgtttctattgccacggctagcaacggttttaaaatggtggcaatatgtatctattgccacgatttttttcgtggcaacaaatcattttcctagtagtggggtgcagtggtggatgaagccggaggtgtaattgtagtacgtgtaggtggtgacggtggcgtcggcggccatgtcgagcttgtccatggggaggccgtacaagacggtgctgttgccggcctcctccatggtcacccacgacaccgtcatggccgtccccgtctggtcgcccagcgttatgtgcacctgctgcggcgcgttcctccccgccggctccgcgaacacgtcggcgtccagtggcatgtccaccatgtccgccgccttcttcttcggccgccggtacacgctcgtcgtccccggacaccgcatcgcctccgccgccgtcgccacaatcaggacgaccaccacaacaataatgctgctgctgcagaggcgagcccccatggccattgctgcagctagctagagctaattaagctcgagctcagtacgtagctagctatccagacgatggcgcgtttaagtagaggaggggcacagtgcaagtagcagctagacaccgtacgtaccgtggattattattaaaaccacgtgctgtaatagcgacaccattgatgagatgagattgacattgcatccatcgtactctcatcttctgcatattattgagattgggctgcaggagatccatatatacgatatcctcgtcatcatcttcatcgtcgatcgatcgacggtcggctacagtactacacacacgatcgaggtcacgattaattttgtaccacattattcgtgtttgtgataattaattcactgacgacagagctagtgacatgtctgtccgtttcgtttcggatcatccattattttgtctgttttcacacgctgtacccatccaagctagggtcttgagattaacttacaccttactttgcactgcacattttgcaacaactaccagctgaagaacaaaacgggtgtgtgtaacaatgtatacggacaagacgcaactgtcgtctgtccatttcagtgacttggtactcctatatactagtggtacattttatagtactagtaaagctacaaacaaacgtgtaaaaacatatgccactcgattctttcattaaaaaaaatatcatgttgtgcaatactataatgaacacttcattgatgtttctctccctccagcctccaccgatctagggctctttggaacactacaggttctgatttctgaaaaggtacaggattaaagtgtcatatcgcttcaaatccattagattgaaaac

SEQ ID NO: 41420 - DNA, 29358 bp, Oryza sativa
  unsure (1)..(29358): unsure at all n locations
ctgcaggggaaattgtcacgggttttattccatgtgcatttggaagcccacgaggcagggatttcccggcccaatccacggggaaaccctagggaaaggtccccgaccttcggaggttgggaatttttgctctctcgatccgccactgcttctcgctcgcgcaaccggagtcgcttctctctcgcgcgaacaacagcgggcgccgccgcgcctccttctccggcgagacgcgccaccgccgggactcctcctccggcgagaagggtaagcccttctccttattcccatcctctcctcctcctgggtttccgttctcctcctcctctagggtttccgcctcctctagttagctcccaatctcgctctccggtctcagcgcttgtatcgcaggcaccgacgcgtgggcgcggcgggtggcaccgcggcagccggtgcaacgacgacgaggcggcgagccggcagcgcgggcacacggctccaagcaggcggggacaggggggatccaaggcggcgcgactcaccggtagaggaggcgctgaggcgcagatccgcctcctcctcctcctcgctgcgcgacgcccgccggcggttgcccggctaggtttgtgcgtgcccttgtagctgctgcttgattcttgggggttcgttcagtacttcagttttcttggtgtatgtatggcatgtttcttgatttggtttgggagagttgtaatctgttctcctgttctttctaatacattgtgatattgtaccctgcagtagcatttcattttgttatggaagcgattcagaaggggatatgggtgggcgtatggtgctcttgttttagatcatgaatgagttttggtaagatgatgttctaatttgatggagtaggttgtgctctggttttttctgcagtgtaattatcatgcttagtgtagtctaaatatgtgagatcaatgtgccaatcccaagaaatgaggaattatcacacatgcagtgaggatcattcaactagtgaggtatatgagaaattttagtctgcaaaccagtaacagttttttgtagttaattagagatgcagttcttttagttggatgctgtcagctctgttaacctagaggtagatctcagtactggttgagctgctagcatcaagttttttgttttttctggaggtattttttagtctgatccattcttgtagtctctgtcagggaactgtagaattagtggtcaatttagcatacatgttgggactaaataaatggtaacaatcatatttttgataggaactcatacttactacaaaatgaagtcttttatgctctatacttatacattagtccaaactttagtttcatgtcatgtatcactagcagaaaatgagcaaggtggcattgtgcattcaaaaaaacacaagctttggcagcaacctatatacaaagacacgcacacacagatgtttcaatctcctctctctcactcactgcacaatacactggccaaacaaagtgacctagtagtaccgattaattaaaacaacaactactactactacttttttttccttatcatgtccataatgataattcataattgtgctcttgcattcttcctcttgccaggattcaatttgaattgcatgctcaacttactttcaaatatggacttgaaatagagtattgttggaaaactatcaatacaaaaacatggacttcaaatgtgtttgatttaaaaataatggtgtgtatctgcatgtaggatgtttgatctaaaaagaaagtgcttataccaagagtttgtttacgctgatgtagctgacaattgcaatatgttggttgatgtgcatgcatttttttcctaagctagtatcaatggccatccttcaaatttgattgctgaagtatcactattttatatttattacttaaatttcagattatctttttcatcctgacagatttattagaatatatgaagatttgttgaagagatgatgaagaagatagaagagataaagatttaaatggacccatgtctcattcttgatcaagacatttgtggatataaatataatgtacagttctatatttgtggatgcaaggatgattccaaagattttaaattttgtatgatatggatgattctaaagtttaacttatgtcatgtcacgaagttggtttccacataaactcacctatatttctttgtatttttctgaatttctaatacttgttgattttttatgtttttatatttttttctggaatttttgtaggttgtttcctatttatatggattttctatattctttctatttttcctgaaatttctataatatttctagagacatgttgttcaaacactgtttagcagtttgcctgtctaaatcccccttcccccatcaaccctctccccctactcccaaatggtatcagggaaaattcccctaacaggagtgattcccttggaggtggaaggggatcggttggtgcagggaaaaatctctgtacgggaatttttcccggggtttcctcccctgcatccaaaggagccctaagagatatagacatatataagaacctgtaaggtataaagatactcaaaacagcgcaggcttgtttggtttggaggccgggatttcaactccacagaaatagaaaataatgtaggaacaggaatgcataattacaaatccatactaattaaaaaaaaggtatgagtagatgggaaattttttatgtttttttctctacaactgttagaaaaggaaattaatttcctttggattttctataccttattgctacataatcaaatgacagttataagtagtaattcttagcgtatgcttggtttagcgtatcccaaaataaacaccctgagaaaataaattcgtctcaatccgatccattccgtcctccaactaaacaaatgcttatgaatccaaatcctttgtagattgacaggcaggccggttggatctgacttctgcctggtcatgcagcacggactctctttgggccgggcttatctaattggcccaattagttttgaacgcgagatgtgaggacctgtctcttttgtttgtttggcaaacaattcagatttccccgcaacaagggaaacaattcagatttctctatctctctctttcaattacacagttaacacacatactaaaatcttcccgcgaatgagtttatacgctgctgcagataaagttttttttaattatttttaggagaaaaagttgagtgtgctcacacgtgtaacaattctcaccattggataatgatttcatttgtagatacatgcaaacgtgtgaacttaactcctttcattcccttcactttactaaaggtctgctgatctacatatagatatagtggtgcacagcctgaaagtgctgtcaacaagtaaatgagagctgtgcagtgtcattctcgtattatatccaacctatcagttatggccttgacagtggccgccattttatttccggttcacgatggatatgtacaccaaaaccttacttttcttttgattcccagccacacttaaaaacacatatcttttcaaaattgggggtttcaaagctagtactttatacccatccatcctaaaatatactaaggtgtagccacttttttttaagtatttcataatatgatgtgcgtatgtctacatacaattcactaatacttctctcttccataaattttctgttaatcatccaccctaatctcattggtgcatgcatcgtgtttattgaggcggtcgaaacgagaaggtgataacaattatttctttttatttgtgttagtggtggttgtgtcttacttcctccggtattataataattgacgctttggacaaggttgagtttaatcttttataactttgaccatcaataactttcaaaatatttgttttaaagaaacaagaacaacatatatagatttgtctttcaaagtaatataataaagtaaacatgcatttatttattgtatatattataatagaaaaataaggtcaaagatatattttgtagaccgtgtcattgtccaaaacgtcaattaaaatgaaatcggagggagtagctggtagcctggtaccccctccatccaaaaatctaagacatatttctcttgttagtaagaccagtgagtaattaactcatccatcatgtgataaagccaatgaactatacacatgtgttgacgtttgagatcgcgactacggtatttatatggtatggggatcgttggcaccagggtatatgcgggattgaggtaaagagagatggagatagggatttttatataggttcgggccccttatctggtaggtaatagccctacatcctgttggccaaagccggtgttactctttattcatctggatcacacaaatataatatttgggataacctatctagctgtcgtcgacttggcggctagataaccaactcgtagtcgacgacagggtagtcttcctcctcaagtacgaactcgtcgagatcagagatggcgctagatccctcttgccggctttcgtaggcaccagatggggtatgtctaggcttatctctgatgttaatatccagcggcgtattggcttgtgtattgtgggtttctttttcctctcctcctagggggtttgtatttatatccataggtgtcctcttgtccaaataaaactagggagaccaaaatgaatacaatccaagtagtccttgccgtttccatatagaactctatttgttattccttatccggaactccttctatatacgagattacgaggtttgtttccgtatagaacatggtatgtggtgggcctcaccgagcttagtcgattactattgggtatgtggtatcaataacccttatagtatgcatgcaaccaataagtactaagatgacattttgggttccggtcaacaatttaatttagcacatagagattataaataggtcttagacttttttggatggaggaagtatgaaatattccctccatccaaaagagttatggcatccacaatatgcttaaaaaccaggtagtaagcaataatacaaacattgtggaagtagtaagcaacaataactccctagtacttgctatattcaaaattctaagacatttcatttgtcaccaagaccaatgagtaattatcacatccaccatgtgacaaaaccaataaattatacacatgcatgcaaccaataagtattaagatggtttcttgtgttccgtcaacaatttaatttagcacataaagatttttttaagagaaatttagcatgtaaaggttacaaataggtcttagacttttgaaataacaaaaaataaaatatatcttagacttttggatatgtaaaggttacaaataggtcttagacttttgaaataacaaaaaataaaatatatcttagacttttggatagagaatagtaaggaataaaaaaacactattttctcacctatgtgttgactctctcctttccatccatgccattgcacaccgttggatttttatatagtcatgggaccgccttattgcctcacacattatgaaagttccaacgacaaaaatctacatttgttagaccccaccttacttactgagtatactatactaatgcccttagacatattactttcattactaagattaagaaaaaattaactcatcttatatgtaacatagattaaaaaatacatgcatgcaaccaatgattattaagataacttatcgggttttgatcaaatatttttttatttatatcctagatacttgaatactacaaatataactaacatattaagaaaaactgaaatataaaataattctaacatttttgcagaggggtactccctctgtaaaaaaaaaataaaaaaaccaattctaggattgtgttttttttttttgaacagaggagtactctttagctgccccttcaaccttttcttcattaccgacataaattttcagttatagttgcacttccacaaactagaggtgcaataatgaagtagcattaccaaagtcaacaaaaactgtcctgcttgctgccttgctgccgctggtcctatccctaccagcttgaacaaattggtgccataccgtctgaagaaagagttgatcttttctttagttttggcataatctgtatgtcaatgttgataggagtaagagactggaacagataagtatcaaatccggatttccggaatagaacagaatcagattagtgaattatctgcatttttcagacagtagcaactggcaagacagcagagttcctcaatgctgaagaatatccatcataaaagatgagattttgggaattggggatttggataggatcatcagactttgggacaaaccatcgcagcaaaggtcaatatcatgctggcaatttgacgctgaaccaaaacttttgtcaaaattatctcaaaccgtgtactcaatcagtgaagtggacttgagtgagtcacatgcatcttcaacgattttcctctcctcctactgctacaagtctgcaattaatgcgatctcaccgaccgtacacactcctatctatccaacaagctaattaagcgaggagcttggtagacggcggcaatggcgggcgcggcggcggcggccttcgcggcgcaggtgctgcgggggcggtggttcatggcgtacggctccttcctcatcatgtcggcggcgggggcgacgtacatcttcgccatctactccaaggacatcaagtccaccctcggctacacccaggagcagctcaacaccgtcggcttcttcaaggacgtcggcgccaacatcggcatccacgccggcctcatcgccgaggtcacgccgccatggttcgtcctcgccatcggcgccgccatgaatctcgggggttacctcatgctctacctctccgtcaccggccgcgtcggcgccaggaccccgctctggctcgtctgcctctacatcgccgtcggcgccaactcgcaggccttcgccaacaccggcgcgctcgtcacctgcgtcaagaacttccccgagagccgcggcgtcatgctcggcttgctcaaggggttcgtcggcctcagcggcgccatcttcacgcagctctacctctccttctacggcggcggcggcagcaacaccaagccgctcatcctgctcgtcggctggctcccggccgccatctccgtcgccttcctcggcaccatccggatcatacgcgcaccgcgctcgccgaccgcggcgcgccgcgagtaccgcgcgttctgcggcttcctgtacgtgtcgctcgctctcgccgcctacctcctggtggtcatcgtcctccagaagcggttcaagttcacccgcgccgagtacgccgtcagcgccgccgtcgtgttcgcggctctcctcgcccccttcgccatcgtcctccgcgaggaggccgccctgttcaggaagacgccccccaaggaggaagccgacgacgtcccggcgctgtccgcggccacgaaaccatcgcccgcggccgccgagacgccaccagcgacggcgatggagagggtggtccgcgcgctgaggccgccgccgcgcggcgaggactacacgatcctgcaagccctggtgagcgtggacatggtgctgctgttcacggcgacggtgttcggcgtgggcgggacgctgacggcgatcgacaacatggggcagatcggggagtcgctggggtacccgcagcgcagcatcgccaccctggtgtcgctgatcagcatctggaactacctggggcgcgtgtcggcggggttcgcgtcggacgcgctgctgtcgcggtacggcatctcgcggccggtggtggtcaccggcgtgctgctgctcacggtggcggggcacctgctggtggcgttcggcgtgccggggtcgctatacgcggcgtcggtgctgatcgggttctgcttcggggcggcgtacccgatgatcctggccatcatctcggaggtgttcgggctcaagtactactcgacgctgtacaacgtggggaacgtggcgtgccccgtggggtcctacatcctcaacgtccgcgtcgccggcaggatgtacgaccgggaggcgaggcggcagggggcggtggccgtggcggcggggaagaaggagctgacgtgcattggggtgaagtgctacaaggattccttcttgatcgtcgccggggtgacggtggccgcggcggtggtgatggcggcgctcgcgtggcggaccaggaagttctacgccggggacatctacgcgcgcttcagggaggaggcggctgccggtggcggtggcgctggcaatggcaccggcgccggagaagatgagaaggtggaatccaaggaggagaaggcggtgatgacgccgacgagcacctgagctgcaattctgctgctcgatcagaagatctgagagatagaggagcaaaaaggactccttttttctttataactgttcttttagtttttaagaagtgctatactacaacattgcaacacccacatttagagggataattgacccacattttcaacttatctgggctagcccgattcctccaaaacaaaaacactttttatggctggctataaggggaaagattcaatcggctgttcaactgaagaaatttaattgggaaggctctgaattctgtcaactgtgtgatagaagtgaagatgcagttcatatctgttttaactgtcctattgcgacttttgcttggtgtgtatgtcgggatgctttggactggggaaggatcccttttaattttgaggacttctttagactctatggttttgatacttctaaaacctctagacttaataccatgattttggctgctttgatttggactctttggtctgctcgcaatgatatgatttttagaaacaaactaatctcctcacccctgattatctctttccgcttgattggttttcttttacagtggaagattctattaaagccggagaaggcccatgacctggaaatgaagactcaagctatgcaaggagtactggtgtccttacgaagagctgggattggataattctgctcccatctgtttagttttcgtctctgttctgctagataacctttatcctttaccctttcttagagtcatccttcttcttagagtcatccttctttggatgcttatgttctgatgcctgatggtaatgcctttaattgaaaactggcagccccagtattatgtaaaacggtttgtaagacttatgctttctataaaaagctgggccatctggcctcccctctaaaaaacattgcaacacccaatttcttcttcttcttcttggatcttcttcttgtttgacaacttggatatactagttcaattgatggttagctttgggttgcatactgtatgcatatgaatcttggatgtgtccgatgacctataataggctgtcaaatttgtcgcttgcaagcaagcagatatgcatgtggacgttgtgtacagctcgctgtcaattgagttggttgtgttactgttgtgcacttgtgctcatctcttggggttgtactcgtacattactcatgggatacaactaacacgtagtagtatcaacttggcgttgaaaacttgaaatttccaacttgaactaaaataacagagagcgaaagctgggaatcttgagtgagtttgctccatttcagggcctatttaaaatgaaggattgttggaggacttcttttcaacgatcaatttccttatgaatttctccaaaagacgtctttcattcatagcaaaacaatagaatgttctctattggattgtattcctatggtagaatttaaagggaaaaaacaaaagatttggtagtcttaaatttttctgtggttcaattttcccgtgatgcaatcaaaaggtttctcttcttgtgttctcagtttctgtatcataaaaaaaacatgtcactttgatttctgcatttttttttctgttcagctgtttttctatcctacgctctaaagagcctcaatgagatcgcaccatctaacaattgagagaggattctcttacttacttccctctaactttgagtcactggtatgtgggtatgtgagatcattgagtagagggttgacatgaaacttttatttttgaaaccgagaagttagaggatctcaatccctaacaatgccatttagtaagtccgaagaccacttctttgggagatactgttgtgatttgacagtatcaacttcatattatcccagtggactatgcagcattttccctttccccctgtctacaaagttgcagttttttagttgcatggttaaattttggagcttaaagttacacaaattcaaatccccaagcttaaaaatccacttgatgagtttgtgatatacttaatcttctacgtactacactaaaaaaaaactgtgtaaataatttgtgcaaaaatgaacattttttcacgaacgcgcaaaaggattgcacgtcaatatattagaaaaatagagttttgatacacaacgcactcagccagaccggcctatgccaaggaaggaagaaaaacaaagaaaggaaaggaaaaaaactcgaaacgacggtaactctactccaaacagggggagggggtagagccactctacgctcccaacaattccccaaaggaagcaacggccgctaacgaccacagccggtcctccgaaaggatggactctacgactactgtgaccgaagagaacacagagtcaaagaccctggagttacgttccttcaacagttgctatgagactaggaggactagggagttgaagctggcacggagatgataaggtaaacatgccctagaagatggccaccaatcctgcagccagctgccacggaggggagagaggacagcccagccaggagacgacaacacccgtcatcagacctaacgagcgaacacgcagtcaaggaggatgtggttcgtcgtctcaagctcttgagcgcaaaaggggcaggccgagtggctatcaatgccgcgcttctgaaggagatcagccgtctaacagcgctgctgaaatgcaaaccagaggaagaatttgcacttagcagggcccttcgcgtgccagagaaaatcggcacaagcaaaggagtgctggtcaaagaagaacgcctggtacgccgaatgcgtcgagtagcgctggtcactcgtccaacgccagacaagatgatccccgacacccggcataagctgaatgtggagtaccgcatcccaaacaaggagaaattgggagatgaccgggacagtgagggcgccgtggatgtcagaaatccaggcgttgtttgccaggccagaagcaaccgtgcgcgaaccacacagacgcgggggcacaacgaagaggagatccggagccaaggaagctaccgagcggccgcagatcaattggtcagaccagaaaagaattgtctcaccatcacatggtatgaagaaggtgaacgcctcaaacatgtaagagacggcttgctcggctggggccttcaggccgtcccagtagggatgcgctgagcgctggagccaaagccagcgaacacgcagggaaaaacctgccaacctaaggtcatgaattcccaacccaccgaaagctctgggacaacagacattcgtccaagaaaaccggcactgcccaccgtgagccgagtccatgcccgtccacaagaaggcgcgacgcttcttattaatggccttgatcactcaggctggaaggccgatcgccatagacacatggaccggaatggaggagagaacagactagaccaaaacagaacggccggccagagtggtgagtcgtcccttccaggaaggaagacgacacacaggaccattattccataaagtttgtaatatgtacagtatattccttggtttcctcaaacaaatacgagtacagtatcctagtatattattccttggcagtgccactgccattgctgtccactccgagctccgtttttccgtccttgaacttggcgtagatgtctcccgcgtagaacacccgcgtcctccacgccagcaccgccgccaccgccgccgccgccaccgtcaccgccgtcatcaccaagaacgactccctgtagcacctcacgccgatgcaagtcaacgccttcttccccgcggccgcggccaccccatgtccctgccgcgccgcctcccggtcgtacatccggccggcgacgcggacgttgaggatgtacgacccgacggggctcgccgtgccgcagaagttgtagagcgtcgagtagtacttgaagccaaacagctccgacacgctcgccaggatcagcggctgcgcggcgccgaagcagaaccccaccaccaccgacgccgcgtacagcgaccccggcacgccgaacgcgatcaggaggtgccccggagcggtgagcaggagcaccacggcgaggatgagcggccgcggcagccggtgccgcgccaggagcgcctccgacgcgaacccggcggcgacgcgccccaggtagttccagatgctgatgagcgacacgaaggtggcgacgctgcgctgcgggtaccccagcgactcgccgatctgccccatgttgtcgatcgccgtcagcgtcccgcccacgccgaacaccgtcgccgtgaacagcagcaccatgtccacgctcaccagggcttgcaggatcgtgtagtcctcgccgcgcggcggcggcctcagtgcctggaggatcctcgccgtcgccgtcgtcggtctctgggattcaggcgaaggctgtgccgccggcttcgcgggcgcggtcaccacggacagcgcccgcgggacgtcgtcggcttcctcttcttcaggcgacttattcttgaacagagcagcctcctcgcgcactacaatggtgaaggggagcaggagcatggcgaacacgacggcggcgctgacgccgtactcggcgcgggtgaagcggagcctcttctggaggatgatggcgaccatgaggtaggcggcgagcgcgagcgacacgtagaggaagccacagaacgcgcggtattcgcggcgcgccgcggctggcgagcgcggcgtgcgtatgatccggatggtgccgaggaacgccagggagacggcggccggcagccagccgacgagaaggatgagcggcttggtgttgccgccgccgtagaaggcgaggtagagctgcgtgaagatggcgccgctgaggccgacgaatcctttgagcaagccgagtatgacgccgcggctctcggggaagttcttgacgcaggtgacgagcgcgccggtgttggcgaaggcctgcgagttggcgccgacggcgatgtagaggcagacgagccagagcggggtcttggccccgacacggccggtgacggagaggtagagcatgaggtatcccccgagattcatggcggcgccgatggcgaggatgaaccatggcgacgtgacctcggcgatgaggccggcgtggatgccgacgttggcgccgacgtccttgaagaagccgacggtgttgagctgctcctgagtgtagccgagggtggacttgatgtccttggagtagatggcgaagatgtacgtcgcccccgccgccgacataatgaggaaggagccgtacgccatgaaccaccggcctcgcagcacatgcgccgcgaaggccgccgccgccgccatgggcatggccggttggaggctggactggagcgctagctggtacagtaaatgtttgtacacgacgacaaggggagtacgtagataggaatatactactcctagacacgtcgtgtgattgcctcccggatccggatgatataacctagttctcaaaaaaaaatgttgcactactttgtaaaaaaagttaagacagttttgaagacggtagaaagtctcttcaacaacacaaattttgacaatttaaccctttacaaaaactaattttacaaatgaatcgtggccaaaacttatttaaaatacgaaccttttgtggcgctgaacttagacaccttagcaccgaataacacggcgctgaatgcacattggcacgccgactagcctcccatccgcggtggcacaacattcagcaccagttgacgtggcgctgagatggatccaggactggtagccaatctctagggcctgtttatctgagcatctccatgtcggcttcgactccctagttctcctggccacttggcagctgtggaaggaatagaactccagggttttcaactccgcacttccttcggtctcagtggttctggagtccatccgctcggagggccatctgtggtctttaactggcattgttgcttttaaagatttcttgggagtgtagtgtggcaccgcctcttcctgctgatcggagttacgtatagctgctgtagtagtttttcttcctagctacagcttttattttgttttttcttccttcccctggcataagccggtctgactgattgcgttgtgtaaaaaaataccttttttccttctaatatattgacgtgcaatcattttgcgtgttcacgaaaaaaataacaatatctctatcaatattatcttcccaattaattatagccctccatcatttcatttttttcacctactttgcttttcatccaattataatattttttctttttaatttcacctattttttaaagtaaccatgtctaaccataaaaatcttttacgttttagaacagatgcagtaactttgatccaagagtgggaagcgtacaagaggtaccgtagcagtacaattttagtttcttctctctcccgtttagattgcctttgaggtgaggctaaaaaatgcagttaattaagttaattagttcaaaagtttgggtaggcagccacatctgagtataggatatcagttggaaagtagtccaatgaaagtgaacacttacagcatgcgcgtgggagatgtggtggataaaaaggatgtgattaacagtaaaagtatacaagaagtaggatcgaatagcttattttttaacaacaaaatgcatgctgcgagggccaaaacagagcaagatgtcagtaacccagtgcaatctaggagtagctaattctaatgtactaggcaatgcatgaaatgtagttaaacaagctgacgagtagtatttgattgatttatatttaattgtctcagtgatttgaccggtagcttaattttctgttattctaggactaggaacagtatatgagactgaattattattattaagttgaaagggaaaaagtgagctgattagtttggtcttgatgcacgtgctgctacaggaggaagagaaaaaaaaaagcttacaaaaggttgggatttggctccatgcgccatgattccaggcagcagtgtagtgtgatgtcgaacgcgcgtgaaagtagagtagtaataaacttttttttttcaagatacgacgtttttatctcttattgccatgcattctgcattctacctgtgcttgtgagtaaaaatattatatcgcgtgtgtggctagatcaatagcgatcaaggcggatgaaaaatgatcgagaattgacggaagtgttaaaaattagaacggataactactaaagtgaaccggtattttttggtgctataaaaaaaacgtgaacttttaatgttatataaccaattttaccaaaaccatatgagccgaatagaaagtttgtgtaaacaatactgagcatttctcgcaaaagaaattactgatagttggataaaagggtatatagataataaaaaatcataaataggctgaacatgtatctctagaggtttctgctgtctactggacagatgatataaagagagaggagacgaagataatgaaaaaaaaagaggtttatagtgatttctctcatatatctataagtataacttagctaaatttataatttgctagactaattgatactgtgctaatgttataactttcttaaaagctgagataaactaatagatcagatacagaacttgttaaacgggattaaaagtcacgcaaaacataactacgtggctagtaataaatggaagttattgtcgctatctatcgagctaaatcctttaagacgaaataacactggtggagaaatcgtttttagtcccggttcgtaacctcattgagtatcaacggtaattgggcagtaggctttaaaggctagcagccttggcacacttaatatttagctgaacaattttagtacaagtattttaccaaaggccaactaagatatcagtgaatatcgctagctcactgccagtgactatctgcttgtaagtgtttcgtcatgcgaggaacatatatataaggacaaacaaaacaaaacaaaactgcataagatccagaggggtcggcgttttaatcgcagaacctatcgatgctgctcatgtaagccttatcctcagtattttctcttcatttgtccaggttaatcattgtttgacctttctgcatcatccatcacatttgtccaggtccagcccataaaaaagacaagccaatcacaagctactctcattttgcttgcaataattttccattaatacatggccattgatacggtcttttacccagacaatatccaaatgcatgttagtattaagatagaaggaaaaaaaaggtaaagaaaataatactagttcactcaaggttcattgctccggtcataattgcataaactagtaatagttcattcaaggcgattgaaagcaaggaacatgagaaaaaataaagagaatatatagtagaaaatgtgccgttaaaaaacaagaaacaaagggtcgtcgttttaatctccgaacccctcaaccttgcttctgcaagcgttatcgcagctattttctcttcagttccacttaatcgtgcttaattgttgtatgtcatttcgcatcataaggccatcaatgacaaaaccaataacacaagatcagaagtagggatacaactcacacatccctggtgactaaaccctaaggagaatgcatgcatgagccgactaaataattccgaggcccaacttcacatgcagtccaagaattgttctaaaagtgtttggtatgtgctttaatcggatgatcagatatctaattgaatgaatgtctgattcaggggaccgagtaggacgataaatatgcatgatcagatgacattgccgtctactggtcgagttgtatgttttatctttttgaaaggaatagttgtatgtttttatcaaaaagaaatgctaactgagtagtaagtaggctcaaagcataggcacactgaattagctgaatggttttaccaaaggccaacaaattaagatttcagtgaatattgctagttgtctgtcagctggttagcgcttgccagttgccaatgaagtgtttcgacacgcgacgaacatgaggaaaaaaaaaagagagagtaacacacagtgttaaaaagaaaagaatatccagattccagaggggttcggagttttaatctccgaaccccctcgatcatgcatctgtaaacgttatcctccggtattttcttttaagttgtccagtttaattgctgtacgtttgacatttctgcatcatccatctatccatcacaaatgatgtccatcggtccagctcatccatcaagacaagtcagataacacaatactaatctcagaagctatgactctcaatttgactgccaacagtaatggttgatatatacggtcataatcgaaactagtgtaatagttcatttattcaaggtgatctaattaaacaaaaaggaacaaacactagaaagaaaacgatagtagcagtagaataagaatgcaccattaaaaaggagaaacagaggggtcggtgtagtagttttagcctacgtaatcctacttcgttggttcaagctgatcgaagcaaataaattaacttaacttattaaggtccatccatgcagtagcatacagcgtcgcatgattattattattacgtgtggctgcaaaacggatataaataaacaagcaatcaaactaatttaatcaatcgatggattgcattgctatcatggatatgatgcatcaggctggcaggcgatccatccatcagagaattctggtggtggtggcaacgccgacggcggcggaggcggcggagtcccggcggcagtcgttgagcatgtcgaggtagggctggcatctgctgacgtggatcccttgctgggcgacgcattcctggaacgccttcttgtgggcgccgcacgcatccaacattggatgagccgcagcggcggccgccggcgccggagaagacgaagtggacgtggcgtcgacgacgttgacggtgcgagggccgaagacggcgtccatccccctctgcaccatcccgtaacccgtgccccatccccaccctgcattttcacttcatgattatgccgtccagtttgagagcggctcgattatttacttattaacatgaaaaattaatattatggaaaataaatttcgcaattaagtggtaggtgtacgaccaatacaataggtacaaaagtattttgataaatcatgcatatttctcagaagcacgaagcaaataatccagtgacaaaaatctgattaaaaaaactaaggtcaaatatctatactccatttagtatagtattttttttatttatcacctactcaatcatattttccattaactacctaataatgtactttaatgttataaaataatctctgcacatgtacgattctatcacatttcatcagtattatacaatataaatgaaattattctaaaaaaaattactattactttgtttaatcggtagcaaattaaagcacggtatttggctagtagattaatttgcatctatgcatggagagcaagtgtatatatagcagtatatagcattgtggagctagctagaaatttagggtctgttcactttgatgcattttcaaccttactaaattttgataaagttatcaaaaaaaatggctacatttaatttgctgccaaattttgataactatataagaaatcatgccaaaattttgacaaattactaaaattttggcaactatgctaaaataccaaaatttgataatgttttttttgcaacaaagtgaatagagccttagtaagcaaattgaataactaactgaccatcaaagaaagcagatccgatggatcctatgacggagtcattgctgccggaggaagtattcttggtggccggagctgtgcctgtgctcttcgccgccggcgtggtcgccggagcagcacggggtactgctttcgtgcccgtgctgctgccgcggaagcttgacctccctcctcctcctgcacgtacgcaccaattaattaattcaatttagttactggctagcttaattatactaataatttaattcacaaaagttaagctgttgctactacttattagcgatatattgacccagtgatcggtcggccggatctaccaaataatgcacgactgatcgatcgaagaacaaaattaaggtcgatcgaagaatctaacctccaccgcggccgccgcgacccatggatggcgtttgtcggatctcggtgacgaacaatcaactacgatcgtcggagaatctattagtaatttgtttacagtgcgcgggcagagcatagggctgcgagtatatatatagagagagagatatggagataacgaattaattaacgacgaagatacagtatattatatgattggtttctttcttttcggtgaaggaagggctgaatttcatcttcttatctccatcgatgagattagatgatcgacattgagaaacgaactccgctgatctcgcggttgcagtaaatgtacacctatctatactagtagtaccaggcagttgaaacacaacgtacatagtgggccgggccttggtcggctgcaggcccaccaaagctagcgcacatacgtccagcccatgacgaaccagtccaacacaaacacatcacaactcagtttgactctaaccctattaggcttagatcacgccggcgaccaactatcgacgcctccggcacgacagcaagggcaactgcaagagtgctttaccaaggtcaggtcagtgcatggttggcctgattccttatagctcttttaatcgtgctttagcgaaaaaaaaatcaactttattaacagacaaatctaaacaaatgcttatacaaactcgtcctacaatcgcttctaaaagttgttcttttattgaacgagaagttagtagtagtatcaattctgtcccttgatttttttatgtggaattaatactcatcatgcctgtatgaattgctttctaatttaaagttctaaaccctccgcctaaagaaaatgtattctagaaggggatgtgatccctcctaatacaataaaccgacgatagaagttatgagtatttcatagtactccactaagaagtgaagaataacacaccctagctagtgacaattagtatgtggtccgtccaatcattctttcacgcgtgtctcatgcctcgcttcacaattcagattgtgggtcccaaaatctgaactacagttactctgcctgcttactgtactaccctttttccagttaccaggctgtcaacacagcaaaggccatcgacatgtggaccactccaacaattttaactcgtgggagtaaaatggagtatgcatgccctctctctctctctctctctctctctctctgtgcaatattattactgtacatgtaccccatgtccccatctctcgtctctaccataactagcctcaagggtgtgtgctaccatggacttgtctcaggcaaagactcttttgtaccgtacaagcttaccatttctataaaagtaattttacagtacttgagaaggtatcaaaaatttaatgtaaaatttgttatcttatagtacctagatatcaataggtattaaatttagaatagaaaaaatgataccttctcaagaatcgtaaaattgttttttctctaatagaaatggagagcgttgtccctccattcctttgataaaaaaagaagaaaaaattcatgccattacagtgttctctcactactaccatccactagtgatgatcagtgcagtgctgtagtagcatgcagcatcagcagctgatagatgcatgtaaaagtatgcatgtgttgtgttttgctaccataccagtgtctggaagcatttgtcacttcaggccagccttttgaaaggctttattagcgctttactaaacacggtatgacatgtactgggtggctccaccataatgtcatggcaaaatggcaatgacaatgcacatttttcttttcctttttttttcttattagcttctatctgagcgatttcacattgctctggttctgaaagattggattttaacattgctctgattctgaaagattagatttcgcatgcttgatcttgatccttgagtacctagttacttgaaaagctactatactattaccatgctagtagcacattgacagggttcagatctcaaccattaatctgcatatattagggattaaagaagaaggatgatacgatgctcctcattattctagtcagtctgttgtgaaagctttcgaaagggatggagattttgatgaggcccgcctggctcacttctcaagtgccatggaagaatggaagcgtgcaaaactccactagttcttgccatcccagtagtatattttctttcatttcaccttcttcaattcctggagcattgtgcaagttttgcacccgtgcttgcttgactgtatatcttgtttgtttgcagctggtaactagtgccacatctaccaagaaccaagattggattgccatgcaagcctggaatatttggagctactcacccagctgttgtatgttactatactacacaactgatgatcctcaagttatttattaactaatttagtgctgtctgtgattttcttgttccaaaatagtgttgttaacttatcactttggcttgcatcagtacctagctagttgacagcattttttctgtggtttggtttaagtggatttgcagcagccagacagataaatgagaaaaaaaaagatgaacagaaggtatccacactatgtacagaccaccacagtgatttggttctgcccaaagaaccagctgggcacaaaagaagaagatgtgaagctgcacttgtccagctacactcctacacggttcatcatcatgtatctacaaaatttgttgcttgtcactgcaatcatgagtagtagcaaccattataggaggtactcactcagagttccaggtgctgctcgtagtagagctcactcatgcagggagacaggatctcctcctccagcatcttcaggacagcgctcatcgatggacgctggcctgggtctgcatcggtgcacatcgcagcaatgtcgaggatcgcctcgactgcttccacttccacatcaccgcagttctcatcaatgatctcctccagccgatgctcccccgtcagggtgttgagctgcagaagaaagttggcaattcagattacttttgtcacttgtaagattcataggagggagggaatatagagaggttcttcttacccagccaacaatgttcagtcccttcttgaggaagcatgcatctgtaggcctctttccggtcaccaactcgagcaaaagcactccaaagctatacacatcagatttttcagtagcatggccattttgcaggtattctgtccatataaagttaaaaatgaccaatgtcagtctggatggaaggtgctcaacacagatttaaacaggcagcattggtgttgtcttaaaaaagcatgatttgtctcgatttatctccagtagcttgactacaaagtagtacaaactactacgaatctggatttagtactaggtggtgtctaatcgaatattaggttactatattttaggacggagaaagtgcttaacagtcataagcttctactgttagtctgtactctgtcaatacaaaagggggagcagtaattatgcaggacagcatgatcttttgttttgattgaaagcatcacagtgtggaatagagaataagtacctggtgctaggtatccaaaagtacccgcgacaacagtggtaacgtgggcatcattatctacaagcagccttgcaaggccaaaatctgatacgcggggttccaagcttctgtccagaaggatgttactggctttgatgtccctgtgcacaatcacgggtgagcaatcgtggtgcaaatacgccagccctcgagcagagcccagggcaatcttcatacgtgcattccagttcaatggttgatcatcctgagcatctcctgaaatcagggacaaggcgtttttgagcatcaggtaatgtaagaagtttttgcacaattgaagcagttgtaaccatgatgatgaaacaatatgcagcaagatgcaagaaagacaataggcttaccatgaaggtagcaatccaaactgcccagctccaagaaatcatatatgagtagtttggctgtaggaagacggcagtatcctcgcagattgacaaggttaatgtgcctaatgctgcccagaatctcaagctccttctcgaaggtcctatcgcgcccttcacggttgagatcaatcctcttgacagcaaatgccgtgccatcatccatcaccatcttgtacacggtaccaaaaccgccacaaccgaccacatcctcttcatcaagcagctccaaccttctgatgatctcacctgatgagtacggaaggttccactggtatgtcacgagcttcgcacctaagtcagaacaccacagatagcaattagtttccattaagtgagggcctggacaggccggaacgagtgatagcagctgtgtcgactttattaccatctgggatagtttgcttgtccattttaacatagcttccaccaatgctcttcttcctggacagaagacatatccagaggaagcctagtaccgcgatcaatgcaagagccatggttgacattgagccaatcacaatgccattcaggaagtgcgatgttttgttgttgttgattggtgaaacgcctgtttgcgacagagagatgaaaccatcagttagtcacacacacattgcaccaaatttggtgagaagagcttcaacactgagaagatggcttagaaatggaagacttgccagctgaggagaggggatcagaatgcggcaacacggcaggaaacccgagggttccacggcaagccttctggatgggcagtccacaaagctccaaattcccaacgaacctgcaaatgccattgaattgtcatgtgaagaaatgcaccatggcattgaatacaggttgtgctcaagaagtagcagaaatgcacaaatttgttcatgtttgctacagttatgctcccacatcataaagagcaatgacacatcaaagaaagtagaaaggaagatgggcccaaatctaaaagcttacgagctgcttttgaaggttccaaggacaccaacatttgggatttctccagaaaagaaattggtggacagattcctgcaatgcaaataagcatatgttctttcagagatttgcaacagcatttactcgtctggttttagcaatgccgacaagatggcataaggaaatttatacagcaagaaacttacaggaaacgaaggtgagtaaggcttccaatggacgccggtattgtgcccctcaacaggttgctggacaagtccctgcagatggcacgcattagaccaagaataagcagtgaatcagatcagggtattttgctaagaacctacaagattgtgaggtgaatgagctcgccaatctctgaagggatgcctccttgtaggtagttggctctcaagtaactgcacacacacagagtaaattaaacctccgcatttcagctctacaaagtcattagcagacagatggagatggaaccaaacaagtactagatcgtagcagcatacatacatcgctctgagctcggtgcagttcttgatctcagaagggattgggccatgcaagctgttctggtgcaatgctctgaacaaaaggggttagaaattaaagaaagaccaatgcggatagtgtaaatgaagatggtgttgaaatgggaagtgttgcacaaaagtggtgaagaagaaaaaatgttacattctctgcagcttgtcgagcttcccaatgttaggtgaaatgatgcccccaagctgcatgtaagggagatttctggtagaaaaggaaaacatgaaagaagagattattcagggggcgaggaatccaatgagcacatgggtagccgagccatgaaacattttgcttgagacttgagagagagatgcaaaagggaaaagnanananananttgnaanangnatanagggctnnanattaatttctgggtgnncaaaantggagaaatgcaaggaaggaaagatagagataaattggagacggacatggattggaccctgaggtcggggaaggagcaggagatgccctcccagccgcaggggttagggtcggtgggcttccaggtcgtcagccgctggctgctgccattgaaggagagcttgagctccagcaatgcctgccctgcaaggagcagaaaaaacacaactaccccggtgagacagccagattggaggaagcgttctctcatccatccatccatccatccatggatgcgtagtgcagcgcagagagagagagggtaccgtccggggtgagggccatggaggtggagcagagcagtgaggcagccatggcggtgacgagggcagcgcacaggcccaccacctgccccggagtcccgtggcggccgccgctcgtcggctccatcttcttcatcttgttgcttgtgctgtccatggtggccttggcttggtctctctctctctctctctctctctctctctagagtgtagtgggagtgagagtgagggtgagggaggcttttgctggttggattttgaaaggtagcgagcgagccgaggactagtctgagctgctgtcatctgacatgtgggactccagcctgactcccgggcccacatgtcggcgagtaaggatgtgtggtggtagccgtagcaattttctactccaaaagccgccaaacacgacactggtcgcacgcgcaagctacactgaattttgctttcctttctttttctttcttcagcactcctcctgtatgtacagtacagacaaattgtaccgcctgtatatacatacaaatacacgtatgtaggtatgtaaagacagacttaaatacgtagatacagatactacaagccaggtaggtacgtaacgttggagatgtaaatatgtgagctacggtacgtaagcttgttggttgtgcgatggtatacgatgaggatcaggaggaaaggccggattgtcaaaaaatacagacagctagctgactgcaaatactgctgcattgccattgaagataattactacatgagcatcactagcatagtaacctgcctgtactaacaagatgagcaccatgtaagtatagtactccttgcatgcattaacttaactttggtgtgtgcaagatcgagggaacagcaagacagagacaacaaaatacaaaatgacaaaaataatgttagcaactggagtagccgttgataatggaatgacgatggcccaccaccaccaacacaatcccgttgagttgctacttcaatactactagtacgtgtaaacttgaaacagtagctgaagaacaaacaataacttgttgatcatttgatgaatgtttcaaaaccacagacacgcccataccaactccaattcgattcgatccacatacaccctttttaaaataaaataagttcaaacaagatcgatctgtcctgaaactcatctgagcccaacgttaaattttgcaacaacaagacaaacgcaggtgcagtgagagccgtactagatgcaccacgcatcgtcaggagtattaaattcttcgttactgctagtagaatccaatgttttgttggattaatcatcacaaggggtatacagtacgtattaccattagctactactcctcgttaccgtcctagcttgggccgttgcatgcagtgcagcagtggtgacctcctgcggtcatcttactcatctacactatcaaataagattttctttcagtttatgttagcgcatttttctaactgctaatgtgaaaactttttatataaaagttgctttaaaatatcaaataaatttatttatcttcattagtttcaaacaccttagtgtgtcgtgtactcgttaggtcgtgccggcgatcgacaccatccaattctccctctccccggtgaagagagacattgccttgcagttagtagttactttttgatactccctccgtttctaaatatttgacttcgttaattttttttaaacatgttttaccgtttgtcttattcaaaaaatttaagtaattatttttttcctatcatttgattcattgttaaatatacattttatgtatacgtatagttttacatatttcacataagtttttgaataagacgaatgatcaaacatgtataaaaaatcaacagtgtcggatatttagaaatagagagagtaatatgtttcacacggctcgaagacaattttatcgagggttggtgcgcgcgagatctggtcgactgaacggttaggcttaaatttcggtgagtctacttgcacctttgaattcaattttcagaacttgggctttaactttgagaccttgctataaaggtttgtggatgacaaaaactaaatgttgtttatgtaagtagcattttgtcaatcagggtgaaggtttagcaattatctgtctttaggctagtgtttcagttagttctctcgtttttcattaaattgtgctttgcaattaaaagttatgttgactgcaaaggttgtagcttatttgaagcaaagattggaacggaaattctcattatcttagagttacagctctcccaaacgtgttgttttgctcctgtcagtgttgccgacatgagtcccttcgttacggggcgattttgggctttcggtgggctcgtttcagccctaagaagaaatgatatgggccggcccatacattcataatacagatttacaattacattcattcatccctaatgtaattaatgtagtccaattccaaactggatcgtacaagtatcatctctcttctttctgtctctgttgtgttcatcatggagtggacacatgcatatgcatcaagtagtatatagtaagtatgaaaagtcagcgtacgtgtgtagtagctgtcagtgtcgtcagaccgccatggccggcggcgcgtcggcgttgtgcttggagctggtctgaagaagctcaacgccgccgtggtcggcgatgttcttggacctgtaccagagcgcgcagaccacgaagtaagccaggttggcggccgacatggcgcccaccacaaggtagaagaggtcgacgcggcccttatcgatgtcctgcgccagccaccccgtcgcccgctccaccgccgtcaccatcgccccgctcgcgtagctcgccaccgccagcgccagcggcgacagcgcccccgccacgctcctcatgctctccggcgactccttgtagcacagctcgttcagcccgatcgccgcgaacgcctccgacagccccgccatcgcctgctgcggcaccatccacgcccacgacgacgacgaccctcctcccgccccgcgccgcctctgctccaccgccaccgccaccgccatcgtcgccaccgacagcgccagcccgatcccgatgcgctgcagctggctgatcccctcctcacgccccgtcacccgccgcagcgccggcaccaccgcgcggtcgtacaccggcagccacgccgtgagcgccaccatgttgaacaccaccatcgaccccgccggcacctcgaaccccgacctccccacccgccggtccgactgcatcacctggaacaccgtgtacgtgcccagctgcgtcagcatcacgtagtacacgatcgacgacgaccacaccgggatcatccgcgcaagcaccttcacctcctccacctgctgcaccgtgcacagccgccacgggttcgccgccgccgcgctcatgccgtccaccaccgcgtcctccgccgtcaccaccgcggccttgtccagccaccggaactggtccgtgtgcttgatcttggccaccagcttgctccggtgcggcggatcgaacaggtcgtcggcaggagacgccggggcagggaggcgcctcttgcgggcggcggcgacgagcacctgggcgaagctggtgaaggggctgccctcggggcggacgcggacgta

SEQ ID NO: 41421 - DNA, 750 bp, Oryza sativa
  unsure (1)..(750): unsure at all n locations
tacagtacttcatgacgaagtccgctcgggagagccagagaggatcactgcggtgacctcccaaccagcgtggggctgcgcgtcgtcaccctcctgatccggaagcggncctgggcctggtagtccactccatgtgnggataccccaggggccacgcacatgccccgcagctccaagacgaagccagtcatgtccaaaccacgacgggtgacgctgccggccatctacaaacaaaaacaaaaagaaaacaacattttaaaggtcagattttggcgataaatgaagcagcaagacagagagagactagacagtttttacaaataacaaaggatttttatttttgaaaatattgctaaggcttgggatctacggctcgtcctagggtcaagggtagctctgatgccacttgtcacgaccggaaataacccaacgggcgtccctgacgtgcgtgcattaatccttgtcccaggaggcaaggtacaccaaaacttgatacaattcagagtttaacaagcggaagcgtaaatagttaacttattacatgggcagcgaaggcccagcacacacaaagacaaacgggaaacagcggaagactagggcgacgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatg

SEQ ID NO: 41422 - DNA, 1132 bp, Oryza sativa
  unsure (1)..(1132): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctcgagtatctgtaggaatacgatgagcaatgtgccaaccttgagaatctggggagttatcgggtttggcccacgggaagagaaggctgccatcacaggcgctggctttacgccaagcctggcatccgatgcagtgatgtaaccgaccgggttgctacatgaaccagagcagtaacgttaattagtatagtatataaccatgctgtgatgtgttgcacctgaaaagtagtactatgtgctgatgagcgatgcttactctgttgacccgaggtagttaaagaggttgatgcactgggagtaggagacgtgagccgccgcgatgaggtgcgggtccgcgatgacatcctccccgttgccggcgtagttgcagagcaccatgccaacgccgccggcctgcttcaccaccagccccttctcaactctggcgttcacccctctggtgcagacaactatcttgccgcgcaccttgtcgctgtccagggagccagggaagcacaacgtcctgcacgcacgcagcagtgcaagcaaatcgacgtcggttcgattcgatcggtgcaagtcgagatgatatctgagttcttgatttcttacgagttctcgctcggtacgttcgcggcgttggcgttcttcgcgttgatcatcgcgtaccgttgcacctgaggcagagtgctgcttgacagactttgcctctgcaaattgcccaaatcccaatggcatgagcaaaagtacgccgtattctcatgt

SEQ ID NO: 41423 - DNA, 10210 bp, Oryza sativa
tggtcggtcgtattgtcaaaccttgatggtcatgctgctcgtgacgccgccgaaggtgacataagccgggaagtccctgtccatggtgctcgcgccgaccgtaagtatccatggtgccacgttggtgaccgagcccggctgcgggccggagttgctggcggagcagacgacgatgacgcccttctggacggcgtagaacgcgccgatggcgatcgggtccgacaggtagtcgtccgccggcccgccgacggagagcgagagcacgttcacgccgtcttccaccgccgtgaccatggccgcgaggatgtccgagctggagcagccctcggcgtagcacgccttgtaggcggcgacccgcgccagcggcgagccgcccttggccgtgcccttcccatggccgaacacgctggcgtccggcacgaacccgccgccggcggtggacagcgtgtgcgtgccgtgcccgatgtagtcccgtggcgtgtacagctctgcagcctggcttggcggcttcccctgcagcaagcccgacgctaggaagccgaggttgaagaaccccgcgccgatcagcttgctgcatgtacgacatgttagtttctcgccagaaaatttactgcattagttgcatgcagcttgatgagcagctgtggacagtggagttacttgttgcatttgaaggtcgtgtcgttgccagtgatgcacttgccgcgccacctcgacgggactgaatagccgtcgtctttgaagctcgcggattccggccatacaccttcatttgtagggagtacgtgcacgcacagaaaataagaatcaggagttcaggaatcagaacaggttccggctatggctaactgcacagcacttcagtacagcagataggacgacagcacatctgaaccaggccaccagggatcccgtaatccaacagaggcacaggcgcactgcgcccatggcgacgctaccattttgcgaggtttgaattgactttttagttcccgtattcttgggatttgattctgttaacctcatgtcatcttggggtgattattttaagttatctcgcgcatgtatctcatcgggaagcatgtaccgatgcacggaataactgattcgctccgatcgttctgtgttcattatttggggctgtgtttctcaatttcacttcctcatattctagggcacccgcaatggttatctatagactctctacaagagatccatgtcagcatatttttctacttggaacagattaaatgaagagagagagagtaaatctatctactaaactggagatagtttatagagaaaaacgaggcaatggatgagagagctacagatacccatgtagacatactattgaggtggtttactatcaatctagtctattgctgagatgtacatttttatagagagcaccttactttactattgtgggtgctcttagtgcgttttttttaaaaaaaaatccattgaaaaattaatttaaaaaattcgattttcattagtttttggttgctagcggttgtaccagtcgctcgtgaaatccattttgatcgtctcgaatatcatttttcaagtagtggtacctgtgtcgacgttgccgatgatagcgtccaccccgtacttcgcggcgtccttccacgcaccggtcgccgcgccatttcgctctagctcgaggaaatcccaggaacgcgtcgtgtggaccttgtgcaggacgtcggggatcacggccagcacgccgggcagctctgagtccaaagtacgcgaaaaaaagaacgcgctcgtcagtgacaggtatgaactgcaaactccaaggggggaacacactataacatgatgatatatgtggcgtacgcttgatgactcctacgaaactctcatcgatctgcaccacgatcacttggatggggctcaagacgtacagtaactgaaagctgtttatttttacggcacaaaatgaacacattagtgatgtaggagtacatagctagtagcctagtacggtagcaccgacatccataacggccacactagtattttctgacctggtgacgactgtagcaagcaaaccagaaggagaagctggtaagccatcaaagacgatcacataagtctgcatgcacgaaagtaccccgcttcatggattagagatcgtcaatagaacatttaatcgcagtcctatatttgttgacttgcttgtattgtacgtgacgaatatacgatggaaaaacatttttgcagttttaaggaatatataccctgttttctgtcatatatcatcgaaatagttataaaaattaaataaatttaacaacacaaattaatatgtgatatatcactctttgtaactctaaattagaaataaataaataaatacgacggtaagtagtacacgttacagtttagtttgattttctcattgaatttagttgttgatttataattgatcaaatttaaatcacatatgaatatgttatatatgttgccatttttttttgtaaaactatttgagtggcaagaagtaaaagagcatccccttaaaaatataatctccatgtatgattaaaaaatccattaaatacatttttttaaaaaaatatttttcataaatattcgaatgacatacaagagaaacgagaggacatgcaattaaagaacaaaatgactttggcggatatatttttaaaaaatattgagggcatgtatgatgaatagatcgagagggtaagagagagaagtgaagaaagagcattgcctttgtgcctgcggacgccggcgcctgcagcgcgaggaagagcaccaaggcgaggagaaaaactcgggaccgtcccctcattctgatgattggttgatctgcttcgtgtctactctgttcacataatcccgcaatttatagacgccaaggtcaaccttctgatcagtatgtccgtagtgaggagcacgagctcacgtgttggataacctggcatctactcctaagtcaccagtactgcttaattaccagacagcagataatggatccgtccacatgcgcgcgcagcatgcaaaacagctagtgctcaggattagagcaaaggcattagagcagtccaaaccctctttctcacacctagcttacataccgttaaatatacagtcacctatgtcggatggaagttcgtcacattcgttgggagattagacttttattttcttcctcctccccctcctgtatcttgtccccttcgtgtttttgatttttcggcccgctctgtaaatacttttattccttcttaatataaagatgcgtctctcgcgtatttaaaaaaaaaacagtcacataagtaaaaagaggcgataaaatagttaatgagaagagatgaaaaaaaagatgaagaaatcatttcttacgaagaaaccagctctgtgtagcaaccaataataaaattgagagagaataaaagtgattggatgggattttattttgagctctatagataatccctgtttatagttggacgtggccagctatcatacctgaacttttgtaaaaaaacagaaccctaagaacatagctggcttacgggctttatatttgccggaaattgactcaagtttatttaaatcagcagatcgaatatggagatctaccctaccaatatattatttgccctcctgattggagtgggcaatagttgtttagaaaatcatagaagcatgaattcaaatggtccaacttgtcaagattctccccctaaaagaacttgtcaggattcaagtcttgattatttcctccaacatattgcatttgtgtcccttacaagaacggcacaagatatgcacaaaatactagcaatgccatgttacttgacaagggcacattcttaacgaaactacatgaaatcccgcacaatattacgggagcttggtatgataatagtagaaatagcgtataagataactaaataatataagtttatataatcatcatatttgatcgatcattgaaaaaaagctataaaccattaaattgatgttgtttatgataacttaaacaatatcaatcaatccttctcaagccggcagttttgcctattgttgattggtccacgtggcacaacaatgtttgagaaataattggaaattaataagtgtaaaaaattgctaggctctgtaaaacaaaataaatcaagagaagtatctagagatatgcagtgtgctgtgggttagaataaattttctttcaatgatgccgcatactccatgtccttctcgattttcatcgagaacgacctagtgagcatgacaacgttgactgtgaagtctcggatgacaacgagtactcatttgagttgaagtcggggggctactgtcatggttacggataaggcatatctcatatcctatgacttatggaatatgtggatacggcatgttttcgtatgtatgatatgtttccgtatacgataaggtaattatcaagagattatggaaattaccctcgcgggcaagtgtaacgctccgcatttcgtgaggcgttaaaaactatttcggcaaaatcctatatgcgaaaatttcattctttgagtgctgagtctaagtcgtgccgtggatctcgatataaatctccttgatccctctcgtcgaattcaaaaatcgcctcatcaaaatcccccacctcaagtttccaattccgattcgagtctccgaaatcaaattcctaaagtcaatcccctcctttgaatcctctccaaataattgttcccaaaagtatcaaactcccgctttgtttccttcctcatctccttgaacccttgtgcacaagtatcaaatttagattcaaatccaagctgcaattctctccaattcaaattctaagcagaagtctattttgactccctcttggtcgttgggccgattcttcctcccttggcccatctcctccctcagcctcgcacgtgcattgcacgcgccgagctgagccgagccgagagagagagagctctcgccctctcgttctttctctctctccctctctgtttctctctctctctctcgtcgagctcctccaccggcgtcaaatcccccgctctccgccattcaattttcggtcggccgccgtttcccccgcgcgcgcgcgccctggtggcaaccgtcgcccggtcgccgcccgtgcccgcgctgccgcccagtcgccgccgcgtcagccctgccacgcctacgccgtgcagccgccgaaccccgctcgcttttttgcagtcatcgccgctgtcatcgcccagtcccgacgcccccatgccgcatgcttccaaaacgcggagccagagctcgcgctctctccctcctcctttctcccaaaatggcatgggcagagctccctttctctccccttttcttctttttccctgaccagcgccattgtcacctccactgtcgcccccaccttgacccaaccgagctccccttgactgcccgtgctcggttccttcccctcgaagctccacaccccacgcctataaaaccacagccaagccgctcgcctgctctctctctctgttcttgccaccctcgccgccttgctgccgctgtccttgcctccctccgccgccgtgtgtgctggtgaagccggcgtgcgcgcgaggagctaacgcggactccgggcaccctcatcttcctcttccccggcccgaggccgtagcgatcatgccccgcgccgtcggccgctcgtcacagcgcccgtctcggctcggtagtgcctccctccgttctcccttctcgcttgccctctccctcttttagctcgcgtggtagctcggtagccctcctgaacgcgcgtagacgaagccccgccgccgcccggcatggcctcgccaccattgccacccgttccggggagccgccgctcgtcggcctccctcgaggcccctccgtcccatccgaccccgagaatgagttccccgaacaacggagatgctcccgacgccttgaatcgaaccctcgccgccccgccagtttttccccttttgcacgccgccagccgccgccgtcgcaatccaccgcccttgacctctcccggcgcgatccgagccattggctcgtcctctcttgtgccgctcgccaatccggtgtgctcccccttgaccatagtcgtcttgtcgagctccggtgaactcggccgccgtccgccgtccatctcggccttccccttcttcctcctcccgctggcccgcgtggctgccacgaaggcgccacgtcggcgccatctcggctgcgaccggttcaaggctgaccctggtccaacgctcccctgcacccccgctcgcgcgcgcgcggtccaccgcgagccatgaggctgctcgtgggcccgccgcatccgcgtccaccgcaaaccgcacgtgcgctgcgactccccctcccaaaccctagcgcgctccgcgtgcgccccgctcacggtgagccgagccgctaacaagcgggtcccactcgggaccacgcgaggtgagcccggtccatcggttccctctctcctcgcctcccgcgcgccctaatgggccgtgtctccttaggctggccggcccgttatctcggccttagggtctccggctgggtgatccaggttagtaatgtcgtgtgggtaaagtgtacctcctctgcagaggttaactaactgttcgaacagccgtgcccacggtcatgggcggatgtgaggtgtttcctgtagcgtagatttgtttgcctgtgctttgtgaaaagttgttgtggtttgggaatcgttaccagaatcagcctatgtggcagatggatgacctgagtggtcaagaaacgaatctgtgtgattcgggatgtctacgggcatcatagactaggcttcctgagtggaagcggattgttgtgctgctgggcagctggactctgggagtccgagaaaatgaaaaggctttgggagccgattaatcaagtgaaatggctctgggagccgagaagtaatgatctgaaccgggaggtcggtacattaccaaatgagctgttgaaaaacatctcttaaagtcgaatcgagacacaaatctctttttggcccaaacttagaaagaaataaatcacttagtgatttcaaaatgatttccaaaacaaaagatttgcaaaacaaccttgcctctcttccaagcttgcatcagacacctaaattcccgtgacttgctgagtgcgaaagtactcacccttgctctatataaatatagttcctctgccttgaagtcaagatgaagtgaagtgaagattaaggtttcgtcctggttcccagccgtcgcctgtggtgttaggtgttagttcattggttccgctgctgctgctgctgttgatgtttcctcgtccgcgtcgtcggttgtattctcaggctgtcctgagctgcaacctaagttaaggtaaataagttctctattaaatttaaggattgcaatgattcatatttgtcaccgtgggtaccagtgctaagtcctgggactggtactgtgatcgcagtttcgtaggaagcagttcgcgccgtttttcctatgacacgctcctatcaggtgccgttgtccggcggtgccagattggggtgtgacagcaagtgaatagcagagtcctacttggagagaatcgggtttatactatatcatgcggggtccgtagtctccgagttctacttgaagactaaggtgattcacggtgtaaaaggcataccccctgaggggtttagatgaccgaatcatagcgccagcaccaccaccatagcctacaatccggaggacgtgaagcctactcgccatgagatctcgttgaaaccatctcgacaagggtctcgccaacgacaagggtctcgccaacgacaagggtctcgccgataatcccaggattattggtcttctattgtaatatgtggttttttcatatctatctcatatatataaactggattagggctattaccttacgagggcccgaaccagtataatccttgtcttttcgtttgcttgatgttgtatcgtgtagatcctcgtaccaacataccctaatactctatttatccggtttatgggtatccccgtcgacaaaaggatacagatacccttgaagtgaaggatctagatagatcctgatgtgtgtgaagttaaaaatcgagataaacagggtttcaacttttagtatcttccctgctcacaacacacatagacattaagataaatctagggatcattggtgtgctgaaaaacaaaacaattatcttctcattagcaatcaaataaatttgcattccttgaacctctcgatcaaatataaatccattgttaagaaaaactctataagaaatcaaacattgtggaaaaaaagtctcacttgcctttcggctacgacaccatcgtcgccttgatggtgatggtaaacccctgtcaagctcacgttgacgccctcgctacttccatataccaatgagacaaaatgccaatggttgatagctgagagcacagcaacgctaaccttgtgctggacagcgagctattgttgcgcaatggcaaatctaaggagttgtggagtttaagaggacacacaacttgggttcaattgaatttattgaaaaattaggttgaattgagttagtaaatcataactcgagttttttttttgtaagaacaagtaacagagctagtcaaacatactccctctctcccagtttgatcatcgcctaagtttttgaggttttctcaaaatgatgatcatctaacaaagtgtctctttatttatttgtacaaagagtaaatgcacatcgtggaatgccctgcatgcatgcatgcaactatacacattcggtcaaccaatattaatttctattggttcaacccatgcaacatttaaagcgtgaattaatttatgttggacacgaggggatatagcacattcatcgatgcggattaattttagaatgatgaatgcgttgatgttattggttttggtaccatttgcttaggagatgatcaaaatgagatggagggagtattttctttatacaatcatcgttcgtttgacactgattgaaacaaattaaaggattttacagaaattggattaaggctagcaaaatatcttcaatattttttttgaaaaggatcttagcatggattatactagcaaggcgtgccgattttctagtatatattaataattgaccaaaagcaaaagtaaggtggtgtgacttcatgagagaagaaaatgagagataacttaaagcatagagtagtcatccaagggatagaaacaattaaagtgtcgtggcttaatgagagaagagataaacaattaattaagtggggatgcaatatactggatatcgtagaaatataatgaattgatatatatattgaaatgctatgtagatgatgtgtaatgatgatttaacatgctaatattttaaatctctaaaatacaacaaattataaataacgtagtatgcctgtattctttagtgcggagtggagactaatcccatgcatggaaaacatagcaaacttaaaaaaaatagattaatatattttttaagcaatttctgtatttttttttaaaaaaaacataactgtgcgtgcggaaacgagatactggaggttgggaaccttaggaaacaaacacaacttgaagatacaataattgccagtgaatgatgatgtgacatctttacatgttaagttttagaatgtggtgggttgtaactaaaagtgcacctaacccccctcctatgtgggttttggtgattaatgacaaaatgattaagggacttatgattttactgagtaaatgcaggtgtattagtcccaggttgcttacgaggtggctaggatgcttggagcccccaaatcatcaaattcaaagtggtgaaaagaattggagccgagttaggctagtttaatttttcactttgagtttaggaaaaaccttactattaagaggggtttcaagtgtggttctgagatactctaagtgcccttagctatatccaacagttgaaatatttttaggagctatttttggaaatagcctcctcaagatagcaaagcatgtctggaagctttaggcccccatgtccggaacttccgggccgaggagaaatgaagaaaatttcctaaatgatgaccgaaagttcctggcaccaaggaccggaacttccgggcaacattccggttcaaaaatgtgagtaacagctagt

SEQ ID NO: 41424 - DNA, 6559 bp, Oryza sativa
tgccatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccacgatctgaccggtctgtgaccggtcacacactgtgacctgtcacggaccgaacgagtgtgctgcgctgcattaaatgcgacatggggcgctcgtccaacccgcaataaacgcggttaggtgagcgccgctgtgctcacctaacccacacacgtggcgccaaacccacagggggccggggcgccccagccctcggggccgaaacgggagcggcccgacccctcggggagacagagggaggggcggccacatcaccctcgggcccgacccccccccgagggggtcaggccacgtgggtgactgcagctgccccaaacctctagtcaagatacccccggtcccatgtcaccgacagtagcccccggcgttacgctagggcgatcgcccccccgagggaagcgctcgggcgtgacgccactccttagacctggtgacaggtggggccggtctccacaggcggcagaaacccagcggtcgcaaatcgcgcacatcgtcaaggaaaaaaccgaccgacaataatgagcggcttccttcaagaccgctacattacttaagtagcgcgcgaaccgggacgagctggttcgtttcgcctggagatgtgatgacggtgcatcggtcggcgagcgtagttaacgcgcgcacgatatgtcccatctcgactgccatggccgcacatccgcctcgtgcgccgcaaacgggcgagcgggattagtggaggcgtgggcgcgagagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttagcaatggcagggctggtcccgccattctcttctttcttcatggatgttctggagctttatgatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaactgctacattccctgcgtccttcgcaagaagtgggacgactggaagagcgactggttctacacccctctcgccgacgaagcgcgcctccgacttccgagccagcccccagcgcaggcctccagctggcgggcgccggtagatctgggagatggctacgacgccgttcttgactgcctggcgggtctgcgatcccaggggctcacgggggccatggtgttcggtgactaccttcatcgccggatcgcgccactccagcggcgcgcccggggcgcctgggagtacaccgggtctaaggactacatgaggacccaccaggggggcagatgggactgggcccctgaggacttcaagatggtggtccaacgggtgctgaatctcagctccgtggaggcatccctcatcccccaaggtgtcctccccctctgcagcgatccagagcgcgccaacatcctgaccatcatgcaggcggtcggggcgtcaggggagtgggctcctcgaggccacgatggcacgggcgggagccgcaggggggaacaatctaccccgggagggggtcatgcttctgggccccgtgacgggggcccggggggcagccgccctgccgacgcccgggggaagaggaaacaggaggataccccctctccatctcctccccgagggggcggggcggtgcgtgccagcagcaggcgcccggagggtgctgtgccgacgtcgcagcccgagagggagcgaaaaaagaaccggctccgcaagatgggggggaccgacccatgccggggaaacctcatctcccccccaaggtggtcgtttacccgacctcctcgcaggttcgtccccgcgcccactgcggccgtattcattctcccaaggcgagttttcacttacccgtttccttttgtcttctggtttttcttccgctttcagcgagattccgtcgcgcccccctcgccattccaagtccggccggtctgaggccaaggagacagcgaccgcggaggcccggaggcgggaagctatccggcgagaagccgcggaccgcctccgggaagctgaggaggctgcccaggaagccgtccgggtttgccaggctgaggaggccgctcgggaggaggccagactccaccgggccgggaagtcagcccgggaggcagaggcgacgtgcgcacgccaggcggcctgccaagcccccgacccgactccgcccgaggcgacgacgacttccgaggccacccacgacgaggccgcgggcgcaccgctcggacccgacccttcgggcgatgttcgggacgagccagcctcgggggacgcccctgagtccggcacgtcgattggcgggccgagccgcacagcgcccacaccgaggcggctctcccctctgccttccgccgccccattgaacacagagcccctcctgcaggccctggccgccgcgaacacgacggtgctggacgggttaggtgcccagatggaggtcctgcaagcagagcgggcggagctcgacgcggcgtgggcgcgcgtcgaagaggggcggcgctcggtggaggccatggtggaggcgggccgcaaggcataccgccggcacgcctcagagctcgaggcccgtcggagggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaatggcgggcgacggagaacgaggcggcgtcccggcggcgcgaagtggcccttgaggctcgcgccacggcgctggaagagcgcgcccgcgcgagggagagggacctggcggaccgcgagaccgccgtcgctatccgggaggcaacgctggcggcgcacgaggccgcctgcgccgaagaggagtccgcactccgcctccacgaggatgcgctcaccgagcgggagcgagctctcgaggaggccgaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggtggggcggccgcgggcgacagcgatctagccgcccgcctcgtagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccaggggggcctcgcccagcgcctctcagagatggccgggactctccagcggctccccgaggagctcgaggagacgatcaagtcatcctcgagagacctcgcccggggagtagtggagcttgtactggcaagctaccaggccagggacccggacttctccccgtgggcagcgctggacgagttccctcccggaaccgaggacgacgcgcgcgcgcgcaggtccgggacgccgccgaccacatcgtccacagcttcgagggtacggcccctcagctcgcgttcgccctcgactccgacgaggagggcggcgacggtggtgtggacgacagcgaccacgaggccggtgacccgggagcctcgaagtgagcccccaggcccccgccaatcttaaatagtttttcctttcttcttccgaggccttcgggcctccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcctcaaacggcgcgggtcggggctagtgcctggggagatgcacatgtcgagactggctaggccgggagcgcggtgaccgagggttatggggacccgattgtgggcctttgccgattcccccccggagttcaccacgccccggggcacggctcggttctgggccccctttggcgatttccgccggcccgggccaccgagggcagggtcgagcacgagcgtgctaattcaagccaaaactcttcaaaaggaaacaatggcacagacacaatccttagaaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatattctatgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtgacgctgatggtagcgccgcaggctctgctggtagcgcgcggctcgaagggccgcgcgccgccttcgttcttccaagaagtcgaggtcatctctgcgatgctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccatgcttcttgaggatgttgaaggtcttggttttgaggcccttgaggatttctgcgttggcgcgctccacttggccattgcttctagggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgaaagcgacatacagatactcgaacccgcccggggcccgtctaaacggacccaggatatcgagcccccagacagcaaacggccatgaaagaggtatggtctgcagggcctgggccggctgatgggtttgcttggcatggaactggcacgccctgcaccgccagaccaggtcgatcgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgcccccctcgggtcccgaggcctggactccgacgggcctcgggggccgttcaggctcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacaaccaactgagagtcacctcacaccaggaggcggcggatccccagtccagccgccactctgagt

SEQ ID NO: 41425 - DNA, 7143 bp, Oryza sativa
cgccaggggccgcatctatagggcgcttttcgtccgagaggccgcgcggggcgcactcggcttctgtgtcgacgacctcggggtcggaaggcgacaggcgcggccttcccgcagtggccccggggccatcctgggggtcgggggcgcctggcaccgtcggacaagcgggcagagggccagctccggtcgtcgggggcctcgggccgccgttcggctcgggggcctctcctccctgctctctcccgggtcgagtcgacacagggtggggatgcgcggagcgagggtcgtcctcgtcgcgctccatgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccggagcgtttgaggagcttaaataggggtagcgccttctctcccagcctcgatatgaaccgacttagggcggccatacagccagtgacgcattgcacatccctaagcttgctgggggggcgcatccgctctatagctcgtatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatccgagtaaggtctcctggttgcgtgttttcacaaccaagtcatcaacataggcctcaacattacgtcctatttggctacccaaagaaattcgagtagtacgttgaaaagtaggacctgcattctttaacccaaaatgcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatttatgcgtggcagggggtaagggtccttaggacatgccttgttaaggtcggtgtagtcgatgcacatccgaagcttgccgttcgccttgggaacgacgaccgggttcgccagccacttcggatggatgacctctcggatgaatccggcctccagaagtcgcgccacctcctcgcggatgaaggcttgacgttccggggcctgccgccgcactttctgccggaccggccttgcgcccggccgtacggtgagacggtgctcaatcacctccctggggaccccgggcatgtccgctggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcgccacccgcgggcttggatgccacggcgaggtggtccgcgcgctgctccatgcaagcaagcgcgactttgaggtcgccatggacggtgatggggccaccggggcccggcatcttcatctggagatatgcgtagtggaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgattggctgggacgaccggagcaccatccccggggccttgatggcgtcaaaggcagcgggggaaaggatgttgagggctgcacccccgtcaacgaggacacgccccaacttcacattgcaaacggtgggggaaaccaccatcgcgatctgtcctccccgggcaacgcacggtgggtggtcggtctggtcgaaggtgagggcaacctccgaccaccgcgcccgccgcgtcgcctcatgggtaggggccacggccagaagctctcgcttcatggccttgaggctccggcgagaagcgtgagcacacgctcccccatcaacggtggcgacagtggcctcaggctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccgcgaggtcgtggagggaggtgttgtgcacggtgcaccacttgctggtcgggcgctccctgctgggagcgccggcctccttctttttgtcgctcgcaggcctcccctttcgggtggcccgcaaagcgccctcgacggcgaggacgtgaccctcgtcgtcggaatgggccgacctcttcttcctcctcctgtcccgtcgccctgaccgagcggcggatccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtggcgcacgccccccctgaacgcgtagatcaccgcgtgtgcagggatgcacggtatggtgttgcggacttgacaaaaccgctgaatgtatgagcgaagagactcatcgtcccctcgctgtaccgcgtgcaagtccgcttcttcacctgggcgcggatatgtgccctggaagttcatagtgaactgctggcacaaatcctcccaagagtggaccgacgcgggtggcaagttcattagccaaccccgcgcctgtcctttcagggccatggggaagaaattcgccatgaccctgtcgtcacccccggtggcctcgatcccagtcgtgtagatctggagaaactcggaggggttgatgcttccgtcgtatttttcggtgatggtgggccggaaccttgggggccaacggacgttccgaaggctcgccacaaaggctcgacagccggcaccgccaactggggacacagggggctggcccccgtgcccggaccgaagtggcgctccggacgaggaagcgccctccgatgcgtgggcagcacggcgatcattgcaccggcgctcgatattgaagcgggcatctggccccctacgcacatcttcttgggttggaggcgttgacgagggaatggcggacgaacggcgggtagcggccgccgctcgccgcgccctccgcctcgacgacacggagccagcagtagcaacgccagtggccttggtggcggaggaccaccagccggcgcctaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcttcaccgctagcgctcggagagagattgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcaggcccccctttgccggttcggccgggggcgctaagtgaggttcttcgccctcgatctatctggagaatgttcgcgagagagcaagtgcacgagacacgggcgatgtagacaggttcgggccgctgagaagcgtaataccctagtcctgtgttctggtggatctgtgtgtgaaggatttacagagagccggagagccagagagttcaggctccagaacccctctcactccccctccctcctctctttttggtgggcaaggtcctccttttatatctcaaggggatactacatgcaccacttctacctacttttcttctgggtggggacctaccctatcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccaccggaggcagatgcatcgcgggagcacagttgtctgccaatgacgtgaccagcgtcagaccagtcatagaccggtcattcttgtccaccacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccacgatctgaccggtctgtgaccggtcacacactgtgacctgtcacggaccgaacgagtgtgctgcgctgcattaaatgcgacatggggcgctcgtccaacccgcaataaacgcggttaggtgagcgccgctgtgctcacctaacccacacacgtggcgccaaacccacagggggccggggcgccccagccctcggggccgaaacgggagcggcccgacccctcggggagacagagggaggggcggccacatcaccctcgggcccgacccccccccgagggggtcaggccacgtgggtgactgcagctgccccaaacctctagtcaagatacccccggtcccatgtcaccgacacttggagattcatctcatagacggttaggtgtcgcccgcgagtttccgtcaagattgtggattgacccgggcaagtttgtgaatgtattcctcacctccgcaaggaaacaaggtaagtgagtaaagaaattgtgccgagtttttagaggtagtcctagtagagcaaacctcacttgtggttgtctctagaaggttgagttggatcttggtggtcactcaacttctagagaaggatctaggggtgttggattgaaggctgtggacctcttctaggatctttgcacaagagaggcaagggtttaattgagacccagctttttgaagctcctcaaaggagagtaggatccgtgcatccgaactttgggaaaaaaatcctctttatctcttccgtgaatgctttgtgcttgcccctatgttttatatactgctatagtctactgtgaaccatattgacctaataggacctgttgttctctctcttttgaagtattttctcagtatttccagtacccggaagttcctgttcttgaactccggaagttccgagctgcctatagctaccaggaagttccggtgttcatcactaggaagttcgcgggtcctgtttaaatttgatcgttacgatttttttagtgattttcaggttagcctattcacccccctctgtaacatcctgaaaatccctaacaataaaaatcactaaaatttcaaactttttaaaacttttgcatcatgctggttgttatgattgctatggcttgccaaaccgtaaatgatcacaaagaaagaaaagaaaagatcgatatttaagcaatagatataatttacgagaatatatttaatcctacaaataattatgcaaaagatagtaaagtcaaatattaatttctattacaaattacaaatcaggtattaaatattcgaaccatgattgatagcttgatgtcacaattagctaaagaaatagtaagattaaatccaattcatttgaatccaatctcacatgaaatataagaacacatgaaatgatgatcaccactatagtgatcgtgtttataaataagtaattcaccggaatatatagatcgatacttgcaacatgtcgccgagttactcatgacatgaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaaaatatatataagaataaaatatgggtaatattaaaatttggtaaactttcatctaaaattaaaacatatattgggtaaacctcatttatgtaaaaattaggatttatagaatgaaatttatacaagggataaactaaaatcgggttaaatagaaaatggcactgttcattgcactctaggtgctcgacgtggtccctggctctattttccccctcctcagccgcacgcgcctggctgcctcgcgccccgcgccacgccgcccgccgtcgcgtcgccgctgccgcgccgtcgccgtcggccgtcccgtcgccgctcgtccgtctcatcgtcgcctcgcgccccgcgcccacgcgccgctggtccgtcgctccgccgcctcgcgccccgcgccgcgtcgtcatcgcatcgccgtcgccgtcacgccgagccccgtgccgcgccgcgccgagctccgcgccgcgccgtcgcgtcgccgctgtcgccgcctgctgccgcgcgccgttgccatcgccgcctgacgccgcatgaccgtcccatcgccgcgccgcgcgcccgttccgtcgccgcaccgccgtcccgtcgccgtgtcgcgtgcctgccgtctcgcgccccgcgcccccggccggccgagtgccg

SEQ ID NO: 41426 - DNA, 27124 bp, Oryza sativa
  unsure (1)..(27124): unsure at all n locations
ccaccgcgccgccgccctcagtaccgccgcgccgcgccgtgtgccgcgccgtgcgtacgccgccgccgccgccaccgtcgccgccgccgccgtcggtaagccttccgccccctcccttcgttgccggtagccgcgacgcgccgctcggccgtgagagagagaggagaagacagagaaagggagagggagaaaagagaagagagggtagagtgggccccacctgtcatttgctcctataaattcctttaggaagaaaaataaaagaaaagaaaaagaaaataggaagaccccacctgtcagtcactatagcttgtggataaggttgtattataaataaatgaattaggaacagtgcctttttacaatttctcggatttattcaaatttgaatctttacactagcataacttattcattttagctccgatttgagtgaaacttgaacctaaattcatctaaattcataagctttccaatgatatataattcactatttgataaaatatatttataaatattaaataattaatatcaagatgatgcataatagtcaacttaaaaatatgttaataaataaaattagtattgtacggtagagtagatgtaataatatttgtctctaacatgtcttgccactgtaacaaccacacaaactaattttatgtgatgtctcaaatgaatggatgtattggaaaatactagtacttatttaatattcgatggccatataattaaatccatggcttataggttatttaaatcaagtgtagccttatgattatgtaactaaaatataaacacacatagatgaatctgtttaggagaataataatagagctaaatgtggaggaatcactaagtaaattaatcgatgcaataccatatagaatagcatatatatgcctaaattgattaccacttattagtaacccaatagaaccagtgcttaaacttgtcgcatcacatatacaatatcactcatagaaactagctaatgtataattaaactacaatatattcaggaatcacttggagcattgggtagtacactttctaaataagctcatgtacagtaggcgaccaaaacattatacgttgttgcacacatatattggacatcccattatagttatacaattaatttatctttttcatatattaaactggggagtatataacaaacatgcatagtagataagtactaattataaatcttgacctcatatgttcatagttcaattgtaactccggattgttcattaagagataatctgtaactataatattataaacctcccgaatttaacatatagagcatggataattattagcccttttataatttataatggcaagtaaaatatgttcataattaaagtaaagcttccatcaataaaataataatacaaatgattcactgtaattatttgattgatcctaaatccatctaacaacagaacctctgatatgtaaccgtgctatttagatatatgcatacgtagccataatccttccatagctatttgatagactaaaccaccgattagccaaatatatatgtatcccataaatgctatgttggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaggcaagtcatcactattccttgaacatgttgatcccaattgcgaaattatttttatttacaaataagattgcatgcaatgatgaacatcctatttgtgaatatgccataccttgattattgtttaaccttattcccttgtaaccatgattacgtatgagtctctagtcaactatgacaaatgcttagagatgccactctagaatcatgtatactcatatttgtcaaatgctatatgcttgggcaattacctttgggaaggtaattgaaatgcggcatgtggagacatgagcgccacattgccatgatattgatgacatgatttgtgaaaggaaaataaagtgaaacaactgttttcgactggggcggctggaggatttgggtggtgtccggaaaaggctagtgccgtccctggtcaattaaggaccgagccatgaagttaagtatgaaacgaccccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactgccatgtgagaatctaaacataattataacttaatgcatgtgtgagtcttcccttccaaggtgcgccagaactcctcttactgctagaaaccgtatacgcctagagtgcatgaggatgtaaaagttcatggagcgggtactgccaatgcgaggttatcgaaaagctttgccgtgacacatctcatgtgttgggacgaggctcatgtattgggcagttgcggagtgcgggtaaagtgtacatccactgcagtgtgagtaaaccaatctattcgaatagccgtgctcacggttattgagcaccgggacatgtattacacttcgctagactctaaattcttaacttgtgtgggatgggatattgcatgatgaattttatgctgatggagccacttcctgagaggagggaaggtggacgtcctcagaaaaccatgacgactcaatggcgggaagctatccttgggattacaatggatggtggacagaaccatcgttgtttaatgtgaacactggtattaaaacttgatcagtctatgctaggtcttaggcttgtgaaaagatttgtaaaacttgctttgcgcaaaggaacctgaagccattccttgaaataccctctatcatatgcatcgttgctgtggtggcttgctgagtatggttggtactcacccttgctgtttatatatcttttaggagagtgttgaagagaagcccttgtcggtacgcttgcgtatccaacaagatgatcggagtgcggtcttgttctaggtctcgttccccagtcgactgcctgtggcatgttaaccgggcccttatattattttgtcttccgctgatgttctctgatagttgttggcctacctggccctaatgtaagtatttaactcttttagcctgaattcattcgtgatatgttgtgatccaactatgtatgtgtgtaccaactactgatccagagattggtacggataaacacagaagatttccgatttccaaaatcgggggtctacaccctctaagctacatcttcacctttcagtaactatatagatagtatatatccatttgttttaatgtcctcaatgctccttccatccatccatcccagtttgaccatcctctaagcaaagcgtaccaagaccaaggacaccaacatatccatcattcttaaattaatgctaaggtgttccatcgcttcgtatcccgtgaactgctcttattttaaatattatgatattgcactaatagaaattaatcaattttagttacatgcaacacatgcaatgatgtacatttactcatttcataaataaacgaaaagacactagttaaatgatgatcattttaggaagatcttagaaaccttaggggatgatcaaattgagatggagagagtacttttcactgaaaatatcttgatactagaatataagtaaattttgtttgttgaactcaaacaccacaaacttgtcacaattacatgtgatgatctacatgccatcttttttttttggtggttgggcgatcgattgcaccacgtatatataaaatcaattattttttagcacctagggtgaaaaatgaactttgagccaaattcaaggaccgaaataaactttaccatgccattataactttgtaaagtttgagatatgttatcggtatctcaatgacatgtaagacccacatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatataaatataagtaatgctagatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatatgaatataagtaatgctagaaactcttacatcatgaaacggaggaagtatattcttcgtatagtatgaaatatcttccgcctttccacatcacgcttacgctttctatccaaagaaaaaatatcctgatggagcgatctctccattacagtcaaacggacagaaatggccactccatccggtcatccgtattccccaaaacacccttaaaaagcgtccgctgctgccataaatatctaaggnnnnnnnnnnnnnnnnnnnnnnncaaccgcatccgccataaaagccgtcgggtttagcgataagggttttaacatttggctaaaaaattttcgagccaaaaactttaccaaaatcctccgaaattcctgcgtctttcagctcggatcaggcattcaggcccttctccccgccaggatcggggtaagctagttcatccctcaatctctagaacgtccaactcttcaatttggtggtttctgccaattcgctgtggtctcatttcgctaattggacctctcgttcggtgaaaatcgcatcgattcctttctccaagttgagttctgatgtttctgttgcctttgagttcgtttatgacggtttggtttatggtaaaaattcaaggatggagatcatcaacgggccggttctcccgcgctatgctgctccggcgaccggcgccctgacctccgacgcgaagatcagcgggcagctgcttaggcgcgtgcacctgaggagacgagcctgtgggttgcagggagaccactaccgggcggcgcgcaggttcttcggtttcccgtccgagcggcatgcgcgaagcggctgggtctggcctgtttgttgcagttacggctcgtcttccgacggggacggcgccgctgccgcggattacgacgccagcggcgaggagttcgtcaactccagcgtgatggaggctggtaattgcttacttctgttacactgtaacttgtaacttcattgggttttgatgcatagtcgttcgagcaatgtccgggtccggcccactgtttgttgggagttgggaagttcgctgtgagcctttgaaacagttgctgttgtttgatcagctacataccgtttatgccaagctactgttgcagtattagttacatatcactagtatatcatttatgccgattgccaaacaaccattgtacatttctgagattaaacttgtggttttatctgtccttgcagttgagctcagaagtgtatctgatggatttgtgattaaaatgcgtgatggcaaaaaccttagatgtgtccaaaacaacccgcgggtattaagattgcgggattctgcacctcaccatgctattgttctgaagatggaagatggaagtgatcttttgcttccaattatcgtcagtacgtattaattcttgcttgggcatgctttccacttatgcagatgcttttctaattgtgtgatatactcacattacttttttccagtggaaacaccaagtattatgttgctggctgcccttcggaacattcgaattgtaagagttggatgtagctttaataaatatatgttagatgttaagcatccacatgattctggttttaaattgttttcatgtactatatctgatttgcatgactattctgtctttccagccaaggccaactatttataatgtggtaaaggagatgaccgaaaggatgggatatgcggtgagtttaagatgagatcttataagcagactttcttttgcaactttcgtgtggcttcatggtttaggttttctgtttagtgtttcatgggtgtgcttatgtgtgttactattttagttttattacttaatgtatgctggttatcatgcactcggacaatacatacatcttttctaaagtgtcctagtggaaagctgttttccagagttcacggtctgcagatctgttctcttaaatgtcatataatatgttcatttatcagttacttgattacttcagatctgttccctttaggtacgtttggtgcggattacagaaatggtccatgatgcatactattctcgattgtatcttgctaaggtaaaatgacttcacatgaactactccctccatactcgtaaaggaagtcgttttggacagcaacacggtctccaaaacacaactttgacttcttgtttctataaaaatatttattgaaaagtgatatatgtatacttttatgaaagtatttttcaagacaaatctattcatataatttttacattttcaaactcaacaacttgagagttattcatgatttatattcctaaggtttgacttaaacattgttctaaacgattttctttacgagtacggagggagtatctattttacttttgtctgaagtatggtgtcatgatatccagattggcaatgaagaggagactattagcttagatctcaagccatcagatgccatcaacattgctttccggtgtaaggtgtgcattcatctcctgtgcagctgtgcttctgattaattgctgagtgctggccatatttcctttaaggctgctaatcccagaatattggaagtgctgtgacttagttgcatgttggggattataacatgcatctatctgtttgagcgctagccacaaaactgtaaaaccagcaaacaggattcccttgtcctgtcagaaaagtgatctattttttggtgctgttgcttaaccttgttatttgtggatgatatgatttgcatgcaatacttctagaggtactcctttttatttccttttaaatcatttgaggaaattttcgtaaccaatgatttgagtacagcagtcaaagaatgtggaaaaatcctgatcttcttggtgttttgctgctaaatggatgtttatgatactcattccaatttattctaactttacataggttcctatacaagtgaataggcgtatagcgtataacaatggattgaaagttgtacaaccaacaccatctgagagctatgtaagctcagaccaattccaatacacaagacttgacaggtttgtaacaaaagtagcttcataggtttcagtaaagaaaggtttattttaaagcactgctaatgcatcccgtaccatttgaaggcctgacgatcaaccttgctttgaggcccaagagtttgatttggtccgcaatatgctggtcgctgctgttgaggaacgctacaaagatgctggtaagctcttgttggcttaaaatgcatatagtaaaatagtcatacattgtgacagtgttgcattgcattattttgcctcctctggaacagataaattttatagtttttcttttgtggaaattgcaactaattcgtacaaaattcctgcgttcaaaatgggccctaaatgggaagtctttgtttttttttatccgcctcccgactcacaaatatatgcagcagaatgttcatggcggctaatatctggtatcatctgtttcagctcaatacagagatcagcttttcatgttccgggcaaagaaaaagaacatgatttaacaggtaacagtcgcccatgccattcttgaaatcttcatatagtcaatttctttgtcaactttcacgtacactagctcgatcaaactgacaggatgacaattcacttttcttgatcagttcctgaagggaggtgtacatactagtcccgcctgaagtgcataaagccaaacatcaagaagaactttgtaaatacttacagaagaacctatacatagatacatatacatactagaacatgattttgggtgctttcaattcgtggtggcgttggtagtaaaattgactcaaaaggtgcccatgtttgtcactcacgattgattttagcaaaacgttaagcaaattgctttacacgaatcctcgtgcttctgatttgaatttgtatgcctatttagtttgcggtgaatacctgttttgctccgaactaagtttcggcccgaaccaacaactgtactctcaagttccagcccggcccaaaagcctcgaaccgtcacgtccagaataaatttcggtgaaccttgtccatactccatagacgtgaaaccccaccagcgaatctcaaaaaaagggaaaaaaaaatcaccagcgccgtccactgctgcgagcctgcgagcgtgtcccgatcaggccaatcagaacctccaaggagaaatcaacggctcataagcatcggcatctgcagatcaaacggagctggttcaccatagtgggctctagccgctctacaccggctcgatctcctcatattacgggcgtaccgtgcgcccatgcgcgacgcgtggcacgcgctcgccaggtcgacggaccagagccgatgtgagccgcccacgtggcacgcctacgtgcaggctgatgcagcgtcgcggttgttgcgagcctatggacccggtccacgagaggatacgtgtaacaccccctcccctcttgccctgtccccttcctccaccgatgaaaagaaaacagaagcttctcttcccctctcccccaaaacaaaagcatcaaaatattcctcctaaatcaaaagaaaaacaatcaatttcaaacgagccatctctctccattctcgtgcccctcctgtctccgcgcattcctccgccggaaaccctggttcatcggcgagcggcgaggctcggggactcgattaccctgcgaggaatcgaggtcggaccgcgggtggggaaggcgaagatggcggggtccatcgatcggccctgtgagtgcgaactgtttcccttcttccttcgactgcgtgttccctgatgattcgttgtttctccatgccgccatgcgttgcccgttctcgtttatgcaatgcttacctgcttgtcattcgcgaacaccggaaaattgcggttgcagagagattgattctgtgagggggttcattggggcaagtggagaacatggcaaatcactcggaaatagacaaatagttcatgttcgagtgggattgaaattttaatagtagtagtttagcacctgtagagattataatcacacctccctaatttttttaacgtgcgtgtaattgcgctgctttcagttaattgcaactcctatgtactctgctctcgtattgattattttcaatgtagttgttaccatttcaacctgattaggaggaggggcatttcgttgaaactatatagcaggtgcaggttttgaaggcattgtgcatgatgatgataagaaagagtggaaatccgatgaggacaactcagaaggtgacaaaaaggccaaggcagtctccttcaagaaccgagctatcagtgctggaaataaatttaggcgttccttgagaaggaagagaagaaggagggtcggcgaccatgtagcctctatagaggacataagggatgtcaaggagctggaagctgtccaaagatttcaccagtgcttacatgatgagggcttgttgccagaacgtcatgatgattatcacgtgatgttgaggtgcaatttttttctgatctcagagtcacagttacttggatttctccttannnnnnnnnnnnnnnnnnnnnnncttatttgatttaaaatttcttcatgtgcctatgacatgttacacatgtaggttcctgaaagcgcgaaaatttgatattgataaagcaaaacatatgtggtcggaaatgcttagatggaggaaggagttcggggctgacaacatagaggtaaagcagagactggaccatatgctccagtacgtaggtagtgatagtctttcttcatgtaacttctggaagtttgacatctggatcatttaggaatttgactatagcgaattagatgatgttctggagtgctatccacaattttaccatggtgtggataaagagggaaggcctgtctacatagaactaattggaaaagttgatcccaacaaattagtacaagtcacaactattgacagatatgtaaagtatcatgtcaaggagtccgagaagtgcttgcagatgaggtttccagcttgctccattgctgcaaaaaggcacatagattcgtgcagtactatcttggatgtgcaaggagtggtatgttattttatagccaatcttgctatcgccaaaatttctgggtagattagtagttaacttgttttttatgtgaagggtttgaagaacttctcaaaagatgcaagagagctaatcatgcgacttcagaagatcaacaatgacaactatccagaggtaggtgattccattatgttttaatgttatttttcactattgccctttcacttcgttttttgtcactatatacatttctatagaacttgtttttatctggggtcataacaaaggacttatctaatacctttctagtgctcgtgcagaccttgcaccgattgtacattataaatgctggccaaggcttcaagatgttatggggtacaataaaatcatttcttgatccacaaactgcttcgaagattcatgtaagtattgaaaattgttattcagaataatatttacttctagtatgtgataatagccttatctgtcttttttcacctaggtccttggaagcaaataccaaaataagctacttgaaactattgatgagaggttaggtcttttctactgtcacaaatactgtagtttggttcctatcctaataattttgtttaattcatgttttcagtgaacttccagattttctgggtggcaaatgcaggtgtgaagaacatggaggttgcataaaatcagataaaggtccttggaaggatcctgacataataaaggtcttccactcttcctgaaccctacccttcttcttattcatcctgtacacctttttttttttgaaaagaaatcctgtacactaaaataatgtgtctatgattttcagagggtccttaatggtgaagcaaactatggacggaaaattcttgctatatcaagcgttgatgggaagaaaatatgttatattaaccctagacacttaactgtaagcatgctttgaatggagattactcatacatcatcttaaaataacaactatccgttagaagcttgattctatcccctcgcagaaaaaatgcagcgatgcctctgctgagtctagttctgaaatggaagatgtttcatctcctatagcttcagttaaccccatcataaaccctcatttgacacccgttgacgaggcaagatcttgtaccttttggttttttcaactgcacgaggctgatattaatgattagtactcgttctattggtcttttcaactgcacaaggctgagctcagattactgattagtactcgctctaaacaatgatgtggcattcttaattttcttcctccttaatcaatctttatgttggtaaatatgatcataaatgcatctttttatatttctgcagtccaaattgccgggaaatacttccacatctggtgcccctcccagagtagaggacatccctgttgttgacaaggctgtggacacatgcgccggtccatcaaccagctcaatggcttttaattcaggtctttatatgacaccttcatacttgtacctcttattgagaagttgtctacttgctgatttcaaacattcgtacccccatatgcaactagggaaatgtgagatactgggaattttgttggccgtttggtttgaggaatcaaactatctagaatgggtgatccatcatgggaccatctctcaaatctagtggaatgactccatttctcagtttctcatttagtatgtactttttagagatgatggacaaatccattccattcctcaaaccaagcgacctgtataagatcaagtggtcatctcattcctcaaaccaaacatgccattacattatagtatgtagtgagtggtgaccggtaagcccaccaagagtttattggagtgattttgactgagtttgttgcatgttttacacagattcgttctcgttgagaaacataacgatggaactgggaggacttcgaaatcgaattactgcgtggttgatagtcttaatcgtgagctttgttgccgtgcttcgttctgtcccaagcagagtgactgcaagtctatcaagccaggccatttcccgtggtaactatagtgctgagttccctcaagaaattgagtttttggaagagttttgacctccatcttctcccggattcacagaaaacagtacacattcgtctgtattgagacgtcttggtgaattggaggagaaattacaggagcttgaagcaaagcaatctcaaatgccaccggatagagaggaattgctcaatggagccattcaccgtgttgatgcattggaagccgagctaatatctacaaagaaggtactgttgagtcttgacatatcatatgcactctgtgggtgtgcatgtgtgacaaggaagatgtactctcgttagatagcttattgcttagtggtatcaaggatataactactgttctgaggtaatgtttctatatgttatactattacacccaagaattggcagttcaccgaatttcttgattgttcgctatagtaagaactaagaactgaacaaaaaattgcgattttccatattgacctttgtttctcccatgagcagatgctttatgatgcattgatgaggctggacgaactgcttgcatacgccgaccagcaaaagaatattcaatttcgggtaagttgtggatttttcctatgaattactctttccttttgagaaatgcttgttcttgatgccaactactctttagttatggatgtgagtgagttcacccagaagtacctattgacccgctagtttatataaaaatgaatttattctttgttgctaagtgtgtgtttttttaagttaaactagattgagtcaaagggaacttcatgatttggttcgcacacatccctgttctatcgtactccctctgtttttaaatatatgacgccattaatgtttaacatacgttaaccattcgttttattaaaaaaagtgtaaatataaaaaatataagttatgcttgaagtatctttaataaaaaaataaatcataacaaaataaataatacttgcatagttttcttaataagatgaatggtcaaccatatatctaaaagtcaacaacatcatatagtattaggaaaaaaaatgtaaagaatatctcataacactgagctagccaattcatatgtgttcatccattatatgcagaaaaagaggttctgcttctaagtaccagagtggcttgcttgcttttctcctcgaaggtttcgtgttcttctgtcaactgaatacttgtaagttggactctttgtccaattttaaaactgtgaatattttgttcagccgtgtatctctgaatattaaagaaagaaagaaaggtgggtggtcactttgccacctatttgacttaataggcttaggtgtatttctaaattttgcaaggtgcggcgtgtagttcagagaaataaagggtgtaacatgtagaattgatatcttgttttcatgatcgattgagatgttatgatatattagtcaaacgttcataaacaaaatgtaaaaactagtagcctggagaagtatcccaagtaggtctttcagtgcaaaactatattggaggggcttcttctctgtctccactggatagcgtcggtgagcgaagacactagggactggaaattgtcagatctgaatcgatggggattcggccgattttagggacatagtgacgaatgaaatatggatgagagttgtgtatcaagatcaagacggtgcggttttttggcgcagcagggtacgtgaagcgggcggttttttagcgcgacagggttcgtgaggcagctaaagatcgaagcttagtcttctcgtcttttctttgctatattctgttgcttcttagttttggggcctgaatttttttatccatgtaacttttggctgtggatatagatgccgaatttctattcatctacttaaaagaaaaactatcctctcagtgtcaaaatatactcactccttcctaaattgatcatatcatatactctctccgttccaaattgatctacgtatagttttttttaggttatttctaaataatctacatatttatattcattcattaagtctatttgttatttgtgcattggagtaaatgaacattgatgcatgcatccatgcacacaagtatttataacccacatgtaatatcttgatttactattggctagaaaatagtggggatggtgtatgcatcgagtttgttgctagagtaaatatagtatgagagagttattaacttttcttggtcttggtgtacctatgaaatatgtagatcaatttggaatggaggggatatgtttatgcaccaaaaccaagaataatttaaatcacatcaattaagataccatgcacacattttcacacaatgcatgtatcgtttaaaacactatgccaaatactacaccttagtatgcacacattttctcatgctacattaattgtattttgatgaaatacgtgtccatgcggttatatgattatcaatttgaaaaattttgaattctattatatgatgatcaatttgaaaaggatggagtagctactaagcatatgtttggttgaagggttggtatagatcagattgggttgaacctatttttcatggtgtttggtttaagaacaaatggaatgggatggttactgataggggatattcctaagatctgggttgacatattccataaaaaactaacggacaaaatcaacccaactttttctctcgctagcatatgggtcttctcttaaaaagtagaatcatcttatttctcatgtcaaatggatagataccatcccatatgagtccaacctatctcacctcattcccaaacaaaacatatggtatggaagcacttggagggactataagaaaaccaacacatggtagggaaatacttggaaggactaataaaaactactacctccgtttcataatgtaagtctttctagcattgctcacattcatatggatgttaatgaatctagatatatgtatgtatagatttattaaatctatataaatatgagcaatggtagaaagtcttacattatgaaacggagggagtactgtgcaatgtaaaaataaccctcattataatctagggctaggcggttgtgtaatatattacctttatcttaaaatataacaactcattataactcattataggattggatataacataatactacgaaaagtagattgatagcggtaggatgggaaagtaggtgaaaaaaatcaactttttataatcctatgtagttatatttgaaataaatttaaaatttaaagataactatatttttgtagcgagggacatatacacaagcgcttaacataagtgtgaaagcacatggtaccgaccagtgcaatactaatccactttcaactatgatcaatcggaaaccagtgcaatactaatcccctgaggggctgtttggatcagggctaaaattttagtactttatcggatgtttaacactaattagaaatattaaatatagactaataacaaaaacccattttgtaaccctggactaattcgcgagacaaatctattgagactaattaataatacatgattagcctatatgatgctatagtaaacatgtgctaattatggattaattaggtttaaaaaatttgtctcgtgaattagctcttatttatgcaattagttttattattagtctacgcttaatacttctaattaatatcaaacatccgatgtgataggatttttagtcctttatcacatcggatatttgaacactaattagaagtattaaacgtagactattgacaaaacctattctataactctggactaattcgcgagacgaatctattgagcctaattaacccatgattagtctatgtgatgctacagtaaacattatctaattatggattaattaggcttaaaaaatttatctcatgaattagctctcatttatataattagttttataaatagtctatgtttaatactctaaattagttttcaaaaatttaatgtgacatgtactaaagtaactttagtactcgaatccaaacaccaccacggaatgggaatttctgatgcatattcttctcgtgatacctcggcatgtacgcggtcttttttcttggcacgcagttttgatgtttggggacatcatcatgcgcttatggcgtcagaccaaccaatcaagcagacgtgcaacgtgcaagagccacacgaccatctgcccatctagttgaagtgggtgattagacttgattgatcgactcgtacgtatagcttgtaggatctgaccgctagaatctcccattcttcacccaaattgttgcaccaacgtactgctgcttccacattcgacgcttccaaatcgagcttgctgtgcccttttcccgtcatggtttttgtttcgtcatggaacatcacgatcgtcagcaacaagtggactagggcaccgaatgggttccggtgaggaatgctacatgtacgaccaaatttacatgcatacaagtaacacgtggataattgaaggatattaggcagccatatctttcggtcgaagtatgaaaaatataccgcaaatgttacaaaagttacttgttatatcacgtctaattttttcaaggattttcaattctttatgttgactagaaaatagtgcccgtgcattgtaacgggaaaaatataagcttacgttaaaggttgcatgaatttgaaaaaatatatttttgtgattatgctaaggaccatgttggaaatttatacaccttatttacatttgtgtcattaaacataatgtcatgaaaactcaactttgtttagaaaaataattctgcaccgtaaaaaatatttaactaaatttagccttaaattttatttcgattttcagtaatttttaatgactcaaagagtgctaaaactaatttaataaataaaaaaccaatttaacatggctgggaaatgaagaaaacggctcgtaattgaaaatatgtgccgtgaaaacgagccagcttgtttacacacatgagcgtggcccatctctctcattcacatgctacgagcactcccagtggcaggtgatagcccgagtcggcatcggtgcgctgagagccatcagatccatttgatcagtcataatagctagtgactttagacaaattatcccccagtctaacctctaaaccgtcctctgactcctttggaccgagcaagagaggtgttggtgatttggcagagtgactgttcgtgtcatccgcgataattccatcagtggcgattggccatgtctagcgtggtgtcattatcctttcacttccctcctccgcgctctaatccccaaaaattatcattttttctcctgtctcagtgagcatggactgcatggtagtgaaggaagagactaatggtaagtgctatggtagatatgaccattaccttcaaatttatctattttatttactcatgaactgctccctccgttttacaatgtaagtcattttaacattttttacatttatattgatgctaatgaatctagacatatatatatctatctagattcattagcatcaatatgaatgtgagaaatgttagaatgacttacattgtgaaacgaagaaagtaagagacaatccatacaatatatcatctctagtacacaaataccaatatctctaatgctctcacacttttcttgaaatttatgtggaggttgcctcttgatttaggggtggctcatcgtctttcttcacttttcttctctacctaatcactcaatctaatgtggtagaatgctggcctggaatacggatagaaggtggattaggaggtcaaaagatgtggcagaggagactgcaggtgtatggatttgttactcattagggcagtcccaacccatagtgtctataagcagtgtctatggtgccatatcaataagacatcacaatagaaaccacactccacaacccatgatttcttaaagtgggccattaataaatacatcatctctcttttctatcaatcatattaattcttcatctattatgaagacactactcttttccaatgcaaaacttgatagtgtttagtgcataggttcttgtgttgaagctgggtcttacatgagacccagtttcttcctctcttcactctctctcttaattaatatagtgccacataaactaaaagttctacatggtaatatagttaatgccatagaaactattttaggtggagggttgggactgtacttagtaaataaatctttgctttgattgcgtttcttccccatttttttctcctctcatcagccttttagtttccaaacggggaccgtggtgggtctagtcctcgtgggctcgatcaacaaagcagaatccatggaaatagcccacagtcctggtttggaaccagaatctgatcctattttgtactctctctatcgtatttttaagtgcagctatgagcttctatatttaacgtttgatcattcgtcttatttaaaatttttcataattagtagttttttattagtgacttatttttttaattttttatattttttaaataagatggacggtcaaacattaagcagagaaaccaacagctacacttaaaatatgacggtgggagtatctgtttcgtattggctgtcgacaagggtgttggctacacacaaaagaattatgtgaggatggaacgtgatgcggatagagtcggagtgacgaacgacgactaacaaaaacctaaacggaagccttacgtatttttttataagtatataggtatatataaatttggtgtcttaaaagataagacggttgtcggtgatatgtgcccggggttaccgggagtaccgaacttacaagggaggagtcgcccttggcatccacgtggcactcaccccgaggggtcgcgcctgtgaacgagtggaagccgtccgtacctaacctgaggggtcggccccgaaccctcgggctggtcaccacatggccaccatgcaaagacgattcgtggacgccccctccacgcccacctaatcgcatttagtgcgggcgaagcgggcagaacgagcgtgcctcgccacattaaatgtggcctgccgctcgcttgaccgaatcttgaccgacggacgggacggtggcaaagccacgtgcggtccgctcgggtctcaggcggagtgcagtaggtatgccctgtcccatcaagatgacgggaggcgcagcgcccaggacagagttcccggtgcgtacaaacctcaagtctacaaacattaaatgaagaatgacatggatcctcctccatgtcggcttgtgttagccggcatgatttgatggggcccgctcgacaaccgatgctcagaatttttatgcggtagcacaagacacacattcaacatagaggatatttacccttttgctccctccgtactcgtaaaggaagtcatttaggacaatgtttaagtcaaaccttgataatataaatcatgaataactctcaagttgttgagtttgaaaatgtaaaaattatatgaatagatttgtcttgaaaaatactttcataaaagtatacatatatcacttttcaataaatatttttatagaaaaaaaaatcaaagttgtgttttgaagaccatgtcgctgtccaaaatgacttcctttacgagtacggagggaatatgtgtttctattgaaagatatgcctttcgacctaataatcatcctcggtaattgactatattgtttttaatcgtgatatacatatacacatactcacatagtattgtttttttataaccattcctgttttcgtttgcttaggctggccttttgtggtcaaacaacaaagtttcaacggctattattggtgcatcttgcaaatttcttgccaacttgggaattaacgtgacatactaaggaaaaagagatacatactaaaaaccatccatttatagtgcccttggctgtagccacttacttctgttcgacgacaatgcagtgaagagactgcgaagacccaagctggaatgcgacactgcatattcacaacactgaggactgaatcagggatgccccccctagattcagattctggcgacggacaatggcaccgaagctgatctatgtcttgttttaggatttagtggagtgacgttgtaaattcggtggttgtattgatggtccaacttaactgaacaaagggtcacaaaacaactgaaatcttatattccgattcttttcaagtggcaaacgcctataaccctgtagaagagcccgtaggatgcaaagctatacctgtagagtttcatgacgtcaggaataacataaaaaatgaatttaggaatgtattgctcccaatttacaaaatatgcaaaattcggtgtagcttcaatgatgaattggtatccacataagggtgaatgtacttggacaaactattgcatttttttttgtcaattagagcaatagcaggctataagctggctacaaatatattttaaagagataaatgaagagaaagaagagcagtgggctacagatctgtagtcagctgcagcacggactccaaaaacgtaatgtgtgtatgacaggtgggaccagttattaatagtatagtaagcaactattgtataaattagttattatattggctatagctaatttgtagctagtagtggactgtactattaaacttgttcttacttccccgggcctacttcctaaaaaaaaacaacaacaatccgaacagtctaaaaaaactctcttcactttcctttccccacttcactttaaaaaactaattaatttattggtttctctatgtttctatggttatttgagaagctagctaaacataaacaaaaatctcctcatcatttataatttaatactagttctgtttttaatgtatgatgtctttttttctcaaacttcaacaaataacatttattcacttagctaatgaaagtgaaaacaatactattatatccctggtatgtttatatatttgcataaatatatttatagaaaagccgaatatatagtcagatgatcgagtttgtgtttgtgttggggcgtgggtaggtaattgggttttatctcgtagatactcttgtgaaacaattagtttgaacgcgacatagagttatatgcgtgcacgttaagtgaaacgaccctttcccgtgcacaggagtctggaggtgtatatgctgtagtggatgtgttgtattggtaaggctaagttcgtttaagtgtttaggctaaaattttcgacggcaggtgaaacgatacaagcctcagcacatgataaattaagtaattattgtaatcttataaaataatttatttgtttttcaagaaacttttttatagaaattttttacacgaaacatactatttcaaagtttaagaagtgctaacagagaacaagaaactagttgttccaaaaggctgtttagggtgcgttctatatagctgttaggattagctagttagctgcatgaaaagcgatgtactcctaagtcattagcatataatcctttagttttttaatagatgacgccattaactttttctcacatatttaaccattcgtcttattcaaaaattttatacaaatatataagatataaatcacacttaaaatactataagtgataaaacaactcataacaaaataaattataattaagtaaattttttgaataagacgaatgatcaaacatgtgaaaaaaagtcaacggcgtcatctattaaaaaacggaggtagtaataattaattaattattatctattgtatactttaaaaattgatttatttgattttttagagaaacttttttatataccgttttagcataaaatatatagtttagcagtttgagaaacatgctaatgttcaatgagagattagctcagctcaaactcagtttagaacgcggcctaagtcatatgcatctcttttgtgccttagaaaataagcctctctagagagtgacactttattctcagaatttcccctaccttaccttattccttgcaacagcatgtattcgtccgttacatcagagaactgtaaaagacgatggaccgaatgccctatataagctacatacatattatactgtgcacgagcataaagtcttaatattctctgcgattgtgagccaacagaatgaatgtgtggaaactacaaaaaccagggccctcgcctcatcgatgactaaccagattcacgcaactctatcagagcggctagcctgaagggtcgctatgctagtgtcaaaaagaagcttggagtagagcagcttagctacttgctgctactgcatttccatactataattcattcgtttcaaaatataaatatgtttagaatttatttttttatcacaatacaagtgttcttctctgatttcaatgcacaaaaaattatagctaatcaggtgtttggaaaggggttatttaagcaaactaaaattcaaaatttgaccactgagataactaaatagaaacaacctggaaatacctatattttagaacagagtaagcatgaatgacgcttttcaaatggcaatcatgttataacactgatcagtacagtactaggcatatatagtgcgcatgcaatggctacctagctaacgaagaagcttttcacctggtgaacactacaaacaaccacaccggcccaattgaccctgagccctaccatgcgccactacaggggaaaggcctcaatgagaatccaaaaagaaccaccacctcttctatcaccagcaccagcatatgcttcgcgtacagttcctaccatttcagtatctgctttttcgtgccaacttggtactaatatattacctgcaccgaaccgattcctattagtcggccgggttgtttacaatgacgcctaccaatttgcattcacacgctatcatcttcatgcgagtttagaagaaaaaaatcggcactaataacgacaattcgacaaaacaaataatgccgacagtttgaatgtagatatttgctctcggaaagggtaatattatcatttttaagaaggtacagaaatgttataaaacttggtactttcagataccaaaatttctaatataaaatttaggtacttcctcaacaaccataaaatttctaaagaaaaaggctggactatcaaagggcttgcttttccccgcaaaaaaaaaggggcttgctttcagtcttgacaatcttgttctcagaatcgcagagcacataacataacgaggtgctgtgattttttgagttaactggccaatgaaagtttatgtcaacaaaatcttcaatgtttcttctctattgcaagcaagtgcgatgttattttcttatatgttttcaagataatctgattaagtgttgtcaactgcatctcttatatgcagcagtgccttctgaactactgtaaattttccccatttcaagggaataaagcagttgtactttgtgctttaaaaaaaggaaaagatgagtaaaaccggtcttgttttcagcttggtaagctgagtagctgacactttgcaactttcagaggtcatacgcagtgtcctgagtggacaaagtgttatgcattgataccttaaatattgtatctagagacaaaaattgtggaatatatcggccatatctagaatttaaaatgtgttgtcaaattaaagggcattagacacttgcagtaatgtatgtggccgttgtaacgcatttgctaggccagaattcgcattttgcttgttctgctttacctgaaatacaaaaggaagatgcctattagctatttagctaagcctatatgtctggaatttcttttgtctagtctatgtcagtacttgtgtaaatgcctttgctaaacttcaactgtaaaagctagccaagttatagtattttttacattgtttgtccttgcttttcataagtgcagacaagattcttgttggttctcagaatttacttttcctgatatgatgttagtccacagattttcactgtgtgattaacataaagcctacctaatgtaaagggtttaggctttcttgtgtatcagtatatgaaattatgtgtttatttgcttcttcaagaataaagttcgcgcgagcgtaaagataattcttgcctgaaaatgactggaactatgacaactccagctaactcgtgaacagttagtgtgtagttctcctgctttctctttttagccgggtcgcaggaaatgtctcctgctttctacgttagcatattgctcgtccgttgcaatgaaattttaattaataaaatgtatcatcaacccatcattattttgcgtttacatctttatatttgttacaaatatgtaagccatctagctcctcagtcttttttcttcccataataattagagagtaggtagtagggatagctgacatgcggattctctgactctacatgccatttcttcattttaaaaggatagagtgttagtgatggggatggtgtccaattcatcaccacttaccaccatcactactttttatagagtacagaacagttatatagatggtgtttgccatatgtttctttacgtctctgatttgaaacttcaccaggctgggatgagattgcccaggaatgaccagcctgggcaccgcataagtgcaaactacaccaggctggccatccaaaataaagtctagacctcagacaggttggcaacttgaggatagccaaatggctctatctgccccctacgttgacagacccaggagatggccctccacctccttgcagggtgcatatacacaagaacttaggcggctctagcggattggacaacatacggtcagctagaccctacccagtggcagcaagcatcgatagtgctagagtggtgagagaatacttcaagcataaaagaagcaccaaagaaaggcactacacacactaacactgctaattgcctgagagatatgaaacgaaaggaatcgtaggaccttcccacataaggagctcttggcgcccagtcttctggccaaaatcaaggaggagaccaaaacgtgggtcctgacgggtgtgaaaaagctcggtgcaatgcttacattttagttagcttggaccaaaggtcttgaggctgtacatttttttcctttcttttttgatatgtacagttttcttcttctctattaaatgaaattgacgactcgccgattcgttacaaaaagtattcactgcaagagaaacggccaactcacatcatctgttcatgttttacaagcaaaacaacaaaatggaaggacaaaccagggttaaatggttttaggcttttacttcatttgtcctcaaatataagtatttatgagagttaaatttatgtactgtataaacatttatggaacactgattccaatacacataaatccaaacattgcattcgagaaaaaaaataaaaaatagatccaagcattgtcagctaatcagatatttatgtagggaattcaggcaattcaaaaatttacaatttgataaacgagacaactgaaagagaatattttactttgtccttaaactttgctcaataggataaaagtctttatgccatgtatctagaaatagagggagtagattgtagagtagctaacaaccaagattcggtgacgaaccccgattcagctctgtcggccattgtcttcgattttgagtagggttggggcgaagcaagctgacgatgagcagatcaaggtgttgacaggacgctgacaagtggggtgctgacgagtagatcaaggcgggcacaaatggtagacgatgagaagatcgagacaacgacgaacaaatcgaaaagatgcaaatcagggcagccattgccggcgacgagctcccggcaacgcgagtgaggcgaagacttgggattggcaagctcgaggtcatcatcgctgtcatgttcttccttgtcctcaccatcttcctggtacgtccctcttagccatcatcaccatggtcacctccctgctcgagatcttgccgcgccactaccacattcttgctcgagctccatgtgagggggttgggggtaggggggggggaccacatgcaggacaacagagagccagttaacaccagcgcgagacgtgccccccaccctcgccttgacgaggcgcgagtgtcctctacaggcacaagtggctctgtgggggcatggtttcatttaggatcgtgctgcgacacagatggatgcaggtcggtcatctgtagtaccttatgtatatgtatagtactgctcactcttgtactatagaggctctcgacgtggcaccgggctgggggcacttgccgggtcatcacactgtgcatgcccta

SEQ ID NO: 41427 - DNA, 1763 bp, Oryza sativa
catcgtaagtcatagggacatataggcaatgcgagccagctgatatttatctctctctctctcccccgacctagcagccatgttcctcttatgtgtgtgcgtgcgtgcacagttcgtgcaagttgggaggagacgcttgccaatggctggagccacatgatcgagccagcgattctgattccgttggcctgcctataaataccccgaggagcgagcactgcagatgccaaggcagaggccaaggtttcttctctgctagctaactagtgggctgcttgggtggggagcccgggccggcagatatcctgtctgaaacccttaggtatgtattttccctcaaatggctggttaatttcggctccgaaatggcagttcgcatactatcatgcgaatggcattgtcttcttcgccatcacttgtataaagtcactagtgcacatgtagctttcaagaatcaagaggatgatcactgctagctagcttatgcgtctgtttagttaggccaagcagcagcctgtgttgtgttacctactcatttccaattgcacccattgcatcaggaaccttccatctttcacttgtaaaaatcttactgcatctgttttgcctgttcaaacatggattttccatgctctctcaagtgtgaagcagatcgtttgcaacttgcagttgtgtttaggagccatagtagacagggtatcaattaagcacaaaggtcatgttgcatgcatgactcaaagtttttttttccttcatttttttttgggtgggaagaaaaagtttggaccaatggttttacgccagcttttatctcctgtagcatttcacgcactttcacgttgtgttttttctccctcccgggagtcaatctttcgccgtacgtgatatgataatatcgaatccgagcccatatgtccttgaagagactgacagaattgtactttatctgaaacccggttgctcggtcggtcacaccaaactgagccaaaaaggagatccgagttagacaaatcgcgccttgtttgcataaagcggcctaaacttagatgcccatattactatcacattattctgaagaatttttgttcagaaaacaaacattattctgaagaatctcttttgcacatcgcgtgtagcaattgttcgtcagtagcttgctacgttctacagttctctgcacgagtggcctaggtagatactgtatttttttttaatatcttgtgcgaaatgggtgtacaaaagcagagtcctgaacatgtacgcactgcattgcgtgatcacagggacagggacttcgaattcttggaggcaatggcgtcctcgttgctccactgctccgacaagctgccgttcatgaacgtggagaccgtcctccacatgaaggaaggcctcggcgagaccagctacgcgcagaactcgtcgcttcaggcgagcaccttgcttccttgccgctcatggccattgattctttttgatccgtgcatgcatttttttccgagttctggctctgagccatggcgtggccattcttgcagaggaggggcatggacacgctgaagagcctcatcaccaactcggcggcggacgtgtacctgtcgcagatgccggagaggttcgccgtcgccgacctcgggtgctcgtcggggccgaacgcgctgtgcctggcggaggacatcatcgggagcatcggccgcatctgctgccggtcgtcgcggccgccgccggagttctcggcgctcctcaacgacctcccgaccaacgac

SEQ ID NO: 41428 - DNA, 4575 bp, Oryza sativa
ctctcccaggtacttaactcctctgacactgttgcattgtttgatctaacgattaaccggtgtttaagtgggaaattttctaaatacttcaggttccttctgggcttcttgacgagatgaacaggccgatcaacaagggaaagatgtacatatcaagcacgagccccctggccgtgccagtggcctacctgaggcagtttcagagagacttcagcctgttcctcaagtcgcgcgcggcggaggtcttctccggcggccggatggtcctcgccatgctcggcaggcaggccgacggctatatcgacaggcgtaccaccttcctctgggagctcctctcggagtcgttcgcctccctggtcgcacaggtgagcagatagcctgatactcatcagtattcagaactctgaactgataatctgaacctgacggcaatgcaatgggtgggtgcaggggctggtcgaggaggacaaggtggacgcgtacaacgtgccgttctacgcgccgtcgataggggagatcgaggaggaggtgaggcgggagggatcgttcaggatggactacgtgcagacgtacgagatcaacctgagcagcagcggcgacgcgaggagggacggcaggacggtgtcgatggcgatcagggccatccaggagtccatgctcagccaccacttcggcccggagatcgtcgacgcgctcttcgccaagtacaccgagctcgtcaccgcgtccatggagagggaggaggtgaagagcgtccagattggggtcgtcctcaccaggttgtgacacaaaccacaaagctgtgacgactgaccagagcgatttgtaccagtttatagtttgaccccatgtttctgaattctaatgtgtgaccatgtggtgtttagttgttgtattgagtaactgatgatattaacaaattccatgtgtacttaactggtaggatggaaagaaattaatggaaagtggattaacaagtgtgttgaaatgccataaatcgtccgctactcccctttatcatcagtaattcaatatccagcaatactactgattttgtggtttatagctagctacacattcatacgaacgctaataaagttttgcgacttttttttggtttcgtaaaaagaaaaaacatttttttctcgcaaattttttaacgctttttatactttccctcaaaattaatgtcacaaatgtgaaaacaactgaacatgaggccttgtaatgggctggcaagagcaaacaagggcaacaaatttcgaccatcgtgggatgagatgggcttaaggaggcattagggcttgttcagtttgttgctaaaatcaaccatactaaattttggcattgtcaaattttggccaaattttggtaaggcaataaactaaatgacactttaccatcacaaccttgccaatccctaccaacatttgggattctagaaacttctactcatataactatatcaaaaattgttgaggtgtcaaactaaaggcctgttcactttgatgccaaaaaaaaccctatcaaaatttgtcattaccaaaattttggtaactatgccaaaattttggcatgatttcttatatagttaccaaaatttggtagcaaactaaatgtagccacttttttagcaactttatcaaaatttggtaaggttgaaaatgacatcaaagtgaacaggccctaaactccatcttcacagcttgatctttgctaaaattttagcatcaccaaattttgccttttcaacaaatggtaaggtcttttttgcaatgaactgaacaaaccctttgtttttgtatgtgaggcccattaaggaataagtccatttatatccctcactttttgttgagttggaaatcttaacccctaacttacaaaaccgggttaaattaggtcctatagcagtattgagggctggtttcactggcatgacatactagtcagcgaaagaaagtcagtgaaaagaaaataaaaaaacatatagggcccacatgtaagtgagcttgcacctcttccccaactaccctctcttctcatccctcgacctcaacctctctctcccccaagagctcgccggtgaggagaggggcggtgggcggtggctggcgagagaggagcaagatggcggtggctcatatccttaccgacgagccctacgtgggaggttggaggaggagatggcgcagtggagaggggatggagcgagggggcgaccgccgtcaagggtggagctcggggagccgccatcggtgtggagagggtcactgcggctagaatatgtgtaacaaccctccctccagaaccgcgtagccagtccatccgacgggcgggcccacttacacataccactccacttatactttcgtcttcgttttgtgtaaaaaggttaacccgggagtgagatatggttggagggaagatgccttataagttggtttcacccttactaaactagcaaggtggtactaaacatgcacacacagctctcatgggtcatacatgcctcatcctaattgggccaggatgtcacaatatggctgacgctgtccttactcgcaaccgctgccgagggcgatggtggcagtgaacctgtggttgccgaagcaagagctgacgatcacatcatggcagtaggaggagcacaatcagtggactccatggtttcaccatgggcagggtgattgggaggcttcgggtggccttggcctctagctcgatcgtatcagtagtgagtgatgctttggcctcctgtttgggtggctttgctatagcgcctccctcatggccatcgtcgctgagatccatcaaggtatgagaatgggtcaccgcgccttccccatggcttggtgatcgcgttgcatcgtggagcacgaaatgaagcgctacgagagcggtgatccacaatgagtaagtgctctgtgtgttaggatagttgctcgcgcttcactggggaggcatggttgtgatgctgaagcaagcgtgccggtttaagaagctcgtgatcattgccaccacgattgttgccttgctctgaacctagcatggttgtcaccttctctctccacctacggtagctgcgtatcttgagctcgagctcgtgggggaggggcgcctcggccttcccctccctactctcgagtcggtcacggcctgcgcttgctcattccccgccgcccaccgccaagaggagatgtggagagatatgggaagagaggagagaagcatgttagaggaagaaggcaagagcctgacatgtgggtcccatgttgactgcagttaattcatcacgtcagtgaaaccggccatctatagtttcatactgccatgagacctaatttaaccaggttttgtaagttggggatcaagattttccgtattgcagttcataaatatgatttaaatccgtcagaaagatgcgtaaagtggacttattccccattaaacgtagctggtcgtatgcctatattgggcttcggactggtggaacaattctaggccgcgatggtgaggtagacatgcacggtgacatgaattcacctgacatccaagtgaataattgatattctcttcattctaaaattggtaatttataatattagaatatgtcatatttaattatagatggttatatttaggacaaaagtagtaactaatagttctgatgtgcctacgcatggtgcctcttgatggcctgaagcttgacgccatacttgaagtcacagatgatcgcgaactagaactcgagaggggactccatgctaggcgagtgccggaacacgtaatggcggtagaggtggatcattgacagtttgatctcctggatggagaacttctggccgatgcacacccttggtcctatcccgaacgggatgaacgcgtacgggtgcctcctcctctcctcctcgccattggggtcgaaccgttccggccggaatatttctggctccgggaagttcttaggatccttcgctagcactcctggtgccaaccacacccacgttccctgaaaaacaaatgcatttgtaatccattatattcctacatagactttgctctttaatgaatgaatcccactacagtgctatctactggtagtagaaaataatttgaatcattaattttatttgatcgaatggcttatatctatttatattaccacccaattaacaacagtataaacatggaggggtattattataaaaaaaataggtgagaaggggcataattgtcatttagcagtgattaaacctttttttttctttttttagcttttatcgatggaatataaacaatgccagtgcaattgatgaccatagatcaatctagtcaagcataaataacaaagttacctccaatcattatattagtaaatcattactaatttactattaataacgaaccgttgaaatcatttctacagatagtataatattattagtaggaagcaccggagcatctccttgatgtacttatatatagatcgttggatctagtacctttgggaggacatatcctccaatttcgacttgttcaagtgtttccctggctagcaatggcgacataatgtag

SEQ ID NO: 41429 - DNA, 16019 bp, Oryza sativa
catgaacacacaagaaaatatacgcaacacatacctgatcaaggtacgggaacttggtctgcagatcgtcggccatcggcacgcagtagcgggggccgaacgcgtcaatctccttgagcaacttctcctccacctccgggtgcttcgcgacgaggtagagcaccgtggagagggtgaacgccgtcgtggtcgacccggcgaggaggtgctcgtaggtgagcgcgctgatgtagtccggcgtgagcagctccctcgatgacttgttagactccctcgccgtgagcacgacggacaggaagtccttgcgctgctgcgacgccgcaagatcgtgctccattgccgcctccctctcggcgacgatgctgtccatatgtgttttcagcgcgcggttgacccggtcgatcttgtagtcccccatgccgggaatcctcttgagcacttgccggaacggctcttggaggaacggtaggagcataccgacgagtatggagagcgatccggacaggtccatcttgagagatgtggtcgcgtgcatgtgcatcttgatgaactccgacgatgccttagcctccacgctggtatcagcggcgatcttgtctatgttgctgtcgtcaggtgtgactggcagctttgacaggccgaagtccgtgccgaacgccgcgaggccgatcacgtcggtggcgaggctgagagagagatcggagaaggtgatctccttctggccgtcgaggttcttggacgcacgctgaatgcacgactccatggtggggatcaggctggccaggtgcgacggctggtagatggagatgatcatatttctcatcgacgtccacctcggtcccctgcggtgcagcagccatgatgttgtttcctttaatttaacccaaatcaattttttcgacacaactagcataatattcaatgaaattcggccaaattttatgggaaatagctagtctctgctgctagccagctagttgatacttgatattacctgggaaactctaaactatggaggagacaatcctttattgtttacatgttatctaaataattatgaaaaacttagaaaaaaatcaataagatagattaatatgtgataaatcactttacaaacatgcaagatcacatttaacttatacaagatgtaatgaaaaaataaatttaactgcgaatatacgttaactagaaagtttaatttgctttttctgctgcaactcgtagaaattgaattttaacttgcatgtgttgtgcaatgatctatcttcttaaatcttttcaattttttcataactatttggatgacatgtaaaccacggagtaatgtcccctcttagagtttagaatccactctcgatgctaccttatgaagaacaaccctttcttatggataggagaattggcaatgggggagggcatgcttcgatttggaatgctcttgaatttcttcacgcccacttccttgcacagctccgcatccgccacaatgatcagtggttgccttcccatgtgaaatctgcaagtaaattgaataattgtgctatgtgtatgaactttgatctaggttcacactgggtgtgttgttttaatctaggtttgcacagactagataagtttttcaccgaagagtactttgcaatttattacacatatttgcatccacatcataaatttatgcatcatgaatgtagtttactctaaattgaattccagttaactggttggtactgttatcctaagctatgctctccacgcaaaacaaattagaagaactgaatctgcgagcagaggaggcagtcacctgaagacaggaccgtgcttcctagcgagaacggagaacacatccggcccgtgcatggcgagcaggtggaggtggccgatgagcggcagaggcacgggacccggcacgtgccaaaccttccggtacggctcgtacaagtaggccaccaccaggagacccacagccatggccaccaaggtgaccgcccactccgccgttgcgcccagcacctcgctgatgtccatctcagcgatctcactctcaccctgccttgcctccctcttgccttgctatcatttatcgcactgttgacgttctgtgacaactgcgaagcatggttggttaagtaggcttgtgaaacggtccgttcccgcaggattcgatggagaggcatcgttttggttggattagtttgtcctgcttggctgatgtatttgttgttagtcactggttccgaccaaccaattttatttgagcgagatttctgagtctacgtgtgatgatggacgtgccggtcgaggaagaagtttgctaaaaacatgcttaattaaatatcgctgggccggaaaatgcataatcaaatgacgtgcagccagtgagtgcagtgtgacaaaaaaaataaataaataaggaaggtagctgccaaacgtgttgatgccttagatattactcttccatttcagattataagtttggtcaaagtcaaacaactttaaatttaattaagtttataaataaatatagtaatatttataatattaaattattttcattaaatcaataattgaatatattttcataataaatttgtaggttaaaaatgttaatatttttttctacaaacttagttaaatttgaagcagtttgacttgattgaccaaagttaaaacgtcttataacttgaaaaggaggtagtatttttttaaaaaaaataaactttatatgctaatggtggagcaggcgagattctactcagtaggtttcttgtcctcgtgtatataataaggtgtactaatcgacaatcaatatgatcgatgtaatactcttaacggatgtgccgctagctgattggtggatttattccgcaccaaattactgacacttgtccctttttctatttggtatgcagtaccatgcgactatgcgagtatgactatgagacgatacttggctaggctccgtgaagttcttatgggcctcaagaaaacaatcttagctgtttttcttaacccgttttaaaaatggtatgttaagtaaactaagatacataatgacacaatcctatataggcttacaattattgtatttcacgaagaaaaagtactgttgaaaaaaacaatttatgtatgtgaagatatatacagtgattaatatgaaacatggcgaaaaataatttaatagtgttacttccacatagtaaaggatgtcaatatcgcacataataattgttcacgtaagattaacaaatctataaaatataaagaaagaaacaaatcaatttaagggtaaaactttccatatctctaataagttcaaaagaccaccaaggctaaaaaaaatttaagaagaaagaacacaaaattaactttaatattttattaaaattaaattttgtttgtggcttataaaacaataaataggctatgatggtactaacaagttttcaacttccttagtccttaccaaagtcttgaatcctacaagttacttcaaggtatactgtcacaagtcgaattcctttgatcgtcgacgcgctcttcgccaagtacaccgagctcgtcaccgcgtccagattggggtcgtcctcaccatgttgtgaaacaaaccacaaagctgtgacgactgtccagagtgatttgtaccagtttatagtttgacccctgtttctgaattctaatgtgtggcgatgtggtgtttagttgttgtatcgagtaactgataatattaacaaattccatgtgtacttaactggtaggatggagagaaattaatggaaactggattaacaagtgcgttgaaatgccataaatcatccgctacttcctttcatcaccagtaattctgtatccagcaatactactgatttgtggtttatagctccacactcctacgaacgctaataaatgtttgcgatttttttttttggtttcataaaaaaacattttttctcaattttcttgaacgcctttatactttcccttcaaaatcaatgttcacaaatatgaaaacaactgaacaagaggccttgtaatgggctggcaagagcaaacaagggcaacctttcggccatcgtggaatgagatgggctgaaagaggccttagggcttgttcggcctgttgctaaaatcaaccataccaaattttagccaaattttgataagacaataaactaaatgacactttaccgtcacaaccttgtcaatccgtaccaacgtctggtaatctagaaacttctactcatagaattataccaaaaattagtaaggtgttagactaaacaccatcttcacatcttgatcttgctaaaattttagcattaccaaattttggttaaatggtaaggcttttttttggcaatgaacaagccctttgttccattttatatccgtcatcttttcgttgagtttaaattgtatgcttaatactgaaaatcttaacccctaacttacaaaaccaggttaaattaggtcccataatagtattgagaactgatttcactagcgtgacatactatttagcaaaaagaaaaaacatatagtgcccacatgtaagtgagcttgcacctctccccacctaccctctcttctcatccctccacctctcccctctctcttccccaagagctcaccaatgagaagaggggtgttgggcggcggctggtaggagaggagcaagatggtggcgactcatatcctcaccgacgatgcacctaacatgcggagagttgcgacggaggcatgacgaagcgtgcgtggaagaagggtgatgcgagcgcagggcgagtgtactcatacattcaggggatagaggctcggaggagcccacctgtcgtgtgtggacgaggagtcactcatggtcagaagtatgactggacgtctatcccttgctatgcatcctgcgtgtcaagcgccgatcggtggactgtgaacgccgtgcgtcgccaaagccaagagctcaatcgtccagattgtggcagtagaaggagcacaatcagtggactctacagttttgccatgggctgcggtgattgggaggcttcgggtggcctcggtctctggctcgatcggattggtgagtgatgcttcggcctcctgtttgggtggctcggccaccgcgcctctctcattgccatcgccgccgagatggatcaaagtaggggaatgtgtttgcgttgaggtgcacacgatgaggcgcaatgagagctgtgatccacaatgagtaactgctccgtgtgttgagacagttgctcacgctttaccaggaggatgacaggtgggtcccacatgtcagtgggtctcacaatacttttttttttgaatgacataagggtcccacatatttttttatttttgtttttattctaataccacgtaagcgtcacgtaggataaaaacttggtcaataccgccacgtcagccaaaaccaccttcaaaaccatcgagggacattgtttgcaccggtattgatagttggaggagtcgatatacccggttttgtggttggaggatatgaatcatactcaggcgatagttatgggagccaaagtatactttttccaaattttttacaagagaccccattaaacgtagctgggctatgtgcctgtgttggacttcggactggtagaacaatactagtaggagtaccattttagcagtggcgaagtgaaccgttgacagttcttttgttttgacacagtattaaatgcagacgcttagctcgaactgataaatatacagttctgctgatgatgtgcctatgcagtgtgcctcttgatgacccgaagcttgacgccgtacttgaagttgcaaacgatcgagtactgaaactcgagaggtgactccatgctgggcgagtgccgaaacacgtagttacggtacagatggatcactgacagtttgatctcctggatggagaacttctggccgatgcacgcccttggcccgatcccaaacggaatgaacgcgtatgggtgcctcctcttctcctcctcgccgttggggtcgaaccgctccggccggaatacctctggctccgggaagttcttgggatccttcgctaggactcctggtgccagccacacccatgttccctgaaaaaaacaagggtatactagtacggaaacaacgaagcagagtctgtctggaactctggattattggccggatctagtacctttggaagggcatatcctccaatttcaacctgttcgcacgtttcccttgctatcaatggcgataaaaagtagaatctcatcgattccttcacgacctgcatagtacgcacatgataagtgcaatgctcggtcagaaattcaggtcttactattcacgactccacaatcgaagaccataaatacgaccaatgtcgaagaagggcatgcatgcctgatcaaggtaggggaacttggtctgcaaatcctcggccgtcggcgcatggtcgtgtggtccgaacccgtcaatctccctgagcaacttctcctccacctccgggtgcttggagacgaggtagagcaccgtggagagagtgaacgccgtcgtggccgacccggcgaggaggtgctcgtaagtgaacgcgctgatgtagtccggcgtaagaagctcccgccaggatttgttcgactctctcgccgcgaggacgacggacaggaagtccttgcgctgctgcgcatgcggcgctgcctggtcgcgctccattgccgccgctctctcggcaacgattttgtccatctgtcccccgagcgcgaggttcacatggtcgatctcgtggtccgccgtccagggaatcctcttgagcacctgccggaacggctcttggaggaatggcaggagttggccgatgatgatggacagtgagccggacaggtccatcttgagagacgtggtcgcgtgcacgtgcatcctgatgaactccgatgatgccttggcctccgcgctggtatcagtggcgatcttgtcgatgtcgtcgtcattcgaagatgctgatatttttgacaggccaaagtccgttccgaacgccgcctggccgatgacatcggtggcgaagccgagagcgagatcggagaatgttatgtcctcttggccatcaaggttcttggacacgcactcaatgcacgactgcatggtggggatcaggctagccaggtgagacggctggtagatggagatgatcatgtttcgcaacgccgtccacctcgaacccctgcatgtgcagcactacagccatttttctacgtttgcaacggaaaaaagaaagtacaccaaatattaaataactttaaaatgacaatttttttcataacctagtgtaatatatgttttctttccgtgtagaagaactatatatatgctttttccacatatttataaattattttattacagtaataaaggaatatttgttcacatgtgtggcttagaaatcaacacattaattgaaacaaaaatatacaccgttgattatagtagatctagaaaaagttttgatacatgtttaaatataatgatgtagatttatcaaatatatgctctatctttataattagatttaatccaaatcatgatcccataccggctaacaaaacaaattgttttctttctaccaacacacatgggataaagctaggtctgggaacacgaacacaaaataaacgaaagattatttcagcaattatttaattagaaaatggaatcaaaatcctcacttttaggtttgggccgaatatgaaaaagtccagattctttcccttttgtctcttttttgtttctagcctgtttccctgtttcctttctccgttaaagtccagtttgcgttctcctagatcgcctaggaaaataagtctaattaatttaacttcctgtcgctacattagcttcttcaagctccagccgagccaccccaatcccgcatccgattcaactaaacccgtggagataatcttaaattagttgaaggcttttgatctatatctcatactctatcttttccctcaagaaattgaaggaaatcccatggaaaatcgctcccgtatcaagctcgaacttgagtttatcgaaccctagtttttatctttctggtgaactcgagtccgattcaaccaaattagcacattgacgggcaaaaatgcagacaaaaaagagatgatgaacggaaagttaacaatttgtaattagttaaaatatttatgaactgtaaaaaacggtcagcaaattttcatattgatgaatttaaatatttagtgccaactccaatgtggcactgacagaaattagaaaagtaaattttagaatcgataaatttattattattattattattattattattattattattattattattattattattattattattattattattattattattattattattattattattatatgttagctttgcaaaaaatgtatcagtatggatgggaaatttccataccattttcacccgtagctcgctctgtcccaaaatatagcaaccaggattggatgtgactcatgctactgatacaaatctggacagaggtaatataccgtgtcccatccaatcttggcttggtatattttgggacgagtgacttataatatgaaaaaagagagtatcagatagcaaatgtgagttcaaatactaggaatgataccaagttataaaccatatatgccaggctgtggagattgttcgatctggttaacgaaactagaggattttcctgtgcaatttgcacggagctagatttaaaaattgagttgaatttgtatacaactttgattctgtttctatacgggtcgatttatgctaccatatttaacattgtactttgtatacaattatatcaataaatctccaccgatgtattctagaccaacacaatttaacggttaacatatttctccttttgtccgattaaatgtggtaatttttaggcctccagagtaaacgcggtgaaactcattttagagctatcttaataataatatgctccccctgtctcaacatataactattttgagttccgaatctacataagtgcatgtcgagatctatagttaaaagttaatatattttaggacggatgtagtaatatataaatacatttatatttatgcaagaaagtaagagttatatatcaaatataattatacttttttatttaggtttgctgcaaagcagcagagaaaaaacactacttatattattaagcaaggatgaaaaggaagtatggaactatcatgtttctctctcgaggcctaaatagtaccatgttatttgaagaaaaatagaatcatatgcaccatcttgaaaaaggaaaagcacccgatgtgtagtgatggagttgtgaaaatttatggacatgcatgacatagaaataagggttgtatattatatatacttttacttttacttcatagaaaaatgcacgtgcattgcaactggtgaatgttattttaatcttattattgttatacggtttagctagggtaaaattcactgtaggaattcgcttgtttttctttagaaaatcatgagttgcaattagtagtccgacttttatctcaagttagcatacagagttttttaaaagagactttttatacgactctttatttctaaaagcaaacgagcttaaaatccaactctaacacggactgtatttccaaaagcgaacgatcttaaataccgactcaaacacggatgacgtatcaaaataccggcaaaaacatctttaatttttataatagtagatatttgtagtttatcaatgtactaaataaaataatagactcatgttttcacttatgtttatatttattcgaacaacttattagcaacttataaaacttttatacttgtatccttaatgattaaaaaaatattgtaataataaattacgatgaaaaaactatgtaaatacttaagtatttttgttaaataaacgatacacaattttgttaaatagtggttttgttaattttgtgaaataaactacaatgaaaaaactatgtaagttttagaaggagttattaattaaaataaatatttatgtagtgttacatatgtgatatccttatcttcatatttgaatataattctatatgatattaatatcataggagtaattttaatggtcaaaattatctattgaagactgtcaaaaacttgcgtcttatatattttttttggttgaagatatataaattgcagaaaaaaaaactccactctttacaggaaccaatctgagttgctacctaccttgtgaagcacaggcctttctgattaataagagaattggcaatggctgagggcatgcttcggttaggaatgctcttgaatttctttacgcccacttccttgcacagctcggcatccgccaccatgaccaatggttgtcttcccatgtgaaatctacgagcaaattaaactagatccagttaaccgggtagtagaccctggtattcccagttctgagctctgcgttcgagacagagaagcaccagtaagcagaggtgccagtcacctgaagacaggaccgtacttccttgcgagcacggtgaacacgtccggcccgtgcatggcgagcaggtggaggtggccgatgaacggcaggggcacggggcccggcacgtgccgcactttccagtatggctcgtacaagtagcccaacagcaggagccccacagccatggccaccaaggtgaccgcgtactccgccgttgagcccagcactgtgctgatgatctccatctcacccttgcgtctctgccttcccctctttgcctcactgtcgcagttcgtggtgtgccaagcgttgctggttaaataggcttgcgattttgtgaacagtccaacggagcagatggagaatcaatgaggcatccttgagagaggcatatggttttggctgtattagtttctccttaatgaagtaataaaacaagcataattaaatcgcgtgcaaccaattagtacatcgtgacaaattttttgttttcttcgggagggtagctgtcagatgctaatggtggttgtcctgacgtgttacgtgtatgcaccagatgaccagaaaccccatcgttgcatgagttcatcgccgtcagatggtgaaatgagtgcctgtgtcttcgttggcactcgtaaaatattgagccaacgacttcagagaatagaacggcgatggcccaccatcccacgaaaggtaccaaaaggtgctggactgcaaattcgaaattaacaattttcttaaacaaatgcataacgtagtacgatatttcgtattgagagagcataaaaattataaatgtacagttctaagagaatatagcgaaaaaaaaaacaccccataacagtggctaggggtggacgttcggtcagacagaaaaatttggtctcggtttttggtttttcggtcatttcggtctttgcaaactcaggatcgaatttcatccaaaaaatctcaggaccggcaaactcggtctcggtttcggtctgaccgaattatgcactagattcgaatcagaggagtagatcaaacaataagcataatacttacagtacatcgcaagaagccaaaatccacagatgtagccgctcgctgccttcccgtcgtccccgatggagacgaatgcggccggtaggatggaggcggaggcggcgccggcaatggaggcggagggcggaggcggcgcggaggctatcaggcggagccacggaggcggcgcgatggatgcccacggcggcggtggcgccggcgcgatggaggcggagggaggaggcggtgccggtgagctggaggcggagagtgggggtggcaccggcgcaatgcaggcggaggcggagtcgtgacgggctgacggcgtgatgcggcgaggattggataagattggaggcggcgcgggcgtgactccctccctgatgccctctagggttttgtttttaccgggcttattgggcctcgtaggtctattgggccacaatttggttaaccgaaagccaataaccgaattgcccggaaaaagtcggtcttttgatggctgagactgaattactaaaagtcggtctcggtcttttcgatttggttcttcggttcggtcttattctgcccacccctaacagtgacgtagctaggatttaaagtaaaggtggtccatcctattaactaacacatctctatctctactacttaaaaggttgaatatgtttccgtcgttcgtccgtgataaaataaagggcgaaaaaaaattgaatccgattatatgcgatgcaggaaaaaaaacgtccatcgacaatccaatttggttagcaaaatgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaataaatagaggacttatttaccttaacttaggttgcagctcaggcagcccgagaatacaaccgacgacacggacgaggcgaacaccaacaacaacagcggcagcagaaccaacggtctaacacccaacaccacaggcgacggctgggaaccaggacgaaaccctaatcttcacttcactttgtcttctcttcacggcggaggaactatatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttggggcgaaaagagacttgcgtctcgattcgactttaagagatgtttttcaacagctcatttagtaatgtaccgacctcccgggtcagatcattacttctcggctcccagagccatttcacttgattaatcggctcccagagtccagctgcccagcagcacaacaatccgcttccactcgggaagcctagtctatgatgcccgcagacatcccgaatcacacagattcgtttctgaccactcagttcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattagcatgcgaggtttccctgaacagactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacctatttcccaagttttcgacaaacaacggtgtatgtgggatatttggtatacgcgctcagagagcacaaataccgaggtaccacgagggtggagcgacaaggaatcagggtagtacgacctacggaaattagtgcgactactgggtaggtccgtcgatttggcacgcaaaccgaggccaagcaagttaagtgtgtgattctaataatgcaagttgcaaacaaaataataatgacttttcaattataggggcaatttgatcaaagggtgacttgccttgctcaaggtcttcacgaagcttcacgaatcttcgagaaaacccgcgatcgacgaaaatccgataaccgcaactatacgcaaaaaatcgaaaacctaaacaaaggaccaaaagaaggatcctatttagactaattagtagtgccattaaatagatctcaattttacggaattactggaagtataacggagtcaatcggagttacggatcgggagatatgaatttgaagtttatttggaatttctggaataagaggaatggtttatggaatttatagaaataatattctcaagaatattattgacagtcacagacacgcgggaccaaaggaaatgatttgtggaattttgggaataaggaattgatttatgaaaaagggaaaaggatttattaatcctttggataagaaaaggaaggagggatgggatttagacttctttgggcggctcgggtacggcccaagggataagcacggcgcggccgagccaatgggccgggcgcgggcgcgaggaggcggcccatggccgggcaaggcgcggcccaagcgggcggggcgcgcgggaggagagagggggatgggtccgggtggaccggatccatcgtgctgggtctcgggacaggcccacgagttagcgactcggcgcatgggggaagggttcatgcggcgcagggcgctagggttttgcggacgcggctcacggcgcggcgcgcgggtggaccaagaggtggagggcccacgcgcagccagttggcgcaccgtggaccgcgcgcgcgagggtgggggagggaggaggcggctgaccggctcggcgcggtcaaagccgaggtggcgccgacgtggtgccttcgtggctgccacgctggctggcggagggaagaagaaggaggccggccgagaggaggaagaagggggcgcggccgaatggacggcggacggcggccgagttcaccggagcaagcgtgacggatttggtcttcggggagcacaccggagtgacgagggcatcgagaaggagcgagccaacggctcggattcgccggaggaagttgacggcggtggaattcgacagcggctgccggcggcgagagaaaggggaaatcaccgaggggcgacgaggactcaattaaaggcggcgggagcatctccggtgttcaaggaactcatttccggggtcggatgggtctgagcggcgccgtggaggtccggcgacgagagtcgccctccgggggtgggcggcaatgtcggtggggccatgccgggtgtcgccggtccttggggcggcgtctacgcgcgttcggcagggttaccgagctaccacgcaagctagaggggacgagggtgagcagggaaggggaactggagggaggcactaccgagccgggacggcgcggtgacgagcagccaacggcgcggaagcgagttctccgtcgtcgggccggggaaggggaagaagatgggcgcccagagtcccgcgtcacgcgtccacgcacgcaccggctcccccggtgctcggcgacggacgacggtggcgcgagcagggcggaggcgacattggcgcggtggcggcgagagcgaaaacgagagagattgggagatggggcgcctcgggttttatagaggtgggggatgtcggttttgggagggaggaaaccgacctcgtgggcggtcaaggaggggcggtcaaggaggacctggcggcagggcgcccgtggtccaggcagtggcaggcggtgacgccgatggtggtcgggcaaaaggaaaaaggaggggggagaaagggagctctgctccttgctgtttcgggaaaagttgaaggagggagagggagtgagagagaggctgcctctctcggctttggaagctagcggcgtggagcggcagcgcacgacgcaggcgacgctagggcttgacgtggcggcaaccgggcggctgcgcggcgcaggcgcggcagggttgacggcggcaatgaccggccggtcggcacgcgcgagcgcgggaaagagcga

SEQ ID NO: 41430 - DNA, 7986 bp, Oryza sativa
tacagtacttcatcagagactggaagattaccacctctccttttgcattggtcaacttgatggtgcggctggcgcaatcaatcactcctctgtgccttgtcaaccaatccattccaagtatgacgtctaggtccttggattcgagaagaatgaggttggctggaaaaatcgacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatatttttgccggtgtcgagttgacaggaaatgtgcccaatataacctctggtgctgactgcgcctcctccgcagatgcatgattgacccgggcctgaacgaacttgggtccagcacgtcttggcttcgagcactttccaaccatgtgtctgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacggtactgccggataatcatggtggaaggtccaccctgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacagaaacttctgctgcttctcggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggcttttcgctgccactggcgttgttcgagtcgcgtgaaccattccttgtctccatctgaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaagcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgtataacccccaataaattcccgactgactgtcgaataaactccaactaaaatttttctaaagccctagactgagctaatttttttttttaaaaaaaatccgatccgaaagaacgaccaagatttttcccgcaaaccaaagaggcaaaactccaaattttcccgaaacaaatccaagtgaaaaagggcatatgcatatgaaaaggggttcagaaggctcttaggttttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatggaaaagattacaaatgcagcggaaaagataaaagcgagctaaaccggaaagcttgacttcagcagcgagcgactccactccacaggcaatccttgacggcagcgacgaaaccaactatgacaaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaaaggggaaatcgtgacaagaccctccacataaccctcccctaaccatccacaccacgctaaggtttcacccccacccctcataaggcagtgggcggtcccctcttgcgccgcggttaatccggcagctggacaaccggacaccccggccgacccaactccatcacgcccaccctcgccaccggtgcctaggaaagggtcgagctatacttcagatcaagcagttacccactcccgcttgtggtaagcacggtaagttcccagggtttcccgtgaaccggtccttaattgccatgagtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaggttatcaatggcatatggtaaacaataaaaggctgagtagtaggacccatcccacatgatattgtaaaagaatgcaacatttaatagaaatgcgggatatttgtaaattgggtacaatatgatcaaacgtattgcatgacttgccttgctctcacactgacgagacctcagcaacgtcttcgagaaaccgcggatcgacgaaacggccgaaatctacgcgacaaacaaagcacacaagcaaaacatgctataagactactgaaacaggaaacaaaagtatttttaatggattctttgcatttttcttgatttactgagacttgaatggacttaaacggagctcggatgaattacttatgaattttagaagataaactgtgtttttactaataaagaaaagtccttaaatcaatttattgcgcaataaagcccagggctgacgtcatccaagggggggggggcgccgacaggcgggccccgcttgtcagcggttcaagagagaggaagggggcgccggcacgtgggccccattggcagcggcacaagggagggaggtggcggcggcatgctcggcacggctcaagccggccggccagccatggggcggcggcggcggcacgcgcggtcaccggcggtgaccggcggcgcgggagacggcggcggccggcgcgaaggcggcggcggcggccgaagacgacggcgcacgcgcggagggcggcggcgctcatgggagagagaggaaaggaaggaggagaggggattcctcaccggcgagcacgacggccggcgcgaaggaaggaagcggcggcgacgaccggcgatgccgaggtgcggacgggcggcggcggcacgctaggagaaaacagagaggggttaggggtagggagagcgaccacggcggctagagcggccggccggagttgggtggaaatggagagctcaccggcgtgcgagagaaacggcgcttcggcgacgattggcggcaaccgaatggtggccgaggtgcagcgggctcggtgagcgtgacggtggcgactacgcggcgcggcggtgactctagcggcggcggcgcgcggccggagatgggcgttattctgtagagctcgggtgcgcggcgcgagggcggtagacggcacgggagagtgcggtgaaaacgagaaaaagcgatagaaggacgcggggaacgatttataggcggagggggaggcggacgtggccgggaacccaccctattgcgccggcgacgtgggaaggtggggggagagagagaggggtgggattcaaattcgaatcccgcccatttgcggggcgcgcgagggcgggagaggcgggggagaggcggcgacgtgggcgcagcgcgcggggtggggtggagtgggcgcgggaaacgcggacggcgacgtgggagcggcggttgccggccgagcgcggtcggctggaggaaggggacgacctgacaggtgggccccacctgtcagcgtcccggagagaggggaaggggaacgggccggcccaaagaaaggaggccgagcgcgggagggagtgggccgacggcccaatagagaaaaaagaaggaaaagaaaaagaaaaggaagaaaggatttttccttggattaaaaattgcactttggtgatttttaattggttaaaattattcccaaggctctgaaaattccactaaaaatcttgttaatgcattggagcatggggaactcaagaaaaattccaccacgccgaattcaattattaatcgcatttattaactagggaattagctctaggttaattaagataatttcttcggacgatttatttaaccaatttttaaagcaagcaaaagggggaaaacttcagggcgtgacaaacctaccccccttaaacggaatctcgaccccgagattcggaagagctggcgaagaggtgcgggtgggtggccttcaactcatcttctctttcccaagtggcctcttcttctgtgtgatgactccactgaaccttgcagaatctgattactttgtttctggtccttctctcgctggtttcgaggatacgagtcggcttctccacatacgtcagatcttcctgaatttcgatgtgatccggacttgcctgttcctcaggaactctcaaacatttcttcaactgagagacgtggaacatgttgtgaatcccaagcatgttggagggaagctcgagctggtaagcactttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgtgcgattctcaatctttccctaacagctctgactttctcttctgcctcatttaaaacttctgtaccaaacaattggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgcttggtctggccatctgtttgtggatggtaagcagtgctgagtttagacgggttcccaattcttcttgtaatttctgccagaactttgaagtgaattggcttcctcgatcagacacgatcttcttaggtacaccatgtaaacacatgattcttgctagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacggacgtcacatagtgctacgaattcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttctcccatccagattgttccttgttcgtcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtgactcttcctgctcaaggcatctgcaaccacattagccttgccgggatgataatgtattcccatatcataatccttgatcagctccaaccatctccgctgtctgagattcaaatcaggttgagtgaagatgtactttagacttttgtgatccgtatatacctcacaacggttaccgatgagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaaattttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccatagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttatctagaaattccataaacaccttattcatcaaattcatgaagaaggcaggtgcattagtgagtccgaaagacataactgtgcattcgaacaacccgtaccgagtgatgaatgctgtctttggaatatgctcttcgcggatcctcaactggtgatagcctgatcgttggtctatcc

SEQ ID NO: 41431 - DNA, 5434 bp, Oryza sativa
gggggaaaacttcagggcgtgacagccggtgcggtaaacggaggtgggagcgacgaactctgggggagagctggagttttctggcgttgtcgtcacgagacgaggaggcggcggcacgagacgaggagggtgtgcgtggcggatgggtgctcaccgggactgcgtggaagtagcaagacagacgacggcggcgcccccctgcttagttcacgggatggagatcggcgcagcctactcaacccgccgtcggtctcggctcctcgcccgccgcccgcagcttccttcgcatctgcctgccgccggcctcggctcctcgcccgccgcccgcagcctcctccgtgcccaccggccgtctcctctattcacctggagagagagagagagagagatgggcagagaaggagagaaaaaaggcgctgacaggtgggccccaccagtttttatttgtttttgctgattgtatcgccacgtatgtgtctacgtaggctgaaaaccgcttccaatcgagttagggtggtaatttatccggttttaagagtttggggtgtcaaatgttcgtacttttttctttgagaaactatgcatcaacccgtgtatcgacgtgtgctacatactcatttcgtcttaaaatacttgtttttatttaaatttgttccaaaataaatatcacacaatcaccttctgtttaaaattttcacattctacccgcaaccaccactgcgacatgccatattcccttgtatggtttataagagttgtgtgctcatatttagtaccacatagctagtttagtatgggtgggatctaggggtgaaaacgtgtcgcgaccgagaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctctatcttcacaggcgctcaactggggtataagccaggactccacctaagacatcttctccgaagcttctcttactgaagggggggaaagattgagcaagaatgagtacaaccacagtactcagcaagtcacaccggcagatgcatgattaatgcaagggggtacaaggggttaataataggggttaagttttgcagtaaacagcatttaaaagtcacttagttgcccaaagccattttaaaaagacgatcctagagctacacagtattattaatcaaggtcgtgaacccgcacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtatccacgtgccacataccaccacggtatacggacggaagacgtgacatagttcccaacccatcctagccataaacaagagtaccgacccaaccacacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagctacaaactaagccttacccactagacatgtggaagtatggtagtgctttgcaacagaggcccgagcttaatccttatagtacccgaggtacgactaacaaaacccaaccacgcacctcgagcccagcctaaaaccattttgggagttttgaatagagggggaggtgtgtgtccaattccacaataagccaaccattccatactgtccaaatgatatgagaattcccaaagtctaaagttataaaaccacctaatgttgcctaattaatcagcgaagcatctacctaaattcataatagtagaaccatgaacagagtacccactagttggggttttgtttatcctagggtgaacaaggtaataataacaataacaacaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgagaacctccggaacgacagaagctacgcgaagcacacaagcaaagccacaagcctataaagaagcaataacaatacataaaaagaaaccacacggttctttaggttataacaaacattaggagacttgaacgggtcgattcagagttcgtatgaccaagatatgatcatccgaagtttaatgctgttatatggagatttgcggattattataattaggctttgcgactataaaacatgtggaagcgctagccgggaaaagacaggaaggctgcgctgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacatgggttgcacacgtggaaacaacgcggctaccaagcgggcacactaacacggacactacacggacaagcgaacgactaccgataccgatacacggataccggggccgacaaccgcacaacgggcacgggcgacaccgaaaggacgaggacggggcagcgaaggagggatccttaccaccacgcgacgaggcgagggaacgacaacgacgaacgggcgcggcggagacagcccggaacgacggagacgaacggcgaggggacgacttcggtggcgatccttggacgaaggcgagacgcggccggcacgaggcttgacgacgcggagccgaggacgaagacgacgacgggggctgcagcgaccttgacgaaacaccgaggacggacgaggagggctcgacggagggacgaacgccacgacgaccgggaacgacgagaggacgacgacgacgacgaccggggccggcgaggaggcgacgagggcagccggcagtggttgcacggagacgaggatggcgtggaacacgccactgcgaatcgatgacggagcggcgccgcgagacgacgagccggcgaggaggaacgatcacgacgacgacgaacaccggcggggttcggtcgaaggggaggcgaggccgagggcgaccttgccgctgcgatgccggaggagatggcgacgtcggccggcgcactggcacagcgaaaggggctgccggagtgggtgccgacgagaccgagggagaggcggcgcgcacgacggcgttccgacgaaatacgggcgacgccgtggcttggccggggaagaggatggcgttccggtgcagggagaggtggtggcgacgtcggccggcgcacaggggacgcggcagaggcggccggaggcggaacagcggcggcaacgccactgttgccggcggggatgcacttccggaggtcttcgcgggaaatagagggcaggccggggtggagggcgacgcggtgacgtcgagggaggatggcgacgacgacggctgccgcaccgacgagggacgaggaacagtagccggctggagggagtacagtggcaccaatgccactggttgccggcgggggcaccgttccggcgagtttccggcgaggagacggtgaggccggtgaaggggacggtgttgcagagccgagggaggcgacggcacagccggacggcgcgcgggcgaggcgggagaggcggctggaggcgggcggcggtcggagagagagaaggggaaggcggggagaggtggtgcggccacgggatgacgcgggaggaggctaaaacgatagaacgcaaagaggtggttccattttataggcgcgggatgggagccggccacgggagagggcggaacggcggcggaaaagacggccggcggccatggaaggcggccgggaatggcgcggccgttccgggcgttagagggcacgaatcaagggggaaaatgggggaaatcaaagaggatggaaaggggattaaaagcccccacttaatttggaaataagggaattgatttgcgcggatttgaggaaggaagaaactagggttcacgggagagagagagaagctgggcgggaggaggacgacgaccgggcggtaggacccacgcgcggcgcgcggtcagcgcgcggcaacggcgcgcacgcgcgcgcacgtgcacggcacgggcgggagggcgccgctcgagttgggcccggaggcggcccaggtgggagggggcggggaggcttgggccgagaggcggcccaggaggagaggagggcgaggaggcccgggagagagaggggaggggagggagctgggccgggagggggagggaaggcccaagaggagggagagaaggagagggagagaaagagagggaggaagagaggactttggccgcgggccgagagagagagagaggactttgggccagacttggcccaaagggaaagagagggttatttctaggttttctttttaataaactttgataattgtttttgttgcttaataaatatttccggtgctctgaaaattcaagtaaaatttgagagctccttttagaccaaggagaatttaacaaaaattctccgggccacattcgaatttttcttgtacgtattttagtgcttgccaatttcttttcgaattttaattaattctattattccttttagggaatgatttttatttcgggatgaatttatcaggacgtgacaaaacggatcggatattatccaatccgatccgctccaaatccgttcgaagtgaggatatggtatgggtttttagttatccgacggatatggtaagggtttttagctatccgacgaatatggatgcggatgtggatagtgacgtgcggatgaggatatggtatcgataatatccggtggatacggattatccgctattttaagcggattatccgatgaacgttttggcggataatccgaatttcgtagcccatataaccactcaatttggcccatttggcatgagcattttagtcgtgtaaaaatctagcccatccagatccaacctatccatcgatcaatctagctaggtcataaaaccttcagtccgtcatagtagagtacgc

SEQ ID NO: 41432 - DNA, 15700 bp, Oryza sativa
atattgtgatgtgatgtgtgctttcatgaaccatggaattgtgatattggtaccgtattgttgctcattgtatagatgaataaatattgtatcgattgtatatatatgccacatccgattattttcatccatttccgaaccgagtccgcactagctccacaccattttcgacatctgaaacaatccgctccgcatccgcacattatccaaatcacctccgaatccatttaaaaaaatatgatataggatatgatataactactatccatcagaataagatccgttttcacccctagtggaatcaacttataaggtattgtccttcaaaccataccactcatgggttcacccttttacatgaaacgggaacggaattgtaagtggggtggaatatttaagtgggcccattcatctaatgagctgagctgccagttttggagaatgggctgttacaaatggtattagaaccgaccctcgcagttgtgcgcgtgtatgggacagtgcgcgggagaatggcacacgtgggctctatgtgagacatgtagcatcggcactggacgtatggacgcacactaaaaggagacgtgttcctagatatttgcctatttgcctatgtggctacatggataagttagaccgacgagaacgtcggatcctttgaggggaaaggggtgaatgtgacatccggactaatttcgatggtccatgtgtgacccatgatagctacgtgctcatttttagtaccacatagctagtttagcaagagtgtaaaaaacttataaggtcttctcgctcttaccgtaaaactcccgtgttgatcctttcacatgaagttaaaccgatgagaacgtcggatcgtttgaggggaaatgggtgaatgtgacatccgaactaatttggatggcccatgtgtgacccatgatagctacatgctcatttttaataccacatagctagtttagcaagagagcaaaagcttataaggttttctcgctctaaccgtaacactccgtgttgatcctttcacatgaagttagaccaacgagaacgttggatccttttaggggaaaggggtgaatgtgacatccggattaatttggatggcccatgtgtgacccatgatagctatgtgctcatttttaataccacatagctagtttagcaagagtgcaaaaaacttataaggtcttcttactctaactgtaacactcccgtgttgaccctttcacatgaagttagagcgaaaatgtaagtgggtggtatgtataaatgggcccatccatcggatgggctaaactgcacggttctagagggaggggtattacaaccactcacagtcccaaccatacaacatttaataggagtcctatattttttttctaaaccttaatatatgctaaataacccagaaacaattattttagaacggagtattgtaaccctagataccactacacgatgtgcatgcacctgttagtactcccttcattcacttttgatcaccatataagagaagtgcatcaagaccaaggaaacaaaaatcattctaaagacctatattccatttactgtgcatcggtgaaggtgcgttgtcgcttcaatggaagagtaaatgaaatagatggatggagtatatataagcctagagaatctgaagcagctcacatggcatgcaaatggttgcatgcatgcatgcacacacatatgcccccatttacttctaaaaggaccttatgtcacctagagagggtgaataggcgtttaaaacttttaagtaagttcgaaagctaggcttttcggatatttctaaatatttttggatatttccaaatattttccgattttttttttgaaaatctcatatttacaagcaaactagcaaggcaagcaaaaggggatagtggcacaattaggaaagggattgcacaaacaacaactaaactactagaggcaccaaataacaaagctagatgagcgagagagagatatcaccggggttcttataagatgttgtgttcccgaagttcaaatccctgaggggggttctactctccgttgaggagcccacaatgagccaggtcttttccagttctatcctcatgaggttgcacaaatgcacttcgccttccactaagggtatctctttcctttcggaggtgcgatccgaccttcacaaactccctcggcacactacaaacaaatcggtgtctcgaggttgactctagccgtctataggtgtcctccaccaccaagagtaacaaatgcaaaaaagatttcttggggataaatctcaacaaatatttacaaagttaacaacaagcactcaaacaaactaaaatcaaccactcacacacacatgtacactcacgaaatctaagcttgtagattggtggagaggaagaagtgagaaaggcaaggctcaaaagtggatctcaaggctcaaaagggcaaaagatttggaatggaaccagccaccttaacttggggggtggagggggctatttgtagccacggcctcagatttgtccgatgggagcaaatattccattttttagaaatttctgaagtgatttttgaaatattcgaaaatcaccagagagcaaaaacaactttcaaaacttgctacaataactttggaattttccgaacagtacaaaattccagcacgagcacagcagaaaactgggcaaaaaagcatttcggaaaaaaatctgaaaacacccgtactgattttgcgccaacactgcatttcgagaatttctgaagcaattttcaaaaattccgaaaaacaccagtaccgtttttgtaaactcgaagtagttcgggaatttccaaaatgacttttgagaacttctaacaaagaccattaccatttttcgaaggcaaaaaccaattcgggaacttcctaaatcaaatttagaaaactccagtacacaaacccaagagtgagaaccacttcaacaaagattttgagctccaaactcatcactagacatcaaggccacgttcctcttaatagtatggctttcctaccaaatcaagaacaaattgaaaagctataccaatacgaatacatttatgtcttcttgtttctttgccttgaacaatgctaatacaaaatttgacttgatcatcaacgaatcatatcctcttgatctttcgacatttcatcttgcacttcttcttcaacaaggattgatcgtcagcaacttgtgacatcctatggcctcgatcggttcaacggtattcggccaagcacttgctccttcaccactacgtcaggtcctttggcgccaagtctccgcttgcccttctcctatgcatggtccatcagtccactacgtagccaagtcttaccaacccttcaccacatctagccatcttccgtcacttgtggccttggattgcaatgaaaactcattgtattgcatattctttatcatctttatcagttcttcaccagactaatcctttgcttatacactcaataagcacactattcccctaatcgtttgtcatcaattaaccaaaacccactaggggcatagatgctctttcaatctcccccattttggtgattgatgacaacatgattaaagcttacaaagattgataataaatgattttgaatccaaagagctcccctcaatttgtgcatacaaatatatgaagtgaactcatatgcatatatattttagaatgtgagagctccctctaactcttggcgttagtggggtgtgttgtgtgtgacaagagataccaaaagtaaaaaaacttacaattcaaattcttggtatcgattcaaaatgtatcaaatgaaattcttgatgttgattgcaggcaaaagtttgaaaacatattgttcatttttttctcagaaatatccagaaagtattttttttgatagaattataatgttgatacgctgaaccattgcacgagaataacgtgcacggggaagacgcgagaccgagcagtctcgcgcggatacacagcgacaatgcggccaacatagcgacaacgaccgcggccaaaacattgattaattaatagtaattaatgattaattatcttattagaaaaaattaattaatcgctaattagataattaatcactaattaatcaatttgaattgacctgctgttgtggtctcgcttgttggttatgcgagaccaagcggtctcgcaacttcactgcacggtctcgcgccgttgtcgcgcgagacttcccgcgtcgtcatgtccacgtcattctcgcgcaatgattcaatgattcggtggtatatttctactaaaaatattgcatatggaatatttctaagaaaaaattgaatgaacactatattttcaaatttcattcgctgattgcaaaaacttgattctatgccaattgattccggtaccaatttataaagcacgaataaccaaatttcataatcaatttcaagtataaatatataatttcatttgcatgtggcatggtgatcaaataatacgcattgaatccatcacaccatgcgcacgctaattgataaacattttcaaatattctctctccctttctcatttaccctttggcatctttcaaagcatgcattttgataatttctcacaattatctcaccctttataataattctttataccctttaatatacttctccccctttgacatctaaaaactaaggcataagtaaggaaaggaaagcaaagggataattgatgaggaatcatcgagtattttcctctcaattttatatttcatcacttgtgattaggtaatgaacatcaaattgacacaaagatcacaagtaaatcaataagcattgagatacaaattttgcacataaaaagctcacatccaaagggtttaaatcatagaacaaaaagtctcccctttgcatgtcaaggacattcttattttcttcatttaatgtatccctcccccttagttctcctctcccactttggcatttaagcatggcaagaagagcatatgatatataatgatgggggatcatcgagatttgaacatgccaaaccacttcttcacaaacttgagtgagattcaagagttttaaaaagaacaactcacacaaattttcacaaagcatatcgcaaacggatttagtatacatgaatcccaaagattttgctaagtgttgatggctgttaagtaccaaattttcgccatcaatagctgcattaaaccataaatataaaacatccaacatagtggtaggatttatttctaataatttccacgagtgttggtgtatattcatatgtaggtgacaaactatctaagttgagaagaaatatacatgaaggaggatgagaatcaaactcgcatccgaacttatggagttttggacccaaaaacccaattaaacacctccaaatgggccaaacatccataccaatagaatgaggggcccaaaatgagtgtccaagccgaaaattggggccaacggagccggctagggatcgaccgaactctgagttctgccgaaccttgacagaggccactggcccaagcccaggttgcgttcagtagaaaaccgcttcccaatgctctttggaaaatggccgttttcactagtagaaactgtcataagcatggacacttggcaacacaagagagaagatgctctttggatgcttggaggatctccactctctcaagttacctccacactataaatacctctctcctccctcattcacaacacacttgaagcttgagcttaattacaagaggctttattctactttattgtatactagattagggagaggtggagtagaggaagtcggaggaattccagagttgtcgataatcctcttcttatttattttactctggcaattactctactttaatcaaatatcattctgaggaattaagatttattctatgagagttacctcttagttagttcctaatcaacgtatgggatcattgttcattatagtccattaaaatatagtgattgctttagtgagttataaacattaaagtagttattaacggtgtagacatggtgtttgggtagttaatttccttcgtatcccatagtaggtttgaggtaggtgaagaggtggtggcaacctgttaacaaccaaatttgacctgcactggagttaagcagatctctcaggcctcgtgtttttacatcaacacaaccctaagtacactaaagtcctccctacccggttacgctgtagagccatatctgggagcagcgggctggccagcgcctgaagtaccatgttaggattaaattaagctttctgtagacactgtctctcgctagtaaatcctctcttagcctatcttagctttgtgtccttggataaacctggagaagagctgacatacatgttcatcggtatcttccgtgctgacatacacattccctgtgaaaatcgatgccttggaatactctagagtgaagtgctgtattgatatcttccgtgcgcttgtggattctatttgtgacgttaagaaatatataccaacactaagacaaaattcacatagctagaataaggtctccgagtactttgattcccatagacaccattttgtgactaatactcgcttattgattgaacaagcatttcggtacaacattttgtaaactaggctaattagaaagaaatgaaacttagtctagatgcacaaagataaggcaagttattcaatcataccgatttaattaacaagttttagattatccgattaccttccttgacgattttcaagatgtcctctcaatgaaattgataccttatttcaattgaatttgacacccattgtcacacacaagacttgcatatttatatctcttcctatctccattttttaagtgccagttctttacatatttttcatattcgtaactaagtaggaactaacaaattctgctatttttggatttttttttacttttttgcgcgagaatttatgagtgccaacaaatacacgggacctatttcatcatgcatcgacgaactcatgcaagcacggagggtggattttaaactgttatttgcatgttactcaaatagttatgaaaaaaattgagaaagatgtattaatatgttatatgtcacttcacaatcatgtaagtttaaatttaacttatacatatcgcaacgaaaaaaataaattaaactacggctagttaacgtatattcacagtcaaatttggttttttagttgtgacacgtagaagttgaattttaacttttatgtttgtggagtgatatatatcacatgttgataaattttttaaattacttcagattttcttatattaatgacatataaacaatgagatggcatcccctcgagcgtttagaatagttacgtgtaagtacgcgacaatgggttctctcgtgcatacacgtcaggactccggacatgaacccaccaccattagcatctgacagataccccactgaagaaaacaaagatcaatttgtcacgatgtactcattggctgcacgcgattaattatggttgttttagaacatcattaaggagaaactaatacagccaaaaccatacgcctctcaaagatgcctctgaacgatacctcaatgcttatctccatctacactgttggacggttcacaagcctatttaaccagcaacgcttggcacactacgatcaactgcgagagtgaggcaaagaggaagtcagggaacggaagggttgagatggagatcagcacagtgctgggcgcaatattggcagagtacgcggtcaccttggtggccatggctgtgggtttcctggtggtaggctacttgtacgagccatactggaaagtgcggcacgtgccaggtcccgtgcccctgccgctcatcggccacctccacctgctcgccatgcacgggccggacgtgttctcagtgctcacgaggaagtacggccccatcttcaggtaactggcttctctgcttgctgcttcttctgtttctttaatgcagagctcagagatgacgaggataccagggtctattgctaactggatctagtttactttgcttgtaggtttcacatgggaaggcaaccgttggtcatggtggcggatgctgagttgtgcaaggaagtgggcgtgaagaaattcaagaacttccctaaccgaagtatgccctcacccattaccaattctcctgttcatcagaagggcctattcttcacaaggtagtagcaactagcagttgattgctttactttctttatttcgcgcaattttacctgaagctaaatttaaatagatttgatatacatccctcacttctacatccaaaagaaaaatatatatgtatacatgtttttattgcatgaaagatacacatatactatgaatgcgcatccttaagtacgtatagtacatatttatttcactaaatttctactaaaatcttacccacatgtttatagacactggtatttaaatcctagtgtacggacccatacacacatgatccaccacaatacctctcgggcctccccatttgcgagtatattttgtataaaactatatttaccaatttacacagttattataatttgacccaactcgattaagtgatatttgtagttctctttttctaaggataacatgatacctttttatatgtctggagcgaacttgttggattttcttcatatatactctcttataataaagaccagagaactttatccataacttttcttggagctaaattaaaagtagaattaaattttactagttgtatgttgcacatgctagtattcttaatgttataaatattaaaataaatatattggttatatttttgaattctgtctgtttagttagatttataaaagtcagctccagttataaaatgctattttaaatttgaatttcggaattgaattgacaaaataaatttattaactgtaaattcgaaattattaaaatttagaaaaataaatttaaagagcctgtagtatttttgtttgattcctttgagcgtgatcggccataacccattagttatatggaggggcaattttctatttgactctgttctaaagcccaattaataatttgaccccactttttcaagtttgtacatttaaccctttttcaaaatcgaagattaagacttaccctattccgtgaaaacaagataaaagtgttagctaagagataaattgttctttttgcccttgctcatttgaccataactgcataaaagctttttttattcaaacctttgacaaacttgtaataaattagcattgctttgacagatttggcttcaaactgacaaatttgacgtcaatttggcaaaaataaaattaacaaaatctcacataactatgaatgaaattttacaagattttcacatcatattgttttttccatcccaaattgaaaaaaaaacacagataaagcaaaatacagataaccatgccactatcgcccctcttccgtgcaccaccatcgtaacccctgctccccgcgtgtcgccacgatcgccaccgccatcgctctctccgcaagccgtcgtgacctccactccggcgcttccactgcgtgtcgtcgctcctgctctctctgcgcgatgctatagcttctccctccgcgcgccgccaccgctacctccacacaccaccgctcctaccacgtgccgccacctccacctcctcatgctgtcattgtcgccgccgccacctcacgatgttgttgccactgctccctcctcgtgccaccaccacccatgctcccatctcacgcgtgccgccaccccttctctctctgcgcgccgccgtcactgccatccctgctccctcctcacaatgccagccttgctctctccgcactgataccgtcatccatgctagtctccgaagatgaatggatgagaagaaattggggataggattattgtgttcttagggatatttgtaagtccagcacataaatgcattttttttttgttttttctaacatggtcaaacggtaatcccaatttttaaaaacagggccaaataaataagagtcactgatagttagacttcgaaatagagtcaaattagtaattgtcccttatttgaaatgcataatgttccattgaacttttacaaattattaggcctataatttttttacaagaaaagagagaatatgtcttagaatacattcaagaacatatgtcttagaaaccattctattttttcatagcaatatgcaatggaggtacatatgccatatagtagagccataaaaaggttttattaccctcgcaaaaatgtaaaatggttttattacactattgtttgtgtcaggtaggcactgaagagttctgatgtaaagatctagcaagggtaaaaggtccatcaatgtttaaatatttaaatagtactctctctctctccgttttatattataagttttcctatgtcatatttttaagtttaattattttttaaaaaatataatatttttaacattttatgttaaaaataaatatactataaaaatatattgaatgatggatgttactgtatatttttataggggcattttataatatggtcgaacttaatgatatttggcataagataaaactcaaatgatcactcgaagaagtaaaagtgttcgtgcatgcacaccgtaccgggccagcttccatccttggttagtagttaattactgttggaacatagatggattctaatagctcgaatggacgtctacccgtttattgtatgtcaactagatggttacgaaaaattttcaaaaaaaatgataaaatagatcaatatgtaatatatcactccacaagcatgcacgttcaaatttaacttctacaaattgtaacaaaataacaaatttaattgtaaatatacatatagtaatttgagttttgtttgttatttttgttacaatttattgaagttgaattttaatttgcatatttgtggattaatatattacatattgatctatcttgttcatattttttaaatttttttcataaccatttagatgacatgcaataaatgggtggacgtccactggagccgttaaaacagtttcccccgttggaactttataaattcacgaacattcaaataaaacatcagtactctttgtcgacagtggttcgaggtggacgactatgcgaaacatgatcctctccatctaccagccgtcgcacctggccaccctgatccccagcatggagtcgtgtattgaacgcgcggccgagaatctcgagggccaagaggagatcaacttctccaagctctctctcagcttcaccactgacgtcctcgggcaggcagcgttcggaacggactttggcctgtcgaaaaagttggcctcgtcggacgacgacgaggacacccgcaagatcgcggccgatacctgcgcggaggccaaggcatcatcggagttcatcaagatgcacgtgcacgcgaccacgtctctaaaaatggacatgtccggctcgctctccatcatcgtcggccagctcctgccgttcctccatgaaccgttccggcaggttctcaagaggcttcgctggacggcggaccacgagatcgaccgcgtgaacctcacgctcgggagacagcttgacaggatcgtcgccgagcggacggctgcaatgaagcgagacccggcggcgctgcagcagcgcaaggacttcctgtccgtcatgctcacggcgagagagtcgaacaaatcctcgagggagctgctcacgccggactacatcagcgcgctcacttacgagcacctcctcgccgggtcggccacgacggcgttcactctcaccacggcgctctacctcgtcgccaagcacccggaggtggaggagaagctgctcagagagatcgacgggttcggaccccgcgaccgcgtgccgacggccgaggatctgcagaccaaattcccctaccttgatcaggcacgccaaacccttcctcgacgtgtttatatcgtcagacatgaatttctgaccgcgcatcgtgcacgcatgcaggtcctgaaggaagcgatgagatattacccctcatcgccattgatagcaagggaactaaaccaacagctcgaaattggaggatatccccttccaaaggtacatccgacgatctttatatacaagtccatataggacatgacagggagaaatttctaggggacttccgtctagcttcacaaggtggtgggctagacgatctgggttcgaagcctcacccttctaattatttgatattaggtctttccttaatattcacatttttataggacatgacaggcttgctttcatgtttcctcttatgtactacttcagtatacatttcattcgttttttcagggaacatgggtgtggatggcacctggtgtcctaggaaaggatcccaaaaatttcccagagccagaggtgttccggccggagcgcttcgacccaaacggcgaggaagagaagaggaggcacccgtacgcgctcttcccgttcgggatagggccgagggcgtgcatcggccagaagttcgccatacaggagatgaaattgtcagcgatccacttctaccgtcattacgtatttcggccctcgcccagcatggagtctcctcctgagtttgtgtactcgatcgtctccaatttcaagaacggcgccaagcttcaggtcatcaagaggcatatataatgcttaatcacatcatcaggagaactattcgtttggattttgggtattgcgcatattattaagtactcgttttcagtttatgttgtactgtacttgttttcgccgggcagtccgtgttgtactcgtaatatatatgaaccacagctagcaaatctccgaggcataaagtttcttatgagtaaatatccgaatataagatttttcttctcataaagacctctataggtagaggagcaggccgtgggacatatcatgttgtacgatgaaaatagatctaataaagacagttattatgttcgctgtttagtttctgtgatattttgaggtgaaatggccacgggtgtttagtatcttctcacgcttctaaaaaaacatagaagggaaagataacaaacccagtggtcgccactattttacaatacattgtcagcagttttccattcacagggtttattgatccaatctactgttgttattattagatggttaagcctattttaacctttaactttgctcaaagcgtatatttcatcgtgaactacaaagtctatttttcattctcactttcaaattcaaaactgaaaaggtaaacactttcggatataatctctctgtcttggaagaaaaaaaatcaacttctgaatttgaatttggacacaagcctttctagattcgtagacagaagttttttttttaatatggatggagtatttagtagttgttttgcttcaaatggagatggtttccgtagtttatactcttattatgcatactttgttgatgaaaattaaataacacataattaggtctataagcatgaagtttgcctgactaaaattcatgctagcgaaaattaaaccactatatcatgtcgtctataaaaagaaccatcataaaattatatgcatgattttaaaagttattgttgaaaaaataaccagttttgtaattcaggtgagaaatgaactccaagcaaagtctaagggccaaaaaatagaccatacgtgtaaataagtttgctctgctctaaaattctcacattaatcagagaaaagaaaaaatagagttgaagtagtgtcaaggttatgaataacacatatctaaaagtaatcgactaagctcggcagggcctaccatatactaagttttatacggaatcatacctcgtatatagatggagttctggataaggaatgacaagaagaagagttctacatgaaaactatgaggactgatcagattatatccatatttgtctccctaattatacttggacaaagggacatctatggatataaatacaagaccccaaggaggagagagggacaaaccaagacaagccagcacagaccagcacgctcaatcagaatagacaccaatgcatgccgccagatatcgatatcagagataaacctagacagacccaatctggtaccatcagaggctaacaagagggatctagcgctatctctgatctcaccaagtctatattcgaggaggaagactgccctgtcgtcgactacatgatggtgttccatgccaccaagtcgacaatggctagataggttatcccaaatattgtacctgtgtgattctgatgaataagagcagcaccggtttcggccaacaggagtagggctattacctgatttcgatgaataaggggcctgaacctgtataaaaatccttatctctgcctcttttacctcaatttcgcatataccctggtaccaacgatccccataccatgcaaataccgtaatcgtgatctaaaacatcgacaagtatacaatttacgtggatccgctatacctcatatacttggatagaacaattgtggctacttctaaaagctataaaaagaaaaacccaacaacaatcaggttcgactttaaaaatcccaaagatagtaaataggaggggcaacatgctgaccataaaggagtagggtggtggtgattgacgggacatctatagctacaaagtagaacccctagtccagatctggccactccggtgtgagccgcagtggcttggtggtagtctgggcggtggtttgcaatggtgcgacgacgacggctctgctggcgatgggtgtgcctgtactgacctggtgtgggaggccatggccggtggcaggcaaagcttccgcagcacgggcacaaggcaagactaccgctgacagtgctccagcgggtccaatggcggcgggagctgaggcaacggggcgaggcgaccgcgatgcgaaagagcggcctgaggtggcggtgatgcgggctgtttggtcgatgtgttgacgatggtggtgttgtgaggttgcgttacaagcttgaggggggctccaatctaaatgatagtcctcttgtggtggcgccttgctgtcacaaaatggccacgttaggcgggctagtgcaagggagaggggatccattcttctctttccctctccctctccaacccaaatgcgtggatcgatttggagcgcgtccgatgttgagctcctactcaaaggtcgaccaatggcaaggtgttggcgcggtggccatccgtcgaaggtgtgcaggtggtgctggtaccctttttgcaggcaacctcgacacgggagggtagaaagcttacgggcagaagcctagcccttcagacaagcaatagcgacatctacggacgctgcttttcccttggggcattatttgcatgaatttttaggtttaaatcatgtcctagcgcctcagggcgggcggcggagttactcctggtgccgcatcctttctagaggtgtcatttagaatatcgttttctttagagatgatgtgctctgctttgatcttgagtagcgggttttggtttagatgctctatgcggcagacgcatagctagctaggcggcactgcgggccatggaccacctaaaaattcgatcaagattaaaactatcgcatactagcaaaagtgcccgtgcgttgctacgggaagaaaaaaaggagaaaat

SEQ ID NO: 41433 - DNA, 1220 bp, Oryza sativa
gtggcggaccgtccaccagcacccaagcgctgttgagccgtcatgaccaagttggccacgtcttccagccatcgttgggctggagactccgggtcatggacgacaggcgggtgtcgtaggagcgcgccagcaacctgaagcgcgccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggatttggttccccgtcgtcgccgctcacactcggagagagatcgtgcgcctttgcttgctcggccattaggcagaacaagggaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctttctatatgtggaaagatcgcttgctcggagaaaacgcgagacacggcggcgatctatacaggttcgggccgctgctcagcgtaataccctactcctgtgtttttgtggatttgtgtatggacaagttacaaaggattaactccctttcccctcagccttccaaaagggaaaaagtcccttctctaaatgggcaaggtcctccttttatatctcaaggggataccacatgcccctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccgccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctacagacttttgtcttgacgggatggggcaaggcgtgcgtcagaccgccagtcgccacctaacccgtgatctgaccggtctgtgactggtcac

SEQ ID NO: 41434 - DNA, 3142 bp, Oryza sativa
ctccaatgggtcaacatttgaattataatcctgaagcaacattcataattttatttaaaaaaacatctcagttgcaaacaatacatgaattctattttgcatgtttttggttttgtagggtggcactcaccaggttagcatgcatcctcttgacgaaagttttgaatgtgctgtagttctgtccctccagcagctcgtctgataatcggaggtaggtgaatccaaatagcttgtgctcaggaggtccattcttgttgatgcctgtcggccttgaattccttagtattgtgttgtaagctgttgcatcgtatcgaccgagtgcgttttcgcatgccacatgtaagccctctctccatccagcactcaggacctgccatttcatagttcatagccagaatattttgataagtgctcttgtgctattctagaagaagagcaatgcagaagttctaacttatagaccagtaagtactagtatgtaatagtccgttatttacctgttggactagttcttctggtgcactctttgcctctgagctttgttcagaatccctcatctcagcacatgtgaagttaacgcaggcacggtgccttgtgagcatgcgtgcgatggttctgtagccatctctgttgtccaagttgtagtatccagcagtgagctcagctgcatggtttggaaccctatccacaatgaatgccggagatctgccagcaaacattggagcatgtgtcatttatgttctagattcaacaattaatggaacattatatatatatatctgttgcctattcatctagcctgtagtctaatttgaaatcattgaagtcttcaaaattatgtactataattcgccgagatctttagcatgatacttactttgattgccagctgcactctgcatcccaagaagaccttgtttgcttcatccaagatcttgtctccatgttttatcagcttgtttgagtaccatgtgaggaagaacttccccttctcagtgacatatgttccattatccgcgaagaaccgggtcttctcgggagtgtcattgtactctccagcatcgtcgggcaattcccattcaggatgcccagcctttgctgcttctgctttgaaatctgcctccaggtatttatcatagcactgcagtattttttttattgtaataactgttagagcagtgaattactaccatttgtcatgcattttgtcccatttcatatctgttcagcatatttagaatttgatttcctcttcttttgttgcttaatttcagtctcaggcttgcttctactgttttttttttttctgttagtactgtttttggtccaaacatctttgtgaaccagaaccactttaatatttgtgctcattttccaaagattttttttcctaaaggagatctgcaattggaccatgattgttgtctttggtcatcagccatcacatggaggagaatatttttatcaacaacttatttataaaatgagggcagccataagaatctttactctggtaaagactaaagaacactcactatgaattctcctatgcctgggaacacccatccctggctctgggggtaggaagggtatctcatctcaccagctggaccaagccccacctcaatgtccacaatgacaccagtatccaagaactctgccatgttctccctgaagctcttcatgtagtcagcatacatctgtcacagccacagacaagagaagaatgtaatacatataacgaaatcaaaacctcatttttatctcttttttttttctaaaattcatcggactccatatgtgcaggtggtggtggggcttgcttatcagctaaaacctggatggcagttcttccatggaagagaggctggtcatccactccaagggtgaggtactcgatgttcctcgccccaccacggttggtgtagaagatgtcggggtcgctcgcgccgacatcccgcacccactgcgggatcgggatgttgacgatgtcgccgacgttaccaccgcactggtggaacgacatgatggcctgcagcttcagcccggcctcctgcaccagcctgaacagctgcttgtaggcctcccagtcgtaggacccggggcccttcccctccaccagcccccaccacacgtccaccatgacgccatcgacgccggcctccgtcagcttcttcagctgtgcccgggtctcatcgaccttctcgaacttgttgtccacagtcaccacatccagctacatatctcgcaacagaattcaggtcagtgtaccacaaattcgctcttcttgagcttgttacagaaagtttgtgcctatgttaatgttaatgttgccagtgctgtgactaaaatttgattatccaaatagaactagagcttacggggagcatgacattgacttgaacatagttggctagcaagttcccggccattgtcgctggctgtgtatgctctgagaacactagcttcactgtcttgttgctcactgagctcggcttgatgaaatatagcaggacgctcatgggctatttatacttgcaaaaaggagaggggggctcttctccaccggcgggaaccaaccaatccttttcttccaggtacctacttcctctgagaaaattagagatggtgtactatgcccactatgaactgaatttggttaccgcccctgtcatcccaggcttcgatagttgatatcattcagcatttcagttgttgtgcacacattttgttcatcctcgagtaccatcgattcatgcttgcttgctgcagttcagcaggctcatggtatggtaccgctgtttttacctggttaaaagttttactatagctatgtacgtcagcttgcagtcatgcacggttctcatagggtggttaatttctactccctccatcccaaaatataaacacttttagaatagtacagagtcaaaatatttttaactttgactattaatagctaaaaaataaaaatatcaatgatgtaagaataatatgactagatttatcattaaacaaactatcataatatgtaactctttttatttaaaccatcttatttttgtaaatatttttagtcaaagtaatatctcaatgaccgtgtcaaagttcaaaaatacttatattttaggacagagtgagt

SEQ ID NO: 41435 - DNA, 1668 bp, Oryza sativa
ggcgctgacgtcccagccctgctaaaacttcagcaaaactttgcacacaacacaggcaaacatcaaatgacagaaatttacaggcagtaatatatccagagaaccatacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataagccatgttaagttatcgcttttggaagaaaacaccgtagtttcatctctttccaacgattacctgtagggcgttgcggagggtgccgccctctccttcggagccaggagccgtgcctagcgccactcccgcgtcgttgaccgtccgcaagagctctcgagccctgtagattgaaatgaagtaagtcacaacatatatggcattgaaattgaaataatatacaacattaatgctagaaacgaacactctgtcgcgaacaggtcccgtctcgaccgtggtacctagacgggtacgagtatcgtactcgttctgctcctcaacatcctcggggtcatccgctatgtcggctagtgtccaagccggacgtaggacaagacagtaggtccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcaccttgtcggtgatatgggaccgggagtatcatgaccagaggcttgaggcagacgcaatcgcccacgtggcctggcaccttcggggacgtcgggcccgaaggtgaggtgtccgccctcctcctgatttccccagggggggggg

SEQ ID NO: 41436 - DNA, 15950 bp, Oryza sativa
agcgccggcgtaatagccggcgtaccccccgtgcaacggagggtgcctcctcgtccagagtgtcacctcgacatggacgtgaggaccagccctccgtgcccccggctggtggtgttggctgtagagcctttgtggcgagtcttcggaatgtccgttggcccccaaggttccggcccaccatcactgagaagtacgatgggagcgtcaaccccaccgagtttctccaggtctatatgaccgggatcgaggccgctgggggtgacgacagggtcatggcgaatttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagcttgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggcggttccttctggcaaacggcgaagtgaggccaagcagaaggcccccgctgttgacatcgatgatggtgaagatgacctaggtttccaagaacctggggccaccattgccaccgtcgatggaggagcgcgtgctcacgtctctcgccggagcttcaaggctatgaagcgagagcttctggccatggcccctactcatgaggcgatgcgtcgggcgcggtggtcagaggttgctctcactttcgaccagaccgaccacccaccgtgcattgcccggggagggcaggttgcgatggtagtttcccccaccatctgcaacgtgaagttgggacgtgtcctcatagatggaggagcggctctcaacatcctttcccccgcggcctttgatgctatcaaggccccggggatggtgctccagccgtctcaaccaatcatcggtgtgacgccggggcacacatggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccgtggcgaccttaaagtcgcgctcgcttgcatggagcagcgcgcggaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgccgtgcggccgggcgcaaggccggtccgacagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcggcttaaaaaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggcctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacctttgtttaagctcctcaagcgctcggggccgttcacttggacggaggaagctgacaatgccctcgcccagttgaaggcgtatctcagctctcctccggttctagtcgccccggagccaaatgaacccctgctactttacttagcggcgaccccccaagtagttagtgcagcgttggttgtggagcgcgatgaggacaatcctcattctgcgcacccccactctgtgccgacttggcccgggagcaggcagggaggagaagcccccgagtcggacggtggcctacggcccctgacgaccggagtcggccctctgcccgcttgtcagacggtgctgggtgcccccgacccacaggaaggccccgaggccactgcgggaaggccgcacctatcgccctttggccccgaggctaaccctgtgctgactcgacccgggagaaagcagggagaagaggcccccgagccgaacggaggccagaggcccctgacgaccggagctggccctttgcccgcttgtccgatgacaccaggagcccccgacccccaggacggctccggggccactgtgggaaggccgctcctgtcgtcctccgaccccgaggtcatcggcacagaagacgagtgcgccccaaggggccacttggacgaagaacgccccggggatacggcccctagcaaagaagatcggccccaccgaagggtgcagcggcctatctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggctagcacgaacccctcacagctgcctcatgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccgggctcagggtggcagccgggttggggatccgccgcctcctggtgttaggcgactctcagttggttgttaaccaagtctgtaaggagtaccggtgctctgatccgcagatggacgcctacgtgcgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgttggtagaagggaccctctatcggcgcgcggctaacggaatcctcctgaagtgcattcctcaggaacaaggcgttgagcttcttgcagacatccatgagggcgagtgcggagcccattccgcctcgcgtaccctggttggcaaggcctttcgtcaaggattttactggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagattgataagcactctgctcttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtggtcggtgtcccccggccgggctcggtacggctggccacgggcgacggcacggagctgccaaacccgtggaacattgaacaccttcgtcgcttctacccttgaagggggggggggtcgggtgtcaggttttggctcgggctaaccccgcacccccctcgggtgtgccgggttagccgggggctaccacacatgcacagctttacttttcgtatttcagcatttcaataaaagaagtttcaatttcctaaaggttgtgtctgtgccgtttttccttctgaagaatcttaacttgaaataaggtcactcgtgctcaaccttaccctcgggggctcggttcggtcagctaaaatcgccaaacggggcccagaaccgagccgtgccccgggacgtggtgaactccgggggggaaccggcaaaaacccacaatcgggtcacccatacccctcggtcaccacgttcccggcctggccagtctcgacatgcggacttgggcacgagcccttatttcaagctaaggcgcaaaaggaccatggcacagatcatcctcatctcatatatagcaaaataaaactaacacaaaaattttttttcatcatttctcattgcagattgagttaatttatacaaaaaagaggcatgaaggccttagaagaaagaacaagaaaaaagttaagattggcgggggcctgggggctcattccaatgcgcccgggtcgccggcctcgtcgccgccgtcatcctcatcgctggcgtcgccctcctcgtcggagctgggggcgaacgcgagcagaggggccgacccctcgaagccgtcgacgatatggtcggcagcatcccggacgcgcgcgcgcgtcgtcctcggtcccgggagggaactcctccagcgccatccagggagagaaatcggggtcccgggcctggtaactcgctagcacgagttcgaccgccccccgggcgaggtccctcgaggatgacttgatggtcttgtcgagctccacggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgctcgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcacccggtgggccagcgcggctctctcggcacggacgcattcaaggttgcggcgcgcctgctcctcttgcgccgcctcccggagggagaggctgtccgccagccgttgcgtcgtggcctcggcctcctcgagagctcgctcccgctcagcgagtgcatcctcgcgaaggcggagcgcggactcctcctcggcgcaggcggcctcgtgcgccgccagcgtcgcctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcgagaaccccttgggcggcgtcgagcttgttcttcaactccgcctcccagctcccgtgttgaaggcggagggagtcctgcgcctcgatcatcgcggtggtggcgacgagggcggcctctcgctcctcctccacctctcgggcgatctccgccagcgccgtcttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacttgggcgctaaatccatctagcaccgcggtgtttgcggcggccaaggcctgcataatgggctcggcgctcaccggggcgacggaagaggaggagaagagccgccttggagaaaatgcgacgcggcttggccccccgaaggatgcgctgggctcggggatgtcccccgggcccgtttggtcctgggcgtcgcccggtgaggtaggcccaggcgatgtgcccgcggcctcgtcgcgagcctccccggaggctgtcgcctgagggttgcccgagggagtgggcccagttgacgcgccagcagcagctgttgcctcagcctggcgagcccgggcggcctcctccttagcggcttcctcagcccgggcggcctcctcccgagcagcttcctccgcttggcgaacccgggcggcctcccgggcggcctcttcagcttcccgaaggcgatctgcggcttcacgccggtcagcttctcgcctccgctcttctgcggccgccggatcttcggcctcggactggccggacttggggtggcgggaggagtgcgacgggacatcgctgaagcagaagaaaaaaccagaagacaaacaagatgggtaagagaaaacttgtttaatgggatagaagaaagacggtcgcaatgagaatggggcgaacctgcgaaggggtcggttgaatgaccactttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccaacttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccaacataatggttagaatggagacgcggtcgggatcgatgcagagggggaggatctcctgaggaaggcgagacgcctccgcggagctaagattcagcaccctttggactacgatcttgaagtcctcgggagcccaatcccatctggctccctggtgggtccgcatgtagtcttcaggcccagtgtactcccaggcgctccgggcgcgccgttggagcggcgcaatccgacggcggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcattactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacctcgctccctcgtatctcgttatctcgctccctcgtttcccgtgcccccgcttccactaatcccattcgcccgcttacggcgcatgaagtggatatgcgttggtggcaatcgaaacggattgtatcgtgcgcgcgttaattacgctcgccgaccgaagcggcgttaccgtatctccgggcgagacaaatctgctcacccagattcgcgcgctgctcaagtggtgtggcagtcttgaatagaccgcccattatgaacaaccaaagttaccaatatcaatgtgcatgaattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcatgctgcatgcaacgcagtacagcgcgttcctttatccggtctgtgaccagtcacagaccggtcagatcacgggttaggtggcgactggcggtctgacgcacgccttgccccatcccgtcaagacaaaagtctgtaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggcggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggggcatgtggtatccccttgagatataaaaggaggaccttgcccatttagagaagggactttttcccttttggaaggctgaggggaaagggagttaatcctttgtaacttgtccatacacaaatccacaaaaacacaggagtagggtattacgctgagcagcggcccgaacctgtatagatcgccgccgtgtctcgcgttttctccgagcaagcgatctttccacatatagaaagagcttgagatctcaccctaagcccccggccgaaccggcaaaggggggcctgcgcggtctcccggtgaggagccacgagctccgtcacacctgtaaccggaaattaaatggaatcattagtaattgcaaaaaaattaacaaatgaatacgaagactcgttagtaattccctgacgctgtgtcacctgtgactgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacatgttagtcttgttctatttatctgagctaaattacgatatttgtatgattttcattcgatgaaacagtatgttagtttaaacgatagttactttttacgagcagtgaaataaaaatgaaagagcgaactgagtaatcaagaataatataaaatcataaagattgaaaacaatccttggagcaatgggcagagttggcgatacttttttttatagtttgcaatcaatattatgacaatttcattttgtcctcgacaagcatttgattcagaaattgatcatgtacaaattccctgctaggtacagttccatggtaatagaagctctttgtgaaattggggatccaaatggttcggatgttgatgcaatttgccactacatagaggttgtgcatctgcacaaattttcttatttggtatcactatttgccagtagttatttttatttcttctgaattcattcaagttttgttcgttcttgatttcgtaataaattatgattcagatatgtgtacaactaacatgatcagaatattaacaaaatgcgattgcttgattctttttctcttctgaatcattgcctgattgactgtatggtataaagtccctcagttattggtatatatgtgtgccattgtgtttatttcagcttcctatactttaggaagcttctaaaagtgcctttgctactaccggagctttcactttggattttataataatttcctgcacaactaccatttcccatttcccgctatcttcctcgcataatcaatagctgggtacacatttagggcctctgcatgacgagttgatgactatgcataacattggttggaggatagggaagcctcactgagctgcctcactgagctatcttctcagcatttgttttgatttgagggaaatttgcgatttaaagattttgcaattataactctgcatcaagcccataattcagattcttcattttacttctcttttgtaaaattggcattcaataactcaatttacaattattcattgtggaactgtgcaagtggtagctatctaactacttatgttgacatttatctaactacattatacttttgacatgattcgatcataaaaataatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttagcaaatgaatgtcatccaatcccacctggtaagatcctcgaattgagttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattgacttcctcccttaacggcacattgtcctctgcatgtacttcttcccttaacggcacattctcctctacatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtggactttcattagggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcgcacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttgggtaacttagggtttatagaggggtttaccttctcttccgatcccaaactcaatgccgcacaaatcaccttcgattagagaggtttttgggggagattgggcgaggagaactcggtggcgaccgaaccctaggcgggcggctggggaaaaaacggaggaagaactggctggggcggcctcggccgggctctaagtagccaaggtcagcgccaacttacttggcgctgaggttgggcacctccgcgccgaagcggttggcgctgagttagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaaataagtttttgaaaagggtcaatttgtcaaaaaaacggtggtagcgagccctgtgcacttccgataagaccgtgtttccatggtaaaatgcgcatccgatgaaacatataatgacagaaattaaatcctcattatgcaaatgtatcaagatgtttccatggtacggggcactctgaaattactatcttccatcttcagttataatcctgttaatttgtgtttgttgtaataatattgcaggatgcattcggtatattgttaccaaatgccaataccatggcaaaggtttgcagatgtgtgcttttctagctttcggctaaccatagaactgattgttttgtacgtacatacgtgccgtgtgttagggcacaacagaaatttgtttggctttggacgcgcattgccgccaaaccctgtgcaagttcaaaccgcggagttttttccgatcgggatgtaccaccaaccaaatttcgttctccgcgattcaggattattacgttatgcgttgcaaatcttgaggtttgtttagagcttggaagtatcgcattatatatgaaatgtataaaatcttgaaatgtatcgcattatatatgaaatcttgatatatacatttcctgtaggaattatatatgaaatgtccgtgttccaaatgtgaccgtgtattaaaacccatatgcaggcagattattctgtagcctgacaaccaagacagacaacactaaaatggtaaaacggtaagtggatggctccaagtaaagaggggaaagattagtaattatttttgacattatatcataacccttttacgactactatctacaagacagagagtacatgctgtacatcatatatgtaatgatatgcctataaacgtgttgcccttgtaacacatgacatgctatactaaacaaatgaaagcaaaccgcataagagcaagtttaatagtaccgccatcaactagttataaacatgtagtacatgtcatccgaggggtcagtatcgtttgtgatgaaaggcgaacccaggttcgccgttgttgcatccagaccatccgtacttcaatcaacggcggcatggtttagcacctcaaagacgattaacagctaattaaataatataacaatttttgtatattagtccaattaattaacaagatcggttctgtctattaattttcttataataaaatactcttgtacaacaaatacagtttagttttttcaaaataaatgtttaatttttggaaggattttagcagtagagttg

SEQ ID NO: 41437 - DNA, 12304 bp, Oryza sativa
aattttatgaagaaaagttagtacgtatagacttttcctttatttatttattttttattctaacttgctattctctgtcctatcctgtgtgttctattgatggggccatatagcaatattattagagaaaaaaaggacacggattagcatcgattcctgtaatttgcatatagcttcttgtgctgcagctcagcgctcgctggagcgcccgttgccctctccctccagctttctctctcctccacctatgaatctggatgacgtggcactactaccgccaactgagtgtggcttactctctccatctacttttaatagtcatatttcatcttggcacaatgaccaaggataagtaattaattctacttatcatccatttaaatatgatactaattattcctcgtaaacaagcgattcattaatatttacatttctctatgcccatgtagccaatcttgtgtagaagaatggagagcaacgcagtaaatccgataaagttattaagaggataggtggttgaattgaaatatgtctatcaaaagtaaaatttccagatttagaaatatatctattaaaagtggatggagggagtattaaacttgctctaaatccatgaccttgattactgaactctcactacttaaaaaaaaagatttttctatacgagaacccctttaggttgcagacggactgtaagtgacggcgtcggtaaaaaatgacctttattttcgcatgtagctccttaagacacccgtatagaaaaatcgattttccatgcgggcctcttaagagatccacatgcaaaaattgtatatatcaaggttttaaccaacaagtaaagtctatatattccttatatatttgaaaggaattgaaatgatgaaaagtgaaatcagagaagtattgttctatacacactcattattattatcgctataaattcaaatggattaaatctatatacggattaaattagcacgatgagaaggtactgtcgcgtgtgaatatatacctttatgtaccaaatagggaaccaaacatgcctcaaagttctttttacttgtcgacaccaaattacggttcgatcgaaaaaatcagctgttacccaccgtgcattaattagatattgtacatagcttctttttttttgaaaaataatgggtgaaaatatggtctctatatttatactaccttcatcccaaaataaatcgtgtagttcaaatctaaaatatactgctacacttatttttgaacaaaaaaggtattaagggtttatatttaattttatgggatatcctatcgatgtttgtgcggtagctttgtcggattgccacatcccctcgtgacatggaagaccgaaagtgatcattgtgtgtttggacggctggcttgcaagccaagctacaaaagttagcgacaaatattaattacttgcccgtttgaaaataaatggcatcgttgttttccacagtcattattcatttttttactagtaattaaactaaaaatatatgtgtttcacaattgaaaatgtttttatatattgttaattttgtagttgttgataatatatttgaaaaaaaataatgatcaaacaagtccgtgtagaaatataatactgtcttatatatatattattgagtgagggagtacattaatttaagtcctctcatttaggagtagtagcttttgtgattatattttccgggcgttggatgatgcattcttgtcaacttgtcatggtctctatttagtgtgaggacgtgatcgataatacgaattgaatcagcagtgataactgctatgataattaattttgttaggtcatggtttatcttttgacatcccctattgatttaagagtgttctaattgtgcacactagcgaacagacaagtatgatatactaggtgaaaccccgcgcattgctgcggaaatttagtatgataacaataaaaaaacgtgtaagatagctagataacatcagattaaataaattaatgtggtttatgataatttaaatttaaatagtatgtagaatgacgattcaaacggaaaaagtaaggtggtatgactttatggaagaagaaaagtagggagatagtttggaccgttgattaatcatctaaaggctaaaaacaattgatgtgatatgatttaattagaggaacaaaggagaaagataatttgtaccatagtttaatcatttaagcattagctaagtgaagatgaactatataagtatataagatatcataaaacataataaagatatgcattgaaacattgtgtgaattatgttggatgataatttaacatgcttgtatttgaaaagctcttagattataaaaactataaagttatagcatgtttgcacgatgtttaaatgtgatgattgttagtgggtgatgatgtggcatcttgttaattagtggatgatgatatgacatcttgctagtggatgatgatgtggcatctttgcatattaagcttaggagttagtgggggataactttatagtaagataggattacatgactatctgtgttttcgtagacatcttaattgtaataagcgaattgttgagttagcacaaattattagactcgacattatattttaactatttgtttcacttaaaaagctcataagggacatccttatatgcatctgttcatataaaactggaacatattagtcttttcctcctctcatgcgcagacataaattcgaaaaccgacacctataacaacttataagtgtcggtttgttttaaaaatggcacctacaacataccagctttttaaataataaaatgatacttttatatgggataaaagtgtcatttttttattaaaaaactgcacttttagcctggagccgagctgtcaaatctgctctttttttactcctctttctcatctcctcggccttatctccttgcgcacgcgggctctctctctcgtcccttctacctctctaatgattcgctgtctcccctcctcttcgagctagcaagcgatggaaaacggcccgcctctccacaatgccttctcatcccgttgccattgggcatggcctcggccacatcgaaaggaggctgtcgcaaccccttcagcctggtggccaagtcagcaaatccagcgtcgtggtggtaggggcagtcggatccagcagtcctcaatctatcacatgatggctgcggtgatgcatggtaaggagtcaaggccgccatgagcttgaggacaccatgagctcagaattgccaaattcggctgctacgagctcgagggtaaccagatccggccttgaaggtgatgggcaggtgggcagacaacaacggtgagcagcggcggcatcagccttctctccttttgcgtcctcctctatgtattttttttagtgagttcttgatgtcaatcgatcttggaagcaatatattattcttggatgttgattacgtgagatgtgattattgtgagtttgttgttattggttgtgtattgatttcacgagtgacatggttggatgcgcttggtgcatcggttcaaatcaaggcgatacatcgagccagatttttttattcggggaacctcatatgtgccgattcctacaccgcacctttgattcttcctcatcattgctgcctacgtggtgccgttggggaatcaatacttatgtggagtttacaaccaattgccattataatttctgatgtagtgtttgaaaattcgggacaacatcgtatttcaattaaaaactaatgtcaaataaatttggctgagggagtatgttttaattttaaccgtagttactcagcgtaccaatcggcggctatacaactgatatatatgtcatgtcatgaatacatgagtaaagagtaacatggtgacagaaagaccaaaagtaaaataaagttggtgctaaactaacaatataccaatgcgttttagggctgcttcccccgtggggccaaggaaagattctcggatgggtcggtttttcgtattaaatttccaatcatttttttattttaaaattccaatcatttggcccaatacacctgaaaaattaaaaaaaaatacaggattcagaatcatgtttgagagtgcacgttccatcgtggatgcagaatgtctctataaaaggaccttgtgttgattagtagaatttaaaactactgctgctcccacctcccaaaataaatttatttttcacctatctcatatataccaaaatgactagaatacctctcttttaacaaatcctaatccaattagtattatttactttatctactcccaatataattagtttctgcttcacaaacatcgatgcaatagttacttaaaaataaacttattttgaaacaaatgaaaggatcataaaataaacttattatgagacgaagggagtacctcttacgcactgtagcttgtttagatccaccactaaaaataaaatatttagaagcccatagatcacaaataataggtcagctctccacagcaaacagaaaatctcctgcagaatcgacccaaaaaatcaggccctcttaaattgattatgacccgtgagggtatcatatcatctatttattactcccatagttcctagtaattgtcagcgtcggtaggcattgttacaatttggaaataagagatgattctccctcatgctccctccccattaattttgtattataagttgctttgattaaattcatagaaaacatatgtttttaacacaaaacaaatatattattagattatatttaatgttagatttaatgaaactaatttggtgttttaaatgttgctaaatttgtctataaacttaatcaaactttcaaagtgtataatatgaaacggatggagtatctattatcagaaatggtttgaaatggttgttttaatagtaatttttttattaaatggaaaacacacatgtgctttccctcttaataacaaaaaatggtttactttaaattgcgatgaacaaagttatacggttgtttttacgtatttttttcacgagagcaatatatttgatattgtggcatgcaattaattaaatacttacaaatttattactaacaatagagtgatcaaagtttcaacagaaaattatatcataaaaagaaatgaagttatgaccatttggtcgtttttaaaaatattatttcaaccctgccagaaaaacccccaaaattagtgccaaaccctcttgaactgaggccgaggttagtactataataagaactattcttaaaataaatttttaaaaggttaaaatatcataatttcagtaattgggacgcggcaccaagtcaccgcaattgccatcaatcggcatccataacactgtagctgtcgaatctcacggcttacgaagacaggcatgtacggaaacattctccctccgtcccaaataaatgcagttttgcattattcacgttcaacgtttcaccgttcgtcttatttgaaaatttgttataattagtattttcattgctattagatgataaaacatgaacagtactttatgtatgactaaatattttcaaatttttcacattttttttaaataagacgaatggtcaaacgttgggcacggatatccacgtatgcacttgttttgtaacggaggtactatagtttgttgctgcggtggcacgccagtaggagtacgccactcatcacatggctacctacgtacgaccacgtaggggtacttcgtacgctaccgacacagtgggttggtatagtccattcactgtagtattgaatgaatgacaacgatttggaaaaacattgttacttaataatggtagttctatgattctgatgtcctcgtgatccaaaatattttagaacggggtattctaagcttcccaaatccgtgaatatatgattacgttggttaatcatttgttctcattttaaataaaataaattttagaattttaaaaccactataatttaacttacaaactttataaatctatcatggatatgagatatgaagccgtgtcaaatataacctgagtattgaatgttgaatcttatccaaattacgttcagtaaaattccgccaatatcatggcgcacatgttctttccttttgaatacgccttaagcgatggaagataacaacaaacctatgacctaagaaaagttatagtaaaaagtaaaaacacatccacacacatgtaagaggatatatccgtaaaaacaagttaattgttgaaaactcgtaaaaatcatacctaaaagttttataaattcatgaaaaaaagatactaaagatagatgtcgatataaaatatattcttaccaagtctcaagttcaaaatcaactttatttaggagtaaaaaaaagacaaatttcaaatgaatagtaacacatgacactatctacccgaaatttgtttttttccttaaacaaagttgagtttagatttgaaatttgatgataatgtatttcatatctacatatatctgtagtattttttatgaggttaataatttttttagtatgattttcacgagtttctaatatttagctcattttcgccggatatgtcctccacgtgtaattgcccgaacaagctttttcttgttcctattaaaaacacacacgacacatggtacaccactttatacgcactcactagtgtgcccctggcgcatatatgtgcaatcgcacaatacttctttttactacacaaaatacgccaaacacaataattaatgtgcatacactcgtaaatgtatctataccataagcttaaaaaagacagagatcaatacgacaaagttttgacctcgatatatcctattgaaaacacacctacgtatttggctaatgctttctagtaacagtcttgttgttgtaacctacagtatgtatcaatataattaaacttctccctatcttaataaatatatgtaggccagcttttcttctgtcggcatggtaaaaaaacacgcctacttatcaataatattcgtgtatattagaatctgaaccatagagaatggtgtcatgtaagcatgtaattaaccacatcttcaccataacatacacccaatactttaactatagatgaatcatacaagtcaaggcatatatcccttccgtctaaaaataagtgcaaccatgagtttctatggacaattttaatcgttcgtcttatttaaaatatttttcaaaaactaaaaaacataagtcatgcatacgtactattcatgttttataatctaataatagtataaatactaattttaaaaaaatttaaataagacggacgatcaaaactggacacagaaatttatggctaatcttattttgggatggagagagtatattagatagtaatagctcgtagggttctgattttctcagatttttgaattaattattttcttctcggaatggctgccacgttatcctttgtgcgacttctcgattgggtggatagcattggtagcacgcggtaccacggtgattatgttgttccccaggcgtggttatgctccctcgtgtcccggttgcattaaccggtggtgtccggtaagggctcgcaagcatgctacacgcatcttcatgtatttttgccaaaagaaagaatccttggtaccttgaaaaatactccctccatctattttttatggtcatatttataaatctgaaaaatttatttttgataggcatatttcaatccaacaacttatcatcttaatggctttcttggatttaatacgtgactctccatttttccacacaagattggctacatgggcatagataaatgtaaatattaatgaatcgtttgtttacgaggaatgactagtaatatatttaaatagatgataagtagaatcacttatccttagtctgtatgtcaagatgaaatatgactatcaaaagtagatgaagggactagtaaagtaaccctttcaccacttttactccgttataaattttgtgaaaaactctatatacatttgagaaatataacacgaaaaagagaagattatatttttagagatggcgctataatactaagaagcacaatgtttttttttatgcaaaacttcctctcaaacttatcttgcctggtgtatctgtatactccttcaaaggtaagtgggtctcacttgatattgagtgaaccgtggcctcaaacgcacttcccatgtcaccagtggcggacgtagcgttaaaatataaatggggcggaaaacgaagatgttcactcgataagagtaatcgaacacgacacatatcgtattaacagttcgttcgtataagtagataagggggtctcgagagtatggggcgacacgagccgtagctgagtcggtcgacccaccccgcctaatgggtaaatccacccctgcatgtcacagatgccgttgtgagtttgcaactatatatttcctctgtcttaaattaaactaaaatctactacggtatgtaatatattctagtacaataaatctgaagagtaaaccgatttgtttaaattcattgtactgggataaagggcctgttcactttactgccattttcaaccttaccaaattttagtaaagttgccaaaaaagtggctacatttagtttgctaccaaattttggtaactatataagaaatcatgtcttgccaaaattttggcaactataccaaaatttggcaatgccaaaatttgataaggtttttttttggcatcaaagtgaacaggcccaaaatctattcagatttatttactatgatgcatcacttgtacaaaattcgtttattttggtacttatagagtacgtggcaatactccaattttttcctgacgcacacgtattccagcaaggctaacagaatatccactcgaccttgtcgaacacccagtcgatcaactcggcgaggccgccgccgacgctcatgtccgtctcgccgtcgaacggatacggcggctccggcgccgtcgcgtccagcagccgctcgatggccacctccggcccagacctctccagaggcctcatgggcctcccgtaccgggccggatccggacagcaatcctgcacaagaaagcccatttctcaggcctccttttatgggcctagatttagcccatactaactggcaaaatgggcccaaacctgatcggcgtgcattttcctgacgaaggccttgaaggcccggaagttggtcgccgtcaggagctcgtccgacagccggaggtacgtcacggcggcgacgcggcgcggcggcgcgccgccgccgccggcggggccgacgccgttgggccgcgcgttcagcagcatctggttgtacccgcgccggtcgtgcctgctcagcgcgttctcgcacgccgcctcgacgccctccctccacgccgcgctcagcgcctgccgcaccagccgctccggtgagctcatcgcctccggcggctgctccgagtcccgcatctcggcgcaggtgaagttgagcacggcgccgtcgtgccgcgccagcatgcgcgcgacggggcggtacccgtcgcggccgggcacgttgtagtaccccgcggcgagctccgcggcgtggctcgggtgccggtaccaccagtggatcccggacaccttcgcggcgagcttgaggctgcagcccaggaacgccatgttcgcctcgtcgaggaccctgtcgccgtgctcgagcagcttgctggagtaccacgtcaggaagaacctcccggcctcggtcaggtacgtgccgccgtccgccgcgaagaaccgcgtgtcctccggcgtgtagttgtactctccggcggcgtcgcccggcagctcccactccgggtgcccggcctctgtcgccgccgctctgaagtcctcctccaggtatttgtcataacactgtaacatttacaaactgaagtgactgacaccgaattgtaaactaatttaaacgtttttaacatcaagaatttaaaatgttaattgcagaaggaaattgatcctacctggaactgtccgatgccggggaattcccaaccttggctctctgggtaggatgggtatctaagctcacctgcagggccgaggccaacctctatgtccacgatcaggccagagtccaagaagtcacccatgttctctctgaagctcttcatgaaatcggcatacaactagtgtcacagataaacaatcgatcaagtcgattagattatcctaaatttgatcatatggttgtgatatgtaattttgcaatctcaatgtaacaatttatgaaatcagtgtacctggatggcagtcctgccgtggaacagaggccggacgtccacgccgatggtgaggtactcatggttcctcgcgccgccggggctcgtgtagtacacgtcggggtcgtcgtcgccgacgtcgcggacccagcgcggcagcgggatggtgacggcgtcgccgacgttgccgccgcaggcgtggaacgacatgatggcctgcaccttgagtccttcctcctgcgccacgcggaacagctccctgtacgcgcgccactcgtaccgcgccggcccggcgccctcgacgatgccccaccacacgtccgccatgacgccgtccacgccggcctcccgccgcagccgccgcagccgcgcccgaagccccgccgcgtcctccagctcgttctccgcggtgaccacgcccagctgcgcgccacgccacggcgcggcgccgctcgacacgatcagttcgaacgaaagcttgaggagattgcgtgagctcggagcttaccgggagcatgacgtagacggggacgtagttggcgagcatcttctcctcctcctcctcctcctcggtgagcaatggcggaggctgcggtgaacgagcaatgcagcaggaggcaggaactcagtttgaatcaagaaagttcgcgcgctcggcgtgtgcctaggtacctcgggtagaggagaagcctgttcgctctcagcggcaatagcacggacccggagagaagccgccgtcttctgggagtcggcgacgagccgccgccgacgccgccgcccggttgccggcggtggaagaagaggagcaggagacgccgctctgctccggcatgtccatcgttgctgcagcctgaccggctgcgacgatggcgacgaggttgtaatcatgatgggcagcagcgaagctgtccgggctatgtttgtccaaatttgaaaatttttgctagatgttcttggctttgtccggtgaattctcggcatatatcgttggcgacttggcgtgccatgccatctgcgtgacacaaaaatctgtcccctttttggcgatgtgtgttgggaagaattgagcaggtgttcatgaaggtgtggtttgcgtgagctctcaagcgtgttttttttttttctcccgttaagtaagaggctcataccatttcagtttctgcttttctagtggtgaatattgagggttcagaagaagctactagctgttgttgtctgtgcttttggttttggctttgtgcagtgatagctacagtaagggtgtgcgttcaacatgcgagcaaatggcagaggatggctgcttccccatttttcaattccacctgaagaaaataaaatcgatgttttcccaaattagaggatgtctttattatttcccaaatattgaagatgattatcgtaaaagaaaaactattagtatgacaaaatataaattaagataaaaatacttaaaataaaacaatacttatatcttttttaaactaattggccgaacctctttgtttttcccgaaacacatatactcacccttataaatccacacatacgcacaccttatccctataaacaacttctttaataacactaaaaaacacaaaacactctcttctgttttcagaaaaaaaactttcttctgttcaagaataaatacttcaccttttatccgagcaaaaacactctcctgggctctacgtctctattactacctccatttcatgatgtaacaatttttagctacttgttatattttgtgacggaggtatggtaagctaagggcttgtttggcacagcgtggagctggagctcagccaaacaattttagttccatctaaaatgagagaagagttagatgtaacgctatcacaaaataaattagatatgtgaagctgggtttaaactttctttccaactccatttcagaaccaactcatgaaacaaaatttaagttgccgtagcactatcactccatcatccaaagcctatgtccattcagcccattacggtctggcccaaagtccgtatccgttcacctcgtgctcctatcccgct

SEQ ID NO: 41438 - DNA, 9557 bp, Oryza sativa
  unsure (1)..(9557): unsure at all n locations
gcggccccacccccccgcagccatggcctccccggagggctccacgtgggtcttcgactgccctctgatggacgacctcgccgccgccgccggcttcgacgccgcccccgccggaggcttctactggacgacgcccgctcctccgcaggcggcgctacagccgccgccgccgcagcagcagcccgtcgcccctgccaccgcggctccgaacgcctggtaattgcggggtttacggcctccgatcgcgctccagccagccctggctgggcccggtgccgtggtctggggtgctacatttttttttcgtcctgatttgtcgcggcagcgtgttagtgcgtaagttgagactgggtatatcgtgatcgttgctattgattgttcgattggaggtcgatagaagcgtatcatatcagactatcagtgggattcggattaggggattagccattgagtgtgtctgaacatgtagaactagttacgtactccctccgttttctaaaatatgacaccactgacttttcaaaatacacttgaacattcatcttattcaaaaaatttatgtaattattatttgttttattgtgacttgatttatcgtcaaatattctttaagcatgacttaaattttttatatttgcacaaaaattttgaagacgacgaatagtcaaacgtttatcaaaaagtcaacgacgtcatacattaacaaacggaggtagtataacttagtaggagccgtcagcctgttttactgaacagagggctcaattcctggttatattgaattgtcagcttcattttcaaatctatttatttgtgtgcatacgtaatgtatttaaacctaatttagggcctcttcatgatttataattctcattttaattgtgatgcaaatgctgcatagcatagcatatatagtttgctaagcatgcattgtgtcatgtttatctggtgtcatgtcatgggatagttgaactgaagaaaacatacaccataattgatgatgtttatgatgccactattgtacaagattcagtttgccgtgtaatattacaatataagaactgataacaagtaaaccaaatggtgtcaaattggcgtggtggtgggagggtggatggttgtgatttgctgtaggtccaactgtctgagataccagattttaaaattttttgtatctatatgcaagtaaattgcattgacatgatattttgagccaggtattgagatttgtcctgagctttccagtggatttttcaatgaatgatctatgaaggatcagaaacggggtgagagaagtggttaatctgtatcacttgggttccagcacgaagcttactgtggaatggaaatttattgaagaacgtgttcatgttaggatattgtttactgcaactctttgatttaagagtattcttttatttatgataccttgtagtcttgtggtgctagtacattttctttatgcaccaggaagtcatctcatgtgtttttaaatctgtcctggtttttgacttgtgcttccaccttctggtgccataggttgtggtgttatgaaccacacagtgcatcttaactgatgtattgttctgttgtgttaaatttgcttgattcttttgttgtcattgtatagttttttatgtacttattgctgtatattatcgtgacatatggcatactgaagtacaagtttatttttttcaccagtgctgaaatcaatggctctgtggactgtgaacatggcaaagaacagccaacaaataaacggtttgttcacatccattatccaatctacatttcctttcctgttttcttttgatcatttctaacttggcaccacaaaacattagtccgagatcagaaagtggcactcgaccaagctccaaagcatgcagggaaaaagtaagaagggacaagttgaacgagaggtaattttcgcatcatttttaattcaacccatttttctggttgcagcattgttttttctaactctaaactaattcatggacttaatttctgttaggttcttggaactgggtgctgtcctggaaccagggaagacacccaaaatggacaaatcgtctatattgaacgatgctattcgtgtaatggctgagctgcgtagtgaggcacagaagttgaaggaatcaaatgagagtctccaagagaaaatcaaagagttgaaggtatgtctttttattttctcttcataattatttgccatgcatctatttttatgggcacccccgcagcagctgtgtacatattgttgtctaaaatgtaatgacaatattgatagttttgttggctcagcatggtgttaaccttaggttatatggtttgtatggactataaagtgtaaatccaaaggacaaactaagcatcatgtccttcaattttgcaggctgagaaaaacgagctgcgtgatgagaagcaaaagctgaaggcagagaaagagagcctggagcagcagataaagttcctgaatgctcgaccaagcttcgtaccacaccctccggttatcccagccagtgcattcactgctcctcaagggcaagctgccgggcagaagctgatgatgcctgtgattggctacccaggatttccgatgtggcagttcatgccgccttctgatgttgataccacagatgacaccaagtcatgccctcctgttgcataagtcaaagcaaagatcaatttgcctcgccttgtaggaaagaggtgaaactgccttccattcaagcccagtttggtcgtcagtgtttaaactacctagctaatcccaggattaaaccgaagcttcgctgtatcgaagtatcaaccggtgacatgtgaactgacgaaagatgacaccgttgtatattacatattagtaaataaattccatctgtccaattaaatgagaattagatgccatataattatatcccaccgtgttttgaccattgagaagcataattgggttattggtggccatgtccgaagaaaaggaaaacaatatataattgggttattggtggccatgtccgaagaaaaggaaaacaatatgtgcgctgtttggtgcaacgtgttcacctcacagcaagacgtgctctacatgctccctggcatctatggtattagccgtcagggaataaaatattccattattttagtaccattttgcgatttttctccttttctttcatcggcatgcaatcctgatcatgttcagggagtttgctacttgtaatttgcctaacatgatctcctcgcggttcaaattaaattatctttgagatgcttgtgtttaattccaggtttgccttgtactcaacaaatcgaatagcacatgtaaacacaaacattatgttgatcaacgcagaaaattttactgtttagtaatatagcagcaaataccttcaaaatgaaacagcaagaatcttctctttaataaatggaactgcaaaatacagaagggcttatgtatacacaacaattaattaatacacagcaaccctcaaaacgagtaacaaaacgcctctggtgcaagagaagtttcaccacacctcgataaatatacgtagaaacccgtgtatttacgtacgccacatgtaaatagtaattaaaatcaataagaaatataaaacgatattaatttctttttatatcgtttaggcggccatggccaccagagcagccaaggccagcccggccacggccaccgccggctgcttccgatgccgcggcgtggacgccgcgctgctgctcgggccggccgccggcgacgacgccgagttcgacctgtgctgctgctcgtcggcgggaggcgaggggagcggcgccggggaagggccggcgtccgcggcggcggcggcggcggccgaggcggagtaagggacggtggtgaccttgacgtgcatggtgccgttgaggcagtggcgcgggatgctgcagatgaagtagcgcgtgccggcggcggcgagctcgaaggtggtgttgccgccggagtggacggagacggggttggtcgagacgcagccgtcgtagtccgtctcagccggcacctccaccacgttgtggtacggctcgtacttgaacgctgcacgccattgttgatctcaatgatgagctcgtttgatcaatcaaccagtaattaattatcgatggacaatggcatttgagatagattaagaataagaaagctattagcatatgattaattgtgttttaattatttacaataaataaataaatttagttgatattccaaaacgacttatatagaaattatttgcaagaaacatatcacgtactagtagtagtttgaaaaacgtgctaatagaaatcgagagaaaatgtacatcttaatcagaacggggtctacgtgcattgcaatggaaattaattacttatggtgtcgccgacgatgaacgtctttccggcggcccacttgtcgtagtcgacgtaggtgtcccagccgtaggagccgccgaccgtgtagtccttggccaccgccgtcgaggccaccgccgcgaccgccatgacggcggcgagcaatgctacggagctagccttcatgcttcccttgtggtagatcgatcgatcgatcggctctctctgatgctgcggttgtcgtcgcctgatcgatcgatatgttgtcaccagcaagcaatggctgtttatataaggagcaagaacaaggcagaactagatactgctctcttctctttttttttttttctgttaagtaattggggccagtgtttatggcatgcatgtatagaggagttgttgtgtagatgatctggagttgcttcccgttcattctacaaaattggaatcaaaatgatttaattgtgcattgcacgttgtacctcttgagttgacttgtatattatatatagttccttctttttaatgaaattgcttctactctgcagcatgactaagtaataaatttacctacctgatgtcctcatttgcattcatggccattcaacatttccagatcaaattccacctattgtctttataaacaaaaatagaacatgtttaatcaattttgtttattttccaatattattttttctgagtatttttgttaatattatggtaattgatgccattatgtgtttctacccaacatatgtattctgattatgttaatgcgagtattctgtgctggtggtggtggtagggtcaagtaatctaaatagtacaagtagtactccctctaatagtactcccggtttttaacataggttactgttgatttttgtcgtacttctaccatttgtattattaaaaatgttaggtaattattattcattttattgtgatctattttataaaaaatactttaggcatgacttttttttcatatttgtataattgctgaaaataagacgaattatcaaatgtatattcggcaacaatacagtttaaaaaaacataggcatgaccaaaatttacagcttttgggttgccaaggactcaagtcaacacaatacaaaccaaaagcatgtctgtagtttgacttttcggaatcactattattatttcttctcgctgccgatttgatggaagcaatccatgcaagttttcattgattaggcaatggaataatcaactaatcaattttgcagaacgtgaagagatgttacttgccccttgcagttgcaggttttgcggacacactcgactcgattgtgcgttacatcatcgactatcagctttcatggtcgcaaagagaacttcattttacacacatacaactcgtggatgtggatcagttcttgaaagaaaatgcagcactatggtgttgcctgccctatctttgctcacacaaataaatcatacttcctccatttcatattataagactttttaatattaccgacatttatatagttgttaatgaatttagagatatatatacgtatatatctagattcgttaacatttatatgaatatgcgtaatgctagaaaaatcttataatatgatgaaacggagggagtagtaccgttgtatctttcgtaattgctccgggttgcaaacataatcgctagttttctttttgtttttcttactgggatatctcacggaatttcgatccccttgcgtcgctggtgaggtcgatggatattggttgcgaatctgcgatggagcggtgacattttggaccggcatgcgccgtttgatagtatgatggcctgtaagactgtttgggctgtttgcggcgcctagatgggcttttttgttttgcatgcggccaatcagagctgcgttcgaaacagaggatgtggctgagtttttcctggcaggaaaaatgagatgagtagcacataattaagtaactactccatctatcctaaaataactttaactttcaaataatttcatctttcaaacaatgattgtattgaaatttgagaaattaggaacacatgcattaggcctagataaaatgagagacaattgcattaggatttgataaagttgagggcattctaatctttttttctttatattggtatgtgtgaatgggtgaaaaataaagttattttaggatggcgatagaattagctattatacacttgaaattggatttatttgatttttaaaaggaaactagcaaaatacccatcgttgccacataatttaaaagatcacatcagagtattacagagaggaaatctattttgagtttcagagcttagtttcaggggatgctataaaaggaatcccgttcggatgggatggcaccggttaggtatcagatgatgcttaccaagtatcatacgattcttactaggtatcaggtgatacttgcattgcgaggtatcaggtgatacctttaagtatcatcttatatctaggtgttggtacctgttgataccacatgatactcgttgataccagagtggtacctacaagatattaggagccgagcattgaggggaggagtgactaggagacgaagaggacgttggtgacggcgtaaagcttggccgtgccaagttcctagacgcgggcgccgctgccacccttggtgtgcacctcctagatgtggcgtcgctaccatctccgtgaagaaatctattgcccgaggagctccactaccatctcccgcaaaaagaaatccggcatctgaggagctcattcgcacctgactcttggaccatcgccgctcggctattggacatggcgccactaccatcgccgcgaagaaatcatttgctgctgccataggagaggaagcaacactgcatacacaaagaaacctgtcgttggcgatgtggtaggaaggcggcactgtgtcgttggagggaaggagtggttgggaggtgagaaggacactagagatcttcgacttcctggaggagtgggaccacctcaactgggcgacctcattgtcttcgtgaggagcgggtccgccttcatcccctccatgctcaccatggaattagggcaacccgtgaggaggatggtgaacaggatcccgtcccccagcatttatgtagttttaaattaattagggattgtttgttcttatgttaccagtctcgtaaaaaaataatccagttattagcggcgtgcaaggatgatcatgattgagagctccagggtctagtcgtgacttctactcttctattgtatgtttgatttggagtgaaaatagacaatataagatgatagtagattcaccgctcactaccaccacaactaatccctttgagaataaaaggttatctttaataaatatatcgtttagtagttttgcgaagtgtgcttgcttaagatgatagagtagctcaccccaacttgtctttagaatgtgtgttactagagggagctttttccacgtttatcatgagcacacttctctaaacactaaacggtatgttttccgaaaacattctatatcgaaggtctttcaaacatcagataaattaaaatttcaagttctcaattgatcttatcctgatcacttgcaccgttttattatgtgtagtcgataaagctcacgtcgattcttgatttgaacataaccttagactagtgagagcacacataataataaaaataaaagatgatgtaagcaagctatacaggctgtagaattagatttgtgctgaccgctgtgttatagaggagaaaagagaaacaaactactactactatctataaccaactagtaactatataaagtacagggtccaacgagctttacgagaaaagagaaatgataggctagatattagcagttgcctatactttatactccctccgtctaaaaaaaaagacaaaccctgatttccgtgcccaatatttgaccgtccgtcttatttaaaaaaattatgaaaaaaattaaaaagacaagtcacgcataaaatattaatcatgttttatcatctaacaacaataaagatatgaattataaaaaaatttcatataagacggacagtcaaagttggacacggaaacccagggtttgtcattttttgggacggagggagtagatggcaaaaagcccgaggccgaacggcccggcccacggtacggtattttggcccgatccaagcatggcacggcccgaccatggggaccgtgccagcccggcccgaccgccggggcgtgcatgggcctccccaccggcacgttgggccagcccggcacgaccgggccagcacggcatgacgggccggcatgccaggcctggcaaataaagaatagggagtagaaatagacatattatataccactgtccaaataatagtgatgaaaaaatagacttattttaggctatatatatgctaggcccaaatagnagggagggaaaatacacttatggtcattatatatatatccagcccaaagaagagggaaagaaaatagacttattttaaaaaggtatgatgggccccgcgttctttcgggccggcacggcacggcccgactgctggtgggccgtgcctaggccggaggtgcagcccatgggctggcctggcccgacacaaagtgccgatcaggccgtgccggcccgatggctggtgggccttggctagccgtgcctgggccggaccttatggccatctatattatactttgctctgatttgggctgtgagcctcactcattcgacggccgacgtaatgggtgaactaataaggaaaaagtacactcaaggtccctcaacttgtcatcgagatacaaaatcatcctcaaaccgcaaaaccagatatctcgcatcccttaactaatcaaaaccggtcacaaaaggtccctcggtggttttgaccccgattttagcctacgtggcggctgagtcagcttgggacccacatgggccccacatttctttcccctcctatccctccacgtcatcatctcttttctcggctagcgacaggcgacggggaggccggcgatctctacaaatctagcgtcagcgtcggcttggtggtggcggcgaggcgcggggaggccggcgtcggcgtcgccctgtcggaggaatcacggtgcggcaacgtcgagcagtcggcttggcggcggcgggcgagcggtggcggggcc

SEQ ID NO: 41439 - DNA, 2587 bp, Oryza sativa
  unsure (1)..(2587): unsure at all n locations
agcagcagcgggttcgtcgggtgggccaggatcatccgcgggcagtgcacgtgggngtngcagcggcngtngggcccttccccccccccccccgccgccgccgttgcacaccttcctcccgctacctcctcccccgacgccctcctcgacgactgccacggacgccgcgttgccttccctccccctcccatatccgcgtccagcccggtgctcgtcagcagccgccgcagcggcacagccgccccgaccgactgctcggggcccctcacgtcggaacatctccgccatcaagagcatctccgccgacacgttcgtcgccgacgccgacgccgcctccgtcccacccttcggattctgggctcccagatgcagctgctgatgaggcgattcctgaggtcgccggcgttggtggagctcggcggcgggagggagggagcagcgggggtggtgctggtgtctgccgtcctcatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctatatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttctttcaccttcactctttgctcgtttgtatcttgatgccccacagatagggcagacatccaagtcagcgtattccttgtaatacaaaatgcagtcgttcggacatgcatgaattcttttgacctccaggcccaacggacataatacttgcttcgcttcatatgtcgtctgaggtaaattgttcccctctggcaacagatcctttaacagttcaaggagttctgtaaaactcttgtccgaccagccattactagccttaagcttcatgagttccaacacgcatgacaacttgctgtgcttcgacttgcatccatcatacaacggtatctggcaattttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctattttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatcctctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacc

SEQ ID NO: 41440 - DNA, 9366 bp, Oryza sativa
cagcgtcgtgggcagcggcagcgtctcgaccagtgtggcgcaggtgtcccccccaacggccgcggcgagggcgtgcgacggcaagagcagcaggaagacgaggaccgtcagcgccacccgagtcagagtccccaccctcccggtgcccaggacggcgcccatggatgatcgctttgcttgcgtatagtctcgctttcaaactctgttctttgcgttggcacttctctgatgctgagatgagatgtgctcttcgcttctgagatatgtgagatgcttggattggtggcgtggtgctcccgtgcctttataccagtggccacgtccaagcttcggacaccgactccgtttcgtatctggggctgaacagtgaccaccggttccgatttgggtgttgaagtagcatttagctagtctaatttcggattcttagcgtaactagtaactctgtactccgtagtatagcaaatattctgattagaagtgggacgttgatatccgaatttgtcagggatactatatctgacattctgatcgcttcatgtaggttttctgcttgtaatataattttacggactaggctatgtgtttttaaaagattattgttcatcagattattcaaatgaattatttactccacactttgataactaagtaaataatttaatttagagtgaaatacatggccggtctttaaacttgtgaggtggtgtcacttagatccgtgaacttgaaaattacacgtttagatccgtgaacttggtttaatgtaccaccccagtccaattgtcctttgaccacgtttgaccaccaacatggcatgtcatgtaggcaatgcttttatgctcagccccctccacatatatcttcgcacataacttgccctgaccagtgcatttcaacccaaatcccctaaaaataatccctaaatcgactagggcttcggtgaggttagtggaaggagccgagaggtagcggctgtggcgacctcggtggtgagattagcggcaggaggcagcgcagtgcagtggggttagcggtggcacagtgcggccggattagcggcgggaggcagtgcaatggcaattgctaattgggaccgtattttctatacacgcaaggagaagaatgagagggaagaacgatttgaggatttttttttttggggggggggtggggggtgggattctggtgtcactatatagctacaacgagatatatgcgacgtgttgtgatgtagagggggctgataacaaaagtgttgcctatgtggcatgccacgttggcggtcaaacacagtcaaaggacgtttggaccggagtggtacattaaaccaaattcacggacctaaacgtataatttttaagtttacggacctaagtgataccactacacaagtttagagaccggccatgtatttcactctttaatttatcctgagcagtaatcaaagacacacacaaaaaaaaaagcttaagagcggttagaaatccgacctcaagtggatatttatacaaccataagttacattcttaatctcataactgaaatatataacaaacaataaagaaaaactaaaacactagcttcaagcttttcctccttgcttcaaacttcaagacaaagcagggctacgtctttccgccaccctgcctcctctctgttcttgttgccatcacataagctcctatgtttagttaagagcaaagaaaagggacggaactagtccgactagacaccttgtcgttgctaagcaccccacctcaatgcgaatgagcacggcggtacccatgttatcgtcaccgcagagcaccacacccgtcgagctgccgtagcttaattatctcaccaaaaggattgcgcgcgccgttgagccgccatagcttatctcatcgaagaaccgccacaaccacgccatcgtcactacaaaccgcgacctctgtcaagccgccgtagcttatctcgccggagagccacccctgacctgcaccacctctgccactctccctactgccactactgcattcgacgtcgctcctaacgcacttctccttcctgacggcggcccaacgtggagcagaagggggaagaggggtggcgccgatcaaatggaggggaaaggaaggaagataagttatataagggtcactaacgggtgggccttacaggataactcagcaggttggaccaagtcaaaggccacgtcaaagaaattgtccttcaaaattgctgagggagtgagattacaccggttttaatagttgggggtttaaaatatctgatattgcggttcacggatataaatttgatggagctatattttgagggactcaaagtgaacttattcctaactgagggcgtaaattgcccacgacataacatacgtcggctggaaactaagcccatataaaattatatctgggccaaacatacatccatatcaaattcaatgcaggcctaaccatccaaccttttttcatgggctgacattagatccagatccattcatacacaggccgaaattaagcacagtctggactgtaaacaaggcaacaagctgaggttaggttcgttgtaaaatcggagtcggaatcggatcggagtcggtatccgaatcgacgacgtggatgtggctaccggtataaaggcacggccaccgctctccaccaatccaagcatctcagaagcgaagaacatctcaccattacaaagcgcgaagcgaagaagagaagctagtttgacagccagacgaagcaaagcaaaggcgattctcaatctcattcatgggcgccgtcctcggcaccgggagggtggggactctgactcgggtggcgctgacgatcgttgtcttcctgctgctcctgccatcgcacgccctcgccgcggccgtcgcgaaggacacctccgccacactggtcgagacgctgccgctgcccgcaacgctggttggccctgagagcgtcgcgttcgacaagttcggcgatggccccaacagcggcgtctccgacggccgcatcctccgctgggacggcgccgacaaaggctggacgacgtacttgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtttacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgctcgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaagtgagtcagatgctgactggcaaaagagacatagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctctcgaatggcttcatacttttacttcgagatgtcttttatgttccttctttgcaaaggaacttaataagtgtatcaaagttggattttgatggatatgattgccgctttggaaatggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccttagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagattcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgggacaaggaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacagtactcccacgccccggggtacaacgtcg

SEQ ID NO: 41441 - DNA, 22074 bp, Oryza sativa
ctcgacgtgctccagtccggaatgacgtaccccaacggtctcgcactcagcgccgatcggagtcacctcgtggtggcgctgacggggccgtgcaagctggtgaggcactggatcgagggccccaaggccggtacgtcggagccgttcgccgagctgccgggctacccggacaacgtgaggcccgatgggaagggaggctactgggtggcgctgcaccgcgagaagaccgagacgccgtatggctcggacacccacctcctcgccgtaaggatcggtcgcaaggggaagatcttgcaggagttgagggggccgaagaacgtctggccaacggaggtgattgagagaggcggcggcaagctttacttgggttcagttgaattgggtcatgtcgccgtcgtcaaggctagcgctacttgattagtttatagttgcttttttcagagcgcttattttgttttagatgcaagtatcaattttcggccgaactacctatgtaatagtttgcatttcatctctcctgggaatataggagtatgctgtatattttgatttcaaataaaactctaacttcggatagtcacattttgcggtgcctgttcaacaatcctgatatttaggacgtggactttattttttgatacatagtgtattgaaatgctagtatattcgcacgaccgtgaattgttagctgtaaatttcttttagtaatataagataacttctcacatagaactgcgattgagcactacttgtcatttttgtttcttgtaatgtagcgtacatcttagtgtaaaatcctacattagtatatctatatactagttctactacatacgtcccaaataagttaatattttacccatcctacacataccaataatactccctccgtctcataataggtgacgtttttgactttttatttgcaacgtttaaccattcgttttatttgaaaaattaatgcaaatataaaaaaagataagtcatatgtaaagtacttttgataataaagcaattgacaaacaaaataaataataattccaaaattttttgaataagacgaatgatcaaacattgacaaacgaaaactcaaaaagacaagtaatatgggacggaggtagtaataataaaaagaaatactcctaatatatcaaatcccaatgcaattcatctctttatctactcctaatctattatattattaaaacagctttgaaaggaggccccacgttcgctgtgggagctagaaaatcacacattaatcggagaaaaagaaaaaagaaaaaggagagtctaagtagaagtacaatttaaaaatagctgaaattcagaattaaaaataagcaatattgaaagaggagtccatataggaacccaatatgagattaatcaaaattcgaaataaagataaaataaaatccaaaattagaaaaggacatgagagttcaagtagaaatacaatttaaaaatagctgaaattcggaattaaaaataaggaatattgaaataagtttccatataagaacccaatacgagattaatcaaaattcgaaataaaaataaaataaaatccaaaattagaaaaagaaatgagagtccaagtaggaatacaatttaaaaatagctgaaattcggaattaaaaataagaaatattaaaagaagagtccatataagaacccaatacgagattaattaaaatacggaataaaaataaataaatctgaaattagcaaaagaaaataaaagaagagttcaagtagaaatacaatttaaaattagctgaaattcggaattaaaataagcaataatgaaagaagaatctatataagaacccaatacgagattaattaaaatttagaataaaaataaaataatatctaaaattagaaaaattaaaagagagttcaagtaggaatacaatttcgaaacaactgaaattcaaaataaaaaataaaaacattaaaataacacaatacgatattaactaattttttttaaaaaaattctaaaattagaaaaagaaaaataagatttcaattaggaatacaatttataaataactaaaatttgtgataaaaataaagattattgaaagaaaagaccatctaaaaaacacatgacgatataaattaagtaacatgcctataaaggagtagagtggtggcggttgatacgagatataaaaattattaataaaacaccaagtagaatcctaatgacgattaaaaagagggacgtcaggcaggccatgaagcaaatgagtaaggcaaaaatgagtaaggcggttgccgggacttctagaaagtaaaaaaaaaacatcgatgatcatattcaattttaaaatgtcaatgacaataaaaaggagaagcagcgggcggggtgtataagagtatagttgcagagccgccgatggttacgggacttctagaaaataaaaaatgaattacaacaatagttatgttcgatttttagaatcacaatgacaaaaaagagttggcggcgaacgggctgtagaggggcatagtggcatcgtttgatgggacttttaaaaattataaaaaataaaactacaagtccaatttttaaaggtttggaacttctaaaaagtaaaaaaattcaatgataatcatgttcgattttaaaatctcaatgacaataaagaaaggaggcaacgggcgagccatagaagagtacaatggcaaagccgctgacggttgggcgggacttctaaaaagtaaaaaatgaacccaaacgataattatgttcgatttttaaagtctcaatgacaacaaagagaagagacagtggacgggccgtagaggagtataatggcaacgtttgacggtacatctagaaattataaaaataaaacctaacgtgacaataaactctaaaaactataaaattcaatttttaaaggttctaagaagaatgaatagaaatagtggtagatcaaacaaacaaataaagaaggatatgacataaggggtagcaactggtgtaacttttaaaactatataattaaaaacacgaggatgataagatttggtattttaaagtcttaaaactatgagatagctaggtagctatttaataaattttaagtaaaattatactaaaaaatatatgattttgtttgggtgctagccgcgcaattgcgcgggccacccagctagttaatacaattattctttacttttactaattctgatgcaatgattcctcccaaaagtaaacttattttgggacaaatggactgagctaaaactaaacttaatatgagacggaggaagaagttaacactcactaataatcatgtaattgaatagaatacaattaggctaatcttgcgataatctatatctatactaatataaaaagtaggagttgcctttttgcaatcgtacgggtgaaatcaacatgttgatcctaccatccatctgtatccacgtccgcatcactctcatccctaccgtccagtgcgattcaccctcccacagcaatcccatcctatctccaccgtgattttcgctcccatcaccgcgcgaggactccgcccgcgctactcgctactaccgctatcgatccccttcctgccactcccccgcgccaccgaatctccctgaccttccaccgccgccgcgtcctcctcctccccacgcaccgccgctgcatgcctctcctcctccccatcgccttcgtgtcgtcctccttcccactcaccgctgctgcatcgccttctccccaccgccaccgcgtcctcctcctccccacctccttcgtgtccttctcctctccatcaccgtccccgagtccccttcgcgagcgcagccgtcgtcgtcagatccgccgactgggtgaactcggcaacggtggtccagtgctcgatccccaacgcatgtcgcgccgtcctgtccaccgccgccgcgtccgcctccccatcacccgccgcttctgtagtttctatagctgctccgttggtgtgcagcccacaaaccctagcagctatcagcgtggccggcgacggcgggccggcaagcgacgatgcagtggcaacaacggcaagcagctgccacgtggcaggctgcagcggctcggcggcgacagcgaacagcaaggcacgagcagcaggagtgagggggcgaggagctagcatatcaggccatccatccatgaagggcatcagacagcgaggggcgagcagcagcagctagcagaacaagtggtgagtcctcgccccgtgcctctgttcataatctttgtctctgatttcagtaatgcatctagatgatgtgatttacaagaattgagcttcatgatcatagttttgatttattcatagattttcaatggagaagaaaataacattgttaaattattattcaagcaattcaagtagtacccatcaaactgatgatagcagaacggaatttttgctgattgtgcacaaattaagaataacaatagacaatttttctcatgaaattagagatgaaataaggatggtatatttgttggtaaggctatggaagcaattgcatgatgctgctgttgcaaatgaaaacttgaaaatgtgactacattgcttattttagtgctggatctgccaattttacattcctccgctgttgctacgcatccatttgtgctagatcgcctcttccttctcagtccacatgcagagacaatggagggtgagggagaaggccacagtgctgtcgcctatgctgccatgcttctgtcgactgtcggactccatcgtaaagtggggagcggactgagaatctgagatgatgtactccattgccgatagcccgctcacctcgcctctaccgccaatcccctccctcactgctcacctcctgctctaccatgtgacctggtgctttctctactgtcgcctgctccccccctcatattggtcaatgcaaaggtgcactaataatccctttgttttagagatttaattgagttttatgtttcggatgctccagctttctaccagaagtacagaacacacatacatcagcatgaagatgagatgattcaggttgttgaattgctttgctatcatcttcatatatttgtttttccaagaagggcagcaggtcacagctgttgatgcggccgcctttggtggtgttcacagttcttgaactgcaggagtaatcggtttgctaacacagacctgatctcaaggtgctatgcagcttccagtgaatgtattgtctttccatgatctgcacatccaccttggcaactctttgcttcccaaaattgattgcatgtgttgcatatttttgccgatgcagaaatcagatgtttttaatgttgtatgtcctgacggtttggcaacaaatatatccccagtatatttttgagaactatcctcagtatctcacggtattatttcatttgcactctaaatgaagaattataaatgcaattttcaatttgatttacctttgtacatgattcaagattcagtgcagcagctgtagtcttcatccccatattagaaagagtgtatcttaacggtgaggtataatcctaacgttatacattatgctttcatttgctcacaataaaacttaaatgacgttcaatataagttcacatattgttctaaaagttttgttttgcagattggtaaaattcactcatatatgttgtcagttagctcatgtcctattgatgcaaattttgttgttctcctctctctgcttggcctcggctcactcacaaacacctcctgtaccttgcccattcctctgcaacttaatttacacttgagggccatgtgatggtccctggcacctgtgtcttttttttttctccaacactgtccatgcgtgcctaaatactgcatccatgaacaacaaaaatgtgtgtgcaacacaccaatgggaatgattctataattgcttattatttagtttgaatcagtttcaaacatcccatttggtttaagcagataattttctttgctaagcttgtacgatttgagaaatctctacgcaatcatcttatttatctacttttttaattacaattgacagatttgcaacaacagaagaggaagagagatttgtaactatccacaatgccatttgaggtaggttgtactgttaaaagcgttatatccattcagttaactgatagggagtctactattttgtgagttttaagtgtcaagtgaatgtgtactgtatgatgtaatggcttggtaattattggtaatctgaattaggggaaggtaaatctcttctttttatcatagagcagcacaaatatgtactccctctgtttcacaatgtaagtcattctagcataggaaatgctagaatgacttacattgtgaaacggaggaagtaattaattattggataatttttaccttctgtatattttctgcatgtttgatatgtactccaccgatttgaatggctagacttaacactcggagggagggcagaggaagaataatatactgatatatagctatgcacggtttatcaacctttagtttaatgcctcaacaaaatgaattatcgggttgataactgaaacatttctaataggtgctagaatgccatgcatcaaactgtgggatttttggcatatgtacgtcctcattttcaagtgcttgttttcagcaattgcttaatagtatcacgcagggctaaataacattttgttctaatcatgtccaactttctaagcatatggaaattgaggatccagaatcaagggtggaaaaatgttatcactggtcttctctgaagcaaaggattcaaatttcttctgtattttttcctcttaatttgcctcaatatatctcaatgcacaactctattcattctagaaggcattggcatgtttagaggttaggtgtagtcttatgtttttatattgaggcctacattaggatgagggacagtttcacttcctgcctcagtttatagtgacaagttcttttttgtggcttttaacatttttaaatgataatgccttttcattccagggtgaagtgtggaagaccaaagctacttggggaatatatgaggaagataattattataatcctttgtatttggaagtgatcagtggttgattttttgcgtcaaagtatttcatatcatactgaaatattaaaatgtcttgatttttttgggttttgatttgatgtaaaataacaacatatgaattttctgatttgctattaaatcaaatgagatgtttttccactggtttgtggtaatcaacaatatcttcatgggccaccacttaacaaaattgaaagtgcccaaaattctacgatttcagaagttcattcaaccaacaagaagactaatgtgtcatcctgccgttacaccttcatagcaccaaaggggccaccaaaacaataaggattcctcgggattatctgaaggtgatattctcacatttactttatcaaggggtgagcatcagaatacaataatacgttaggattacgatatattacgttagttcgtgaaagcctcatgttttaaattttgtggttgtaacctgtgtacgtattgaaattttatcgtggtaacatgtttatatagaatatgatggaagccctaccaacttggcatttttagtttttggttctggacgattcgtgttgcacactctttcttgatttgctgcactgatttagttattttttttattggaatctctatcataggctcacatctcatattgatgttagtgacttacattgtgaaatggaggaagtatactttatgtgatgtatactgtaggaaaatataataaactttgaatctactttgtgttttttttataacgtggaaaatgtgcattgcacgtgcacgattactagtgaccatataaacatgcacatacacacactcctattactatgagcaactcgaatggacaattgcacaccacatacttataaacacctcatactcgatgagtaagttgctatcactaaaagaacaattagcaatatgctaattagtttagaacatagggcaatgttgggagaacttttggaacctgcagcttttcttaaaactaaaagctcctctaaattaaacaatttagccttttattttgattaaaaactgtaataggagaattttacaaaaaaactagtaaccacaaagtagattttcctatgctagctgaaatcacatgagctgtttctcattatctacaacaacccccccccccccccaaaaaaaaaataaataaatctaggggttatggtccaccaaacacgcttgttgcacgagtattgctggtatgcttagaatttatcacataagtcatgttctataatctattctgacttgcatcctatttcgtcattgtatctttttgatgcgtgaatactctcacgtttcagcatcatagcttgttttgctgctacagctcatgcaatgattttaatgagttcagaatcggtacatgaattcacatgttttttttatgttttacccaaacgaaacgacatttatcagggggaagtactagcactaaaaaaacaattttgcccagacctacgttttatttttatcaggtgggcttaaaatattaatgcttgttaatacttgtataaataacgggaagcccgtagatttagccctgcctataaaaatcggcaccgtcgatcacaccaacttggtgggccttaggaggcaaagggacatcaattgggcctgcgacgatgaacgtggccaccaccaccacgacactagtgatgacgacaatgaccacgatcgtgaagacagcgatgtgacctccatagcttgaatccgccgtcaccggcctcaggagcatcaggtctgcaaccacagggtcttgggagtctagatccactgttgccgagcctgacgcgggtggatttgccgtcgttgggcctggagcatgcagatttgccacaaggcctcaagaagctctcactcgttgtcgcggagagctctcggccatcctcgttccacggccatcctcgctgaggtggttgactttgtcgcggcgggcctccgcgccctccctcaccaacatcaatgatggtgcgctacttcggtttcttcccttagactggttgaagaagctagagaggataccgacgtagggatgccgatgctgacatcatcggctggctttttttttgtgaatttgacaaatctgtttcgaatttcaaatgttgaaattgcattatgaattttgcgaatcggacgatatttggatgtgcactttgttttcttacgctaaaattcattgtttagtcaagccacttaattatgcgctgatggggctcttagggtagcggcctacgaaactcatcaattttcacagaccttaaatactagcaaagcgtttggccccatgcaaaattatgttttgtcatagtaagtgatacgggagtggagtcgtgggtgcatgactccatccactagagttcaaaatcccaacacccacaagtattacggacgcatagatgtttgttagctaggatgagcattcgtgggtgttacacatgtagtggcgtgtgcgtctacttttgtattatgaaaggaaacatcattttaccaaatatatttatttttgttttacatgttatcttggtgcacaaaaaatacgggcgtaaaggtttgcgagcgtataaaatttccacgatcccaggaaagcccttggggcacagaaaaaatacgggtgtgaaagtttttttttgaacgactcgcacgagacggtgcgaagttctattgatagagcaggaaaaaaatacaatattacaactctggagagtcgtaaccaggaaaaggaaaaaatataccaccacccacacgccgacatcgccaacacacacgcccaggagaaggctagcaccggatcggccgccactaagcgtgaccgaccgccactaggccaacaaaggggcacagacgagattctgcgaaaccacgtctgacgcaccgatgctccaccaccacacaagctttgccgacatgtgggacccctgcaccggcgtcccccgccggccagccttcatgcgtcgaagaccgcgccacacccaccggcagctcctcctcacacctaggtcgcctcctccatcaccggccgcgcctctctgcgccaagccggcctcctccaccggacgcgcctcgcgccaatccggcctccctccaccggccgcgcctctcgcgccaagccggcctccatctccgccgcctgcgcctctcgcgccgagccggcctccgctaccatcggctgcacttctctgcgccaagccggtttccgacccctccactgcacgatgccacgccggccagatgcagccgtctcccacgccctcggctagtcaagcgaggccgccatgccttcggtgaccgcaaacacggtcaccaccaccgtggccgctgctgccaaacacccagccacctcgccgtcgtcatcctcacctcgcacccaactccttcctcgccgccgacgttgccaccgcctccagagtcgcagctgccgtcaccgctgccaccgacgccaaccaccgcctccgcaaactgccgccgcgccgtcgccctccaccaccgagcagctagctgcccgacgccatcacaccgcggttgtcgtcgccaactgctgccggcgtccagagagaccgccatcaccaactgccgccggccaattgccgccaccatcgtcgccacaccgctgccgccgtcgccaactgccgccaccctccagatccggtcgagaggcgcggatctggggggcaccgccgccgccgccaggcactgcgccgtcgcagccacgggaccaccgctgccgcctccgcgccctcggccagctccgtccccgccgccttcagccaccgccgccccagcgccgcgcgcccccgccgcctcgctgctggggtcagagctcggcctcccacgccggatccggacaggagggggccgaatccggccaccccgccgcctccacgcgcatcaccgccgccggcggcctatccccccgcaccagatccgcgcaggagagcgtgggagccagcaccgccgcctcgtcatcgtcgtcggcccggttgcccacctcttcaaccgtcgtcggcgccgccacctcgccgacaccatgcgccaccgttgatctcgacatcgcagccgccgaagtcgccgccccggagctaggtcggagtcgtgggctccaaacgccgcgaccttggggggggagaaggccacgccgccgccgtccttgcggccgcgcggtttccggcggcccgctcgggcggcggcgaggtggaaggagggcagtgggggtggtgtggcggcggcggctgggtcgcctcccgtgtcgcccctgccctaggagcgacgcgggggcaatggtgttacagcatcgacgcactaaatccagaatgaatcggtgtgaaagttttgcgggtgtataaaatttccatgttccaagcaagcccttagatgggctgaatttacgtggatgagctaattaggtccaggacattaaatgggttgattacgtcaccccataaaaatatgccgattccgaattggcatattaatgggctaattacgtacgtcgacctcactaatcttggtaactccgactccgaatcggctttagtgttcagttacacgacacaatcggaatcggcgtccgaaattggacgtggcctgcctgcagtggccacgggtataaaggcacactccggcgcgcggcaccagtgcaagcaagaagcgaagaacatttaagaaaaacacgccaagacaaaaaaaagaaatttcgatagtgagacgaagcaaagcaaggcgattctcattcatgggggccgtcctcggcaccgggagggtggggactctgactcgggtggcgctgacgatcgtcgtcttcctgctgctgttgccgtcgcacgccctcgccgcggccgtcgcgaaggacacctccgccacactggtcgagacgctgccgctgcccacgacgctggtcggcccagagagcgtcgcgttcgacaagttcggcgatggcccctacagcggcgtctccgacggccgcatcctccgctgggacggcgccgacaaaggctggacgacgtactcccacgccccggggtacaacgtcgccaagtgcatggctcccaagctccatcccgcggagctcaccgagagcaagtgcggccggccgctcggcctccggttccacaacacctccggtaacctctacatcgccgacgcgtacaagggcctcatgcgtgtcggcccgcgcggcggggaggcaacggtgctcgccacggaggccgacggcgtgccgttcaagttcaccaacggcgtcgacgtcaaccaggtcaccggcgaggtctacttcaccgacagcagcacgcgcttccagcgatcccagcacgagatggtcacggccaccggcgactccacgggccgcctgatgaagtacgacccgacgacgggctacctcgacgtgctccagtccggaatgacgtacccgaacggcctcgccattagcgccgatcggagtcacctcgtggtggcgctgacggggccgtgcaagctggtgaggcactggatcgagggccccaaggccggtacgtcggagccgttcgccgagctgccgggctacccggacaacgtgaggcccgatgggaagggaggctactgggtggcgctgcaccgcgagaagaccgagacgccgtatggctcggacacccacctcctcgccgtaaggatcggtcgcaaggggaagatcttgcaggagttgagggggccgaagaacgtcaggccaacggaggtgattgagagaggcggcggcaagctttatttgggttcggtggaattgggtcatgtggctgttgttaaagctacttaggctgtgtttgataattggggttgggaacccaactccatcgcacggaaaacgaagcggtccattagcgtgtgattaattaagtattagttaattttttttcaaaaatagattaatttgtttttttaaagcaactttcgtatagaaactttttgcaaaaaaacacaccatttagcagtttgaaaagcgtgcacgcggaaaacgagggaaaggggttgggaaacttgtggaaagaacacagccttaattactttattatggttacttttgttcagagctgcttgtttagtattacatgcaagcatttattttcggttggactaccagtgtaatactccttggaatatatgctctatatatttttaaacgttcttatgatccataattatttttcatatacgatctaaataattaaattaaacgttcaaatatagtacggagtaagtatatacttaggcccatatttcgggtattgtgcaaattttacgtcgactaaaattaggcccacgttgagttgtagctgttccaacatttgggccgtaaacaatttcgctaggtcttttgaagggcctgacatttggcccacgtacaaacttttatctgggcactggcttcttccctcgaccgcaacggtgccggctgggcgcggcggtgggctgggcgaggggctctccggcggagaaaagagcggccgacgcggcgacggcgaggcgtcacggtagcggctgggtggcgggggaggatcttgggcggagagaagagcagccgccgcggagagggcgaatccccctccagctcattccgtcgacgggtggtgtctccttcccccgttttttttctcttttgcatcccttcgttttgctcgtctcttttcttataaggaagcagaatgtttatctcgtcgcttaggtcatttggttcagttcctatatatggttgtccttgcgtaagaaaatagtaacagggagagtcaatgattatactggaatcgactggtttagggatgtggaaatttgggagttttcttcgattgctgctgtactgattaatcgcaatgcgacttgcagaaaatttaatgcgccatagttttggtctcaatatataagtatataaccagcgcagtatatgcgaatttgagggttttgtgttcactcgcctccaaacaggcatcgtagtttacaaaaatggaaaaccaactactaaaatcaaaatcaggcatcatgtcatgcattattgacatggcgcatgattcatgtattcatggttgttcagttgagttcgccagggagggactgtactccataagctgtgcaatgtgggctgctactggcttgcgttgaatggggctagttgctacaaaagataactcaattttcaggtgtcaaaataaaccacagattttaagaaaacaattgatgccaaaactagtacacgtgctagagcctggcacaggaactgcaatctatatattaccagttatgcattgttcaccccaagagatgataatgggacaaatcatcattagaaaagcaggcaaacatattacaatgcagtactaatgaggttggccgtgtacatccggttggatgtagaggtcgggtttattccattttctaaaaagaaactaatgaggtacaattacaatagtattttctcatctcagaggcaaatcgtgttctttctagaaaggccatgtgcacattcacttttttctttttaccacatgttagtaatatgcatggccttcggactccaatgccatcattttctgtttatttcttttaccatggccacaacatgcatcaactaaaaatttacggcatttggattgcaatgcacaatagactaaatcactgtaactgtaaatgagaaatcatctcatacaattacttttagttgttgattccttgcaaccattgacgacccatcagttcttttgctctgtccactagagcaaagagaggtgtgccgcattccataaagcctacatcacccaagaaaaccatgtagttctcaactttaaaggggtttcttctacaatgcacagtgcgtccatcatccggaattcattgaaacaattggcatagtgagaattgcactccatcatgtatatggattgctcaagtatcaccctccggatcccagggcagtgagcacttggtttcatgtttgcattcagtgcatccactagcctcttcacaaatctttgcctaatatgtccgtgatctagctcttgggcaaattcttcaggattgactttgcatatctgtgaactaaggccaatgagaatctctagttctgccccttcagcattcattattctttccaacacctgtagtggataatgtagcatgattggtaacaacataattcagcaaaacacggtatattatactctattttactagtaataaatgacccagtttgaaaaaaatgcaggtggaattccctcctctaacataaaataatttatgcaaaaaagcataccacactatccacctcaaatattgcatctgtagcattaagtagcagggctcacctctcgtaaggtgtgagatagttcttttaggtctaattctgtgagcttagcttgggcatgctggcacatactacgtaacaggcttggcgccacatatatgtacttttcatcttggatcaggatcatatttttgagtttagtaatgaactctggttccttcaacataactaagcagttgtgcacattatccattgctagcattgctagtgcttgcccggcgacctttggtagcaagaaatcaacatctgtgttggaggttctatgtaagtcgaggaatgccttcatcagtctggttatgagcaccttcatgttcccaatctcctgccttgtgttaccatcaatggaaatgtttctgaggattcctactgcaagcttttttaattcttggtctctgatgttgtctcccaagatatctgcgaggtttcttaacaagaagggatgcttcgatatcttgtaccgcagtgctttgccgatttccccttcaatgcttgtcagcctctgcaacaccttcagtgatgacttcactaggaccatttgctgtgcttcactgttcattgtgtcacttctgaagcttgtaaatcctatgatcttcggaatgaggtcagttactctatcaatttccacacagttattttgatcacaactagcaagcttgtcaacaatcaacatgccaagtgcaggaagttgatcatggtatgtcaatggatgctccttgggaactgtccagtactctgaaatcttctgcaagcttctgattatgcagttctgttcatgggatgtgggctgatcgagtttgtgtctccggctggtcttcattgccttgttgtgtctcttgttgtctttgctttgggggatcatctgcattcctaattgcattcggtctttcctcttggcgtatttgctgtgctcgagaatgggatcctgccgtctcctcttgttcatcgtctacctgcagaagtggatttccctttttaagtttgccatcggtgtccagaagggcagacacaagctgcattgccctaggaacagcgataacttggaggtccttcgcaagctcagcagttactttcgcggcatataatctgaccatcatataatttgggctagtccagcccaacatacttattatcctagccatggtctttgtagaagtgatgagcttttcaaggagccgcgcccttgtcgtctccttctccagaaggctatgcatcagttgaatcccatagagatgattcttgggagagtctgagttcagggaatccatggcaaagttgcccaggctggttttcttcggagcaaacacagccttttccatgcatttctccaaggcatatgcataatacagattgacatattccactcccagctgacctctgaatccagcacgccggatgagggatctccgggggatgaatgagaagatctcgagggtgcatgccacggtgtagagtattccttgggccgtcaccatcgcatagaagacaatgagagatggtaccaggttagtctcttcgtcttctttgttgttcttatgtagtgccataaggtgtgacagtgcgaggcctgcgaacacaacacgcaagactgctgctggtatctgcaagttgcccgacgacaccatcacagcaacaatgactagcatcccgattatcatgaaccgaaagaagccatcagtagtcagtactaccatcactagcgcagcaagcatgcaaatgttctgaatagatcgacgccaagacactagttttctgccccaagcactatctaacaatttgatgattcttgggaactttagcctgctgattgtcaccacgaggacggataccagcaatagtagaaatactatccatttggcaactactgtggacctagttggagcgaagccacccgttcttgtggttatcgatccgtttcctgtaatgttcctgacaaagtcccttgaatggtcatgctgcatggctggagtcatcaacagtatcgcagctaaggggctccatagtgatatggcacggcgtaacgggttgcgtagtgatggctgaaactttggagtcatactcttgccaagtataagcagaattatcatagcataaagcactacagctgccataacattcttatggggaaggggaatcaacagcttccaaacatccagaatgcagacgatggcgatcagccagttccagtcaagaggtctgaaagcacctttggttcggaagaacaattggtaatcggacctgttgttgctgccactaaacatcctgaagtatataggatgtgtaagtaaacattaagataaattttatagtccttgagaagcattgagagaaatttttatacctcctagcattgaaggaactgagagatactaaattttacgttaaaaaatgtgatacctcccgatatctcctcaagaactgtaaaatcattcaaacaataaagaatgtgcaaggcagagttccttttagattatttgtgaatgaaaaataatggattaccatttcttaacttaatggattatcaatttgcttataggaaagattaagtcttactatacgttaaaaacctaataaatagcttataaaaagatataaatgttctaatcaatatataaaaagtgttttttttgagaaatagtatttttagaagtatggagcaaatgaaatcatatatagtaatccagaaacttatggcgatgcatattgtctgttgtgacggcagaggagccgcctccagctgatcggcgatcgccatgtattcccaatcgattgcaaaagggtatgcagactagtgattggccgattgcagtgacctgagaaacactccaactttaaatccccataagagcgaattcagattgagttgtttgagggactaagttcccgatttaaaaggatacatgtatcatgttagatgtataggccgggtaaaaatactattctctaaaaaaagaaaaaaaatccccaatccattggaaatcaacacaatggaaacagaacaaataggccctaacctggcggattctaggaagattatggctgtcgcgaaccaaaaatcgttgtacgagccgagtgccgtcagggacgtcgggtatccgccgagcaggacgacggtagcccaggtgaaggccagcgtgccgagcgcgttgcccaccctctcgaccagcgccaccaagctaacgaagccattcagccacttctccggcgcggctgccttcttgccttgctgttgctgcccgccgcagggcttggctgctgctacctgcacccggtgctctcctccgccgccgacggtgacggtgtccgccatcagctcccgtttcttctatccttgttgctagctagctgctcaaatgcagatgttggttacttggtttcaccttttttaaccgctagtttataagtgagcactgttgtttgtccattttgtcatcgcgtgtcgcggctcgcggctcgcttgggtcaaaggtctttgagaaggattggtaagtcttccgtcatccaaaggaggcgagtaggcgacaacgggttgggcccacgatgctatagacgtcttggacggcaagacgaggagcgcgatatgggccttacgtgatatagcggacctgtaggcgatggcacctggcaaacgagcctggaattttttttatttttacattttttttattaaaatatttacgaaaatacttttttttctagaaaatttacaatctagtcgtctcttgctctggatccagagggcgataagggacctaaatgcaatttttttatttgtgtttaaaccctttccaccgtttttaattgcttaaaaactaataatacgattcgatactctaaatgattttaaatggaaaagtgataaactacaaagttatagatctcatcgagatctacaacttttatataaagtttatctccatccgatgtcgtttgagatgtagatctgagattttttaaaataggttttttattttataatgaatatttggatatctaaaacatcttaaatgaaaaaatgttaactacaaagttgtagatctccttgagctctacaattttgatataaatttttatttcatctgactttatataatataattttaaattataaaatcatagagcaaacaagctgtgctggaaaatttgcatttaggtcccttatcgccctttggaagggcgatttttaaaaatcgccctcctagagggtgagaggcaattagatttgtaaatttttgaaacaaaaaattatgtttgtaaatattttaataaaaaatgtaaaaaaatcgctgcgggtagtagcatagccagtggggaatgcgttcactataggtccctcaacggcgcgtctaaatttcgttcctgaatcacaatatcagatttgacacgtctctcgcaactcccaaaaccagtacaaataatgtcttaagacggtttggatggtgttttagctggtgttgatgtggcacttataatataaaaaaattgatgggacccacatgttagtgagtgtctggttacaaataaaaaattgtagtgggtccccaccttattttctttatttctcttttctcttttcttgcttcttctccttccctgcatctgatagctaggtggcagggagaaggtgagcgtggcgcctttagcgacgacgactggcggagacaaggcgagcacggcgcacgcatcgatgcaggcgtgctcgaatgtctagcccggctagacaacaattaggggtagaggaactccactaacacgatgacgaggacattggcaacttggagggcaacgtcggtggcgaggatgggcaccaccatgtgcagcctcttgtagcatccctacccccactgtagccactgcggaggctggcgtggtgatctccgtgcgagtgtcatggcccagtgggagagcgtgtggggagagaaagaggagtagctccaggagcaagccgtcgggggcacccttgatctccctaaactctgccgcgccacaagtgcagctcaacatttggtcttagagcgcactcctcgcgggcctactcccagatggcagtgctcccgacgacgcaggggacgagaccgcccgagccgacgagatctatgcatgggaggacatcgccgcctcgagctccagtagcggtaggaggtacgattgccaacatagggttatgtgcgtggcgtccgctacgaggcggagtaggtgcggcacgcgaggacgagatcgccatggaggaactaactcgacggcagaggcctttactccacccccatcctctccctaacttgatggcgaggcgctatcctcccacccttcctccattggcgaggccttctactcccttgcaacggtgccccaccctcttcgcttgccatttcgttctcgttggcgtcacgtggggatttgggagcatctcggcgtcggtgactaactccaacgatgccaccacctctcccctcaagctcggcggtgccgctgatgcatccgacctaggctacctcccctacctcggctgcagctgtggcctagagcagataagggaaaatcggttggctgggccactggaggcatcgttcgatccccatccctcctttgccgtcgctgttaacaccctcctccacgtatcgccggtcaccgtcgcccgtgacctgtggccttgctcgccacatgtagtgcctgctcccacaccgatgctgccaagaaaaggagagagggagccaccaatttttttttaatttatactgaattgtcctaacatgtggatcccattctgactcagccgccacatcagccgaaaccaggcactatactaccttgggacctcaagtacattgcttttgtaaattgagggacacgttatacctagtattacggtttagggacggatttaatttgaactcaacgataaatcaagaaacctaaagtgaacttattcctagctagtggcaccgcaccggagtggacgagagtgtgagtacgagctccgacggtgagcaggaccagctcggtgtagaaagttccgacctgcttggccacctcccttccaaagaccaggcatgagccatccttaccttttctcttcccattccttctctcacgctggaaggcaggaagtcgcactgagatggtgcacgatagactgtgatcagggttgtagcctgatagaccgtgatcaaggttgtagcctgtagagcttgcaagtgtaagtctagtcttatgattcattaagctagcagcggcgacgcccgcgggcgtgacccccttggggtgtcatctacctcccttctcttcttttggtgagaaacaatgggtgaaaacatgtcagtctttggatgcacaacaactgtgtccttgatgccataacctttatggagacacgtcgtgtttggagactctacactatagtgttgttgtatgtctgtgaccatcgaccaatcttagcaacgatcgattgggtgctaggtttccctccgagaggcttgtttctgtctggttgacacgtggttttgggagtacactacagtgcataaccactattttttctaacacatggtgtttactttttcgggcgaataaaaaattttgtgcttgttaaaaaaaaattgttcgcccaatattgggaagtgaaatcgactacttgctttgcttttttaatg

SEQ ID NO: 41442 - DNA, 1626 bp, Oryza sativa
ctaattacgtcggcccaactaatcttacgctggcggcgctgcagaagacagcggcggacactgacaggcagccgcggagaagttcgccggggcggcgaccctcggctgccgctccggtggctgccggattcgcggggaggccgaattgtccacgctgcgccgccgaaaacctccggtcagttctcgatccagtaccccctctcccgagaggccgagaccctccgccggccgctgctggaggcagcgatggcttccagaaccgccaccctgtacggcggcgggagcgtgccctgcatgcagcgcggagcccaccggatcgagcccccctgcgcggtggcgttcctcgagatcgctgctggcagaggagggcggaggcgatgatgacgacgacgtcccggcagggggtaagggaggaggggtagttgcctgtcaaatttggtgagcttttgatgaactaactgctgcaatttcttcagcttattatggtacattttttgtgtgtggccgcatttgtaggtgtacagttcatatatatatagtagagtatacatcccgatctgtgaatttcgggttgttcttcgttagttcttcgttagagggtagactccctaccatggtgggttttgatgatacagaaaatgatggctaatcaatgcagtagttgcttggtacatctccatcaattcagcagattgcagattatggtagctccaatcagatcgctaatttatgtggaattgtggatgactgattgatttgaatgatactatgttgctggtttgtgtatgaatgtgtcatgaaccaactttgtcttgagttgctcacgctatgtgtaaaatctgtatatacctttttggtttcaattggaagaagtatagctggtgggttgatccagagcgtcctgtttaagtgaactgtaaataatttccagaagggacttaaacgtgattcttttctcagaatcaaattaaattaagacatacttatcccaacttttttttttcatttcaggtactgtcgtaatgtcgtgtacacactattgcaagagagtatctgatgtagctgtacagaaagggtgagtctccatccgtaatatcgctatgcatccaatttttctttataagatagctccaaaattacaaataaatgaatcattatagaaaactgaagtgtttctacaagtatgtacttgtaaggaccatctggtcatatggaataactgtctctgtttgtatatctgcactctgcaattctttttcttgtttttgatgcatacatgtgtggcgctgtgtccagaagctctgctaattctgggtgcctagatgctgcaaatgatgatgaaaataacatagaaataaataaaatcaatgtatttctaatggattcaaatggttcagtccagtggttctaaagaaaccttccatatttttatcaacttttccattatagtgcacaagactattctaggactgatataatgctatttgtcatgttctctttccatcttcccttgaaactcatgagcaactgtcaagctagacattcctgccttggattattttcattccattttaagctgaaagtgtaatgaaatgttacatttgacatgcttatttgtcatgggct

SEQ ID NO: 41443 - DNA, 1226 bp, Oryza sativa
tacagccggacccccgacaggagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcgtaaggtgtacgataaagctcatttcacggtactacagctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggg

SEQ ID NO: 41444 - DNA, 2569 bp, Oryza sativa
tctgagctctcagactcttccgtgtgccccaagtttttcttgttcagcctaatggccgagcaaggaaaaacacacgacctctcgccgagtgtgagcggcgacgacggggagccgaatccgcgccgtcgagctcgtactcctccacctcctccgcgccaaagccctaagcagggggaggcgcttgagagggtcgacaaatccgcggcgtcaccagccgcaggtgatgcaggagaacggcgagacggggagcgtcgcctcctcgtctacggcgacggcagcacacctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgtatccctgcacacgcggtgatctacgcgttcagggggggtgtgcggcacaaccgcatgctcgaaaagatcgcttccaaagagccccagactactgcggagctttttcagctcgcggaccgagtggctcgtaaagaggaggcctggacctggaacccctccggttccggagtggcagcttcggccgcccccggatccgccgctcagacagggcggcgtgacaggaggaggaagaagaggtcagcccataccgacgacgagggtcatgtcctcgccgtcgagggcgctccgcgggccacccgaaaggggaggccagcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggttttgggctcgggccaaccccgcacccccccgggcgtgcagggttggccgggggcttatcttttttctcttccgtatttcaataaaagcgttttcgatttcctaaaggctgtgtctgtgcttttgtttccttttgaagaatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccaaggctaacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttctctttatttggttgcagatcaaattagtctatacaagaggggggcccgaaggcctcggaagaagaaagaaaaagctattcaagattggcgggggcctgggggctcactccgacgcgcccgggtcaccagccttgtcgtcgttatcgtccgcaccaccgtcgccgccctcctcgtcggagtcgagggcgaacgcgagccgaggggccgtaccctcgaagctgtgaacgatgtggtcggcggcgtccccgacctgctcgcgtgcgccgtcctcggttcccaaagggaactctttcaacgcttcccacggggagaaatcaggg

SEQ ID NO: 41445 - DNA, 2631 bp, Oryza sativa
acagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttgttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgattctaatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccacagtgctgggcccgtcacaggtggtcttacctgtgacggctccacggttggcgcccgtcacaggtgacctcacctgtgacggccacatagttggagcccgtcacaggtgagtctgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgacgccggcctgcaccaccgccgccgcactcactctctcgaccgccgccatccatctccaccgccatctccaccgtcgccgtctcgacctctccgccgccatctccgccgccatccagaccctcctcgccgccgccctctctgccgccatctccgccctctccgccgccctcgccgcctccttctccaccgccgcctcctcactcactctctcgaccgccgccgtcctctccaccgacatctccaccgtcgccgcctcaacctctcctctgccctctccgccgccatctccgctgccctctctgccgccatctctgccgtcctctccaccgccctctccgccgtccgcctcaccggcggcctcgccgccgggcgtcctctccgccgtccgtgcatcgacttccccga

SEQ ID NO: 41446 - DNA, 3444 bp, Oryza sativa
tttattaggtgtagggtttgaaatctagtcacaagggaaggattcatagattggccgcagatttaatgtagttccgaggttatcaaaccatcacagaatacaaagtgcatggggaatcttggtggataggccagtgtagtccatggacggaaccgacctagacaccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataagaacagattatctacacttgatcatttttttatctattcttctttttgcccctgttgtggctcaataagtaatgaattgctcaataagaatagtttatctgtacccttattgtgggctgttttttaaatttgcatgattgactcagtggttatatacctctacacttgttctttatggataagaacagagtatctacacttgttctttttttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttcctactctaatttcctgcacttgctcttttccttatggataagaaaagatgaactacacttgttctattttattgataagaacagatgaactacacttgttctattttattttctatttcctcttttttctgcacttgctcttttcttctggattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatgattgattcagtggttatatacctctacacttgttctttttttatgcataagaacagatttcctgcacttgctcttttccttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttaggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaagaagagagggacgctcgt

SEQ ID NO: 41447 - DNA, 8120 bp, Oryza sativa
agctagcatgaatgcaagggtggaagaaagggttaacaaggtgctcgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaatacatagttgtgaagatgactcctcgtccaagtcgaccgacggagcttacacctcccaagtctaagctatcaattgaggctccccgtggactggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtaagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgcgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtgtttcagagggcatggctagcaattcctgaggctagccaatatttagcatttattttttttctggaattaactcatcagtgacggttcggaagaaacatccgtcacaggtaacttcacctgtgacggactcgcaaacgtcggaccgtcacaggtgacgcaccttgtgacggctgtttcttccgggccgtcaccgaggggttcaccctggaacggctactatataccagtcgatctcgtctctcactggcctttgtttagcggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgtactcccacgccccggggtacaacgtcgccaagtgcatggctcccaagctccatcccgcggagctcaccgagagcaagtgcggccggccgctcggcctccggttccacaacacctccggtaacttctacatcgccgacgcgtacaagggcctcatgcgtgtcggcccgcgcggcggggaggcaacggtgctcgccacggaggccgacggcgtgccgttcaagttcaccaacggtgtcgacgtcaaccaggtcaccggcgaggtctacttcacagacagcagcacgcgcttccagcgatcccagcacgagagggtcacggccaccggcgactccacgggccgcctgatgaagtacgatccgacgacgggctacctcgacgtgctccagtccggaatgacgtaccccaacggtctcgcgctcagcgccgatcggagtcacctcgtggtggcgctgacggggccatgcaagctggtgaggcactggatcgagggccccaaggccggtacgtcggagccgttcgccgagctgccgggctacccggacaacgtgaggcccgatgggaagggaggctactgggtggcgctgcaccgcgagaagaccgagacgccgtatggctcggacacccacctcctcgccgtaaggatcggtcgcaaggggaagatcttgcaggagttgagggggccgaagaacgtcaggccaacggaggtgattgagagaagcggcggcaagctttacctgggttcagttgaattaggtcatgtcgccgttgttaaggctacttgattagtttatatagttgcttttgttcagagtgtttattttgttttagatgtaagtattcaatttcggccgaactaccaatgtaataaatttgcacttcatctggatctcctgggaatataggagtatgttgtatattttgatttcatatagaactctagctacggatagtcacactttgctgtgcttgtttaagaatcatgatatttaggacgtgggcgtttttttatagtacattgaaatgctcgtatattcgtatgaccgtgaattgttaggtttaaatttctttcagtaatataagataacttctggctagaataagtactacttgtgatttatgtttcttgtaatgtagcgtacatcttagtgtaaaatcatacattagtagatctatatactagttctacaacctacgtcccaaataacttaatattttacccatctcacacataccaataatgatctctactattataaaaattgaagatgtttttaccgatattttggtacgtcatccgtgtattagtcggtttttaggttcgtttgcttttggaaatacatatccgtatttgagtcggtttttaacatcgttcacttttggtaatacaggtggaatcatataagaaatttgtttaaaaaaactcgcatgctaacttgagacgatcgaactcctaactgcagctcatgattatctaaaaatatatatatccaagcgaactccccgcagtgaatttcatcctaactaaaccatataacaataataagattaaaatagacttcacccgttgtaacacactagcattttttttctagtaataataataaaagaaatactcctaatctatcaaatcccaatgcaactattcctctttttatctactcctaatacaattattttttacttttataaactctgatataatgattcctccaaaaataaacttatttagggacaaaatggactgagctaaaaataaacttaatatgagacggaggaagtagttaacacttactaataatcatttaattgagaagaatataattaggctaatcttgtgataatgaccatataaacatacacatacacactcctattactatgagcacttccaagggacaatcgcacaccacatacctataaacacctcttgcttgacgagtaagttgctatcataaaagaacaattagaaataactacgagcacctatgctaagtttagaacatagggtaatgttgggagaacttttggaacgctcagcttttcttaaaatgaaaagctcctctaattaaacaatttagctttttattttgatttaaaaactataatagtagaattaaaaaaataaactagtaaccacaagtttatattctcactagctgaaatcacatgggctgtttgcctgtttctcatcatctgcctccccccaacccccccaaaaaaaaaataaatctaggggttatggtgcaccaaacaaattaaatgtaggagttatgatcaattcgcttgttgcacgagtaatgctggtatgcttagagtttatcacataagtgttctattctgacttgcatcctatttcgtcattgtaattttttgataggtgaatactctcaggtttcagcatcatagcttgttttgctgctacagctcatgcaatgattttaatgagttcagaatcggtacatgaattcacatgttttttttatgttttacccaaacgaaacggcatttatcgggggaagtatcagtactataaaaaacaatttggccgatacatacgttttatttatttttcaggtggacttaaaatattacttcttgttatcacttgtataaatagcgggaagcccgtagatttaaccccgcctctaaaaatcgatttttatgggcgggttaaaaagaccggcatacaaaatatgggggcactattaaatttgacacatagagagccaaagttttccatctctccttctcccttggctctctcaccacctactccacctccttcccacccgagcgagcagactctcccccatccccatctcctcccccaagtcctccctctcctggccttcctcctccgtacctacctatcacagccaacgctccgctcctgcccactgccgtcatcgaccacgcccgtagttggtgggccttaggagtcaaagggacatcaattgggcctgcaacgatgaccgtgaccaccaccacaacgacaatagtgatgacgactgtgaccacgatcgtgatgacagcgatgtgacctccacagcttgaatccgccgtcaccggcctcaggagcatcaggtttgcaaccatagggccttgggaatctagatccaccgccgccgagcttgacgcaggtggatctgccgtctttgggcctcgagcatgcagattcgccaccacaaggcctcgagaagctctcactcgtcgtcgtggaaagctctcggccatcctcattccgtggccgttgacatcatcgcggctggcctccgccatccttaccgacatcgatgatggtgcgctacttcgatttcttaccttagagactggctgaagaagcaggcactactacagaaagggccataggtgccggttgggaatcggctataggtgccggtttcccaaccgacacctattggtcggcaccaatagtagcaaccggcacctatgaagaaaataaaaccgacacctttagctttgctcaagccaaaaaaaaaaaagggaccggctcagctcgaattgagccaaactcaactgagcactgttactgcgtcatcgcccgagttgctccgaaatcaatttaaaatccccaaatccccaaatcatccacaaatcgctaccaaaatcaattgacatcacagaatgaacatactctaatccacaaatcgaccaaaacatctaaaataaatctacaagagacgagggaggagagccctcttcatgctccaccatccgcttcgtcgctggcgagcccctcttctgtcgccactcgttgcctcccctcccgccagatccggcggaggggagggtgccgccgccgcccgccgcctcccctctcgccagatccggtggaggggagagcgccgcctcccctcccgccggatcccgcggaggggagggtgctgcagccacccgtcggcgaggtgcgccgccgccgcccgtcacccgccgcctcccctcttgcgccgctgatccctcttccgagctgccgccgcgcgcgtgcgagagagagagagagagacggtgagagagatcgagagaaaggatagataaccgataaggataataaataaagggaggccaacgcttatagataaggccgacactatcggctcagtctcaataggtgcctttttaaaaaaaaaacgacacctataatatattaaatgtgctggttttttttaaaaaaatcgatatctataataaccggcacctatggttacttaaaggtgtcagcctccattgttccggcacctatattgccgatccgtatgagcttttttgtgctagtgaggagaggatgccgacgtagggatgccgatgctgatatcctcggctgaattttttttgtgaatttgacaaatcagtttcgaatttcaaatggtgaaattgcattatgaattttgcgaatcgggcgttatttggatctggactttgttttcttgcgccaaaaattgtttttaagtcacttaattatgcgctgatggggctcttagggtggcggcaaacaaaaatcatcgattttcacggaccttaaataacaagcaaagcgtttggtcacatgcaaaattatgttttgtcgtagtgagtgatacagtagtagagtcgtgggtgcacgactccatccaccgtgcggagttgaaaatcccaatgcccacgagtattacagactcatagatgctaattgttaggatgcatgagcatacgtgggtgttacacatgtagtggcgtgtgagtctaccatgtattccgaaagaaaacaatatttaccaaaaaatatttatttttgttttacatgttttcttgttgcacacaaaatacgggcgtaaaggttttgcgcgcgtataaaatttccacgatcccaggaaggcccttggagcacagaaaaaatacgggtgcggaagtttggcgagtgtataatgtttccaggtccaagcaagcacttagatcggctgaatttacgtggatgagctaattaggtccaggatattaaacgggttgattacgtcacccccataaaaatgccgattccgaatccgcagattaatggtctaattacgtcgaccgcattaatcttgctaactccgagtcggccggcttcagtgttcagttccatgacaccaatcggaatcggcgtccgaaactggacgtgatctgcagtggccacggctataaaggaacacaccctcgcagacgcagcaccaatgcaagaagcaaagaacatctgagatcagaagaactcgtg

SEQ ID NO: 41448 - DNA, 8958 bp, Oryza sativa
tcatcacggcaattggcctcctcgacctcgacgccatggatggagcaccgcctggatggtgtgaaaaaagaagagaaaaaagaaagaggaaagagagagttgacgtggtatgctgacatatggggcccacgtgtatcccacgctgactcagccgccatgtaaaccaaaccggggtcaaaaccaccaaagaacctcggttgaccgattttgtatagttaagggaccccgcatatctggttttgtggttcgagaacgttttttatcccaataacaagttgagggaccttcggtgtactttttcaaactaataaacagaactcttctaccccgttatccggtattatattgcctgcctgccagggagtctggggccgagcccgccgagctaccgcccacggtttgtggcgaacaccaccgttttcgcgggtgctgatctcgatcgtcgatcatatagacaggtgagcatatatgcatatgtcatgtcagcccccgtgacgggtgctgtggcgtgccttgctcgatccactcatcatgaccgatcgagagagctgaccgccaagtggccaaagttgatgccgcgttgatcgttcgtccgcccacccccggccgtcgtcggtcgcgacggagccttttagagcaagtataataatagcgagctataagtctactataagcttataagtttatgtggagaagagaggtagaaaaaaattaaaggggttggctctcatgtaaaagctagcttaacacaatctccaagataaatgcattaaatgtataagtgagagatagagagaggaaaataaaattatagctaacgttatagctaatctattatatatgttggttttaaaatgagctaatagtaagaagtgagctatactattatccttgctcttatgtggtcttggtctcttgttacggagattcgtgcgctggaacttggcgacatggactcacagatcccgctagttgtttttcttgccccatcaaagactatatattcttccccttctccaacccacatccctcatcgcacacacgtttttaatctgctaaacaatgtgttttttttaagttttctatagaaaaattaatttagaaaatcatattaatctatttttcaagtttttttactaatacttaattaatctcgctcatttgctttatttttcgtgctaggaaacagggttgggaaccttgcctcccgaactcgtactcagcctaattgtttggttcacatgccaaacatggctagatgcgtggctcataaattgattggtcacaccttaagtaaggtttggctaaaagataaatgtataatatataggcctttgaattgaaaaactatgacatatgccacaactttgttgtatcctgcagctgaagctcgcacgtggtgtatacatcaggtgcactgtgcttcatctactgtctatgcacaattaaatgagttccattgcaaaatgaaaagaatccaaatatagaagcataaatatatctttattgcgtactttatatttaatttgtcctatgaaatgaatcgatgtatatactgtcagacgtttgaggtcacgacaatagtatttgcatggtgtggagatcatcgatatcaagatatatacgggattgaggtaaaagaaatggagacaaggtttttatacaggttcgggccccttatctgacaggtaatagccctactcctattggccgtagctggtgttactctatattcatcagaatcacaaaagtacaatatttgggattgtctatctagccgtcgttgacatggcggtatgaacaccaatacgtggtcgacgacgtggtagtcttcctcctcgaatataaactcgccgagatcagagattgcactagatctctcttattggcctctgtaggcactagattgggtctgtctaggctaatctttgatgtcgacgtctggcttgtcttggcttgtgttggtctcctccttctcctcctagagggtcttgtatttatatccatagatgtccccttgtccaagtagaactagagagaccaatatggatacaatccgagtggtccatgtagtttccatatagaactctacttgtccttccttatctggaactccttctatatacgaggtatgattctgtataagacttggtatatgatgggtcctgccgaggttagtcgattaccattgggtatgtggtgtccataaccaggacaatagcccccaacttcaactaaaatgaattcacattgtcatgctgacttggtcgttctcgataacattcgagaagacatggagtactcaacatctctgaaaaagatcaacggtgcacaagtgtatttaaattgaagtctaaacaactgccagaaacgagcctgaaatcaacgcaaatgaacgagttgatcttatcgatcgaagaccttggaataacaatgtcgtgcttgcttaaccgttctcggacgactgagaaggtacggagtatactactaaattttctgtcttgccgtaatcgagaatttgggttgaagtcaagaattttcatctcggtggatacaccatcacttcattccataatccttgtcaaactccaccatctgttctcgagtaatcgagtagttgtccaactgttctcgagtaatcgttcaaccgttctcgagtagtcgagtagttgtagaatctgtgacaaagccctaaaatatgattttcctgaaatcaatacctagaacaaattgttatatacaaatagcccagaagcaaatgctcaagggtaacataatataatatgaatttaaaaattaaaaataaattgaatctgcacatggcaataaaagagtactctcgctaaagctgccctcagcaattagagtctggtactcttcctagccctagctatttttatggaaaaatggtttttcggcaaaggtagcttaaatcttataacaaaccaagctaaagctgacgaaatcctagctcctagccgtgaagttgggaaaccaattcccgattacacgacttagttaatacgcattcagaatagcgcaaatggacaataggattgacttcaagatagggcgatataagaaaataggatcaacggacaaatattgcatatacaaacacttccagaggttgtcggagaatccatctcgtcgaaacattgaagcaccaaaatctccctaccaggcgtgccactgtcgacgtttgaggtgacgactacggtatttgcatggtatatatggagatcgtcggtaccagggtatatgcgaaattgaggtaaaagagatggagacaagggtttttatacaggttcgggccccttatctgacaggtaatagccctattcttgttggtcatagccggttgtcacaccctaaaaatcctaaatatataaattgttgtttaattggaattattaaaattgattttaaaagcctagaagagaagatctaatttttaattaataaattccaatataaaatggggctagataaaatttcattaaatactttgcttaattctataattcctagatttttctgggatttatttgagctaaggaagtatttttaataaatgaaattgcatttcatgaataatttaaattgaaaaaggattttaaaagtctcttttggctttgggccgaaagtcggcccaaaaccttctctctctctcggcccaggtcggcccaagccgagcgcccgcccgcgcgcgcgcgttcccgtcgctgacaggtggggcccgcctgtcggggtcgtcgtcttcctcgcgtcggccgccgcccgaacctagccaagccgtgccgccgtctccttccaaattcggccgcgtctttccttctccggtgaaatcaatagaggggaaatgatcttcgggatctcctctaccttttctcttttggaatcgtcggctaatttcgtttggaaatccgtggattcgagtttgattcggatcgaaccctttcctccgaaccctaatctttccttcttgtcgccggtcgccgtgggccttcgccgccgcctccttgcccctataaaaggatccccaagcccgccgctacccgtcgccaccctcgccttcgtctctcgccgtcggaagagccctagcgccgtgtgacctagcgccgccgtcgtcgccgccgctccagccgtgcgccgccgtcgctccagtcgtcgccgtcactcgggaagaccgccatcgtggtcgccgtcgcgtcgccgtcctcgtccgccccttcgccgtcgctgttgaccgccggagcaccgccgtcgtcgtcaaaccgaaggactccgccgccttttcctcgacgccgccgtcgtccgttcatcttccaccgccgttttggtcatcggtgagttcgccgcgtcgcgttctacgtgctggtgccctccgttcgcgtcctcgcgccgtcgttcgccggcgagcatgcgcgcccgagccgccgagccgccgccggaggtgacgtcaccgctgacgtcatcgtggccgcccgtcgtgatccggtcgtggaccgcttgatctcggccgttcgttttggataagatcgatctcggccgttcgttcccgtgaaccgccgccgtgcgcccggtccaccgcaaaccctagccgttgacgcaataattcctttttccttttcaaaagtaattcattatggcgtcataattcaattaaaatccatataagtgttttaatccgatttaatctttaaaaattcataactaattcatcttagctcagatttagttggttcaagtctctaaatttttctaaaattgagatctacatgttaaaaatatccacatgtactgttcatgcttgtttatgtgctgttttggtgattttgctcttttctgtttagattccgacgtttccggagagtccgttttcgcaggagaagaatttgaagagttccaaggccagcaaggcaagtcacacagatcccaaacaaccctttgagcatgttgatcccgtttaaagctactatttctattcaactattgcatttattttcgaatgtcattggatggaattaacctattgtttgttatagcccttttgttcttgattactttattccttgataccttgggttattataacttgactagttgggctatatatatattggttcagctagatattagatatgattgcttagccatgcttagaaacattagcacactattgggataacttatgactcactattatttaatgatggcttaatgatagttcacgatggtcaatcgtgattaggttaatcaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccagaaaaggtgccctgtggtggattgtgttgtgcgaggggtattgtcacagctcctttccgaggtaccgtggtggtattgaggcacatggtgacatgttgtggggctgtgtcttgtgggtacagtggtacacctctagccagagtaaaactattcgaatagccgtgcccgcggttatgggcgggtctaacaatgtctttcgtgattagtctcacacctctcatcatgataaaagatgctataactggtaataatttgtttagctcctggtttggaattgtatattcctggtttggagatagatctgtacagccgggtatggttgttcagaatggttgggcctatacaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaagagttctacagtgacgctgatggtgtggaggattaggtgtagccctggtcaagctgcctgtggagtggagccgtctgcgccgtttatcttatttttccgctgcttagatctttattgattgagaggaactatctacctctgtaatgacattttattcgcctattaattagagtaataattgtactctattatcaatttgttattgtgtgcctcggctgactcctggacgagggttcacacacatgtaagcgtttggaattttggatagaaattccgggcgtgacaccggtgttactgtggacccccgtttttataacaggaatcaatcgtgtaaatagtaccatttccctggatcaagtagtctggtacacacgagttcatagctgaaataccaagtgcacatacacgagggtctagtgcgcattattacatcataggcttgcaggcatagtcttagaacataggaccgaatggtccggaatacattccaaaagcagaagtagataaggcagcggagttaaggcagcggcacgccgttgccataggcaacgaccataactaagacctactgagcgccatcgtcttcatcaccctcttggtagtaagcgtagggatcctccgaagcttcatcttcgacctctgattaagtttgtatattgcaagggtgagtaccaaccgtactcagcaagccaccacagcaacaatgcacatgatagggggtattcaagggatggctatggttcttttgcgcaaagtaagttttgtaattcttttcacaagcctaagacctagcatgactgatcaaatttttagtaccagtgttcatatcaaagaacgacggttctgtccaccatccattgtgatcccaaggatagcttcccccattgagtcgtcatggttttctgaggacgaccaccttccctcctctcaggaagtggctccatcagcataaaaatcatcatgcaatattccatcccacacaaattaagaatttagagtctagccaagtgtaatacatgtctcggtgctcaataaccgcgagcacggctattcgaatagatttggtttactcacactgcagtggatgtacactttatccgcactccgcgactgcccaacacatgagcctcgtcccaacacatgagacgcgtcacggcaaagctttttgataacctcgcattggcagtacccactccataaactttacatcctcatgcactctaggcggaatacgatttctagcagtgagaggagttctggcgcacccgggaaaggaagactcacacatgcattaaggtataattatgtttagattctcacatggcagtcctaccgatggcgacaccactgtaggcacccgcctcgcggtcctaccaaaggctgccccaccgtagagcccctgcctcacatatcaagaaaccactatgcatggatactgcctccgctcatctatctactccgctaggtctatacccatacgagaagtgtggttgtacgggggtcgtttcatgcttaacctcatggctcggtccttaactgaccagggacggcactagccttttccagacaccacccaaatcctacatccgccccagttgaaaatagttgtttcattttattttcctttcaccaaatcatgtcatcactatcatggcaatgtggcgctcatgtctccatatgccgcatctcaattaccttcccaaaggtaattgcccaggcatatagcatttgataaatatgagtatgcatgattctagaatagcatttctaagcaattgtcataattgactagggactcatacataaacatggttacaaatatttaagggtaaacaataatcaaggcatggcataatcacaagtgggatgttcatcattgcatgcaattttatttgtaaacaaaataatttcgcaattgggatcaacatgttcaaagaatagtgatgacttgccttgctcgtagtcttgcgggtcttgatccttgctcggatccacaactccctcgggctctaaaattacgtacgaagaaatgatttgaattcaattagaattcaaataaaatccaaataaactcaaataaaagtcgaacgcgaatcgattactcctaagaatctccaaaataatctacgattatataaaactttgcaattctacggctaacaataatctacaattaaattctaattattttaaattttctaaacctccttaatctctctctaattttttatttatttttccttttctttttctctcttcttttctttatttttttctctctttttccctcttcttctttctttctttttctctccctcccggcttctcccttccctctcggttctctgcctacccgagcggcaacagcgaccaaacaggggggggagcggcggcttactgacgacggcggcggcaacggcgacgcaaggcggggcgacgcatggcgcggcgcggcggcaccgagggcggcggcgcagtggagaggaagagaggagaaaagaggggaatggggtgggggtatttataggggagagggggaagaaggagagggggtggccggcttaatggcgacacgatggcggtgcacggggctcggggtgacggcgacgcgcggcgatgcgacggcgcggggctcggggcggcgacgcgatgggcgggcggcagcaacgatgcgacgcgcgcggtggcacggggctcggcgcgacgggacgtgtggcccggcagcggcgcgagtgcgacggcgacgagacggccgcgcggcggcgcgtaggcgcgagggcgaagggcggcgatgcgactgcgagcggtgcgcggggcgcgagggcgacgggcatgcggcaggggcgcggggcgcgaggcggcatgcgcgcgacgggacggcggcgcgg

SEQ ID NO: 41449 - DNA, 14592 bp, Oryza sativa
taaatttattctataaatcctaatttttgcacaaattaagtttactcaatatttgtgttatttcaaccaatggattcaccctggattaatattacccatattttatttttatataatttatttgaattttaattagggctaattcttattccatcgcacttaaatttaattattaccaatatggtcgcggtaatattctatttatttctatctcgcctaatctttattttaaattatatttcaattatttattttgccaatttatttttagggtttattcctaattgattattctttactcacgatcaatgaactccgaaatcaaatccaaataaaataggcgaataaaaccggcatgatgcaatttatttaaaaagtttttaaagatccgtatttttagggtttcgattttgtcggtcgaattttcagggtgttacagttactctatatttatcagaatcacacaagtacaatatttgggattgtctatctagccgtcgtcgatatggtggcacgaacaccaacacgtagtcgacgacggggtagtcttcctccttgaatataaactcgtcacgatgagagattgcactagatccctcttgttggtcttcacaggcaccagattggatctgtctaggctaatctctgatgtcgatatctggctttgtcttggcttgtgttggtctcctcccccttctttagggggtcttgtatttatacccatagatgtcccattgtccaaacataactacaaataccaatatggatacaatttgagtagtccatatagttttcatatagaactctacttgtccttacttatctggaactccttctatatacgagtaataattccatataagactgtatataatgggccccgccgagtttagtcgattactattgggtatgtggtatccataaccatgatatatacactgtttaacaaaatgaatagaccactaaaaaagttatagaagtaatttgcgaggactgtaaataaaataaaaaaatttgctccatgacactttgaggcatttgctctataaaacctactttttacagctttaccctaagatactctggttatacggttatctgtcaaaagacactccgataattaatttatatagagagataaaatcttttaaaaaaggttttacctttggacaacttgcaagctttaaatttcaaaattttggctgactttaaacattttatgcaaattaaaaattttcccaaataccggaaataaaaaacagttatttaaatccagaaaatattggtataaattttattttatctttttttttttgcaattgtcatttagacaatttgggacaacttttgaatttgcaaaaaaatttaaatattagctattatttgtttgaattcaattcatacgaatagtcaatctttttttcaaagttatatatgtctctattggaagatggtattggaatagggtctctttttttttaaacaatagcgtgcttgacaatacaccacaaccgaataatgttatagcaaataccatgaatctagagtatcctgaagtcaagagacctcaatcgtggttcctctcgtgcgtaaactctgctaatcccataggatcaatagccttgataaggacagattgagcatatataaggctatgtttagctcttagggttgggcattaatcccttgtacatgtaaaataaagcgacttgaacaacttttttatagaaaaaaaattgtaaaatacacaccgtttaacagtttataaaacgtgcttgcgggagagtggaggttacgaaaaataagaaacacacacagcctaatacatcatttaataataggcaacaactaggagctacaaatatcatgctcccttcagcttttaatatttgacgtagttgacttttgaatgtacctttaactattcatgtaatcgtgttatttaataattttgtgcaaatatgtaaaaatacgagtcatacttaaaagtacatttagtgaaaaaacaaatcacaacgaaaataatattacacatatattttaaaatttaatgacgttaaatattaaacataagagggagtactatatactccctccttatttcttattttaatgtatgacgacgttgactttttaaccaacgtttaaccattcgtcttattcaattttttttgtgcaaatataaaaatacttatgtcatacttaaaaaatatttgatgataaatgaagtcacaataaaataaatgataattacataaattttttgaataagacgaaaggtcaaacgtttatcaaaaagtcaacagcgtcatacattaaaatacggacggagtattatgtagtgtgtgcaaggcacatttctttacgtagaaacaaatcttgtttttcttatttcactcatcatcaatgtcaggcaaaattcacccccattatttacctttgtacatggcctaatacgattgttttgaatcgaaagaggttcaaataattacacttgactaaatgctagtagtagctatcatgttgatccagggatcgtggcttggggtggtttccatgagaatactctcgaccaacttgcattattcctcctttttcctctttcagacgattcagacaatgaaacggacgctacctacgggctatggcagcattgcatgcatgttgccaacttgccaaggaggcttgtactacttccgcagtatcttatcctaaaatgagttacttttttacctaccatattttctcaactaatcattaatattcttcaattaatttattcaacaatttttttctcaatcaaccataatctttccttcaattatttatacctatttccttaaaatttatgttcatattaaaaatacttacaattttgaaggaggaagcatccttttttagcccgattcccgaagctagctaccgtgttaattcgagctactccactatttagagcaggcacaataatagactataaatcagttataaacatattttaaagagataaaaaaaagagaaaagagcagcagactatagatatgtaaccagctgcagcacggattccaagacgtaatgtgtatatgccagttgggattatgtattaatagtgtagtaaacaattattatatgaattggctattatattggctatagatgatttagagctagtagttagctatactattaaacttatactattaaacttgctcttagcttcattccatcccactgcccccaaactgctgcatctacggcaaaaaatgctgcgacgctctttggtcgcccatgccgttctcctcttcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgcctccgcctcccccaccctcttcgcctccggcgtccgcggcgtcggcccggacgccgtctacggcctcctgctctgccgcggcgacatgaacccctccgactgcttcgactgcggcaccaacgtctggagggacgcggggccaacctgcaaccgcaccaaggacgccatcctcgtctacaaccaatgctacgcccagttctccgacaggggcgacttcctcgccgccaccaacaactccggcgaggtgagcctcctcataagcggcaccaacatcaccagcaccgacgtcgccggctacgaccgcgcggtcaccgagctcctcaacgccaccgtgcggtacgcggtggagaactccacgaagctgttcgccacgggccagcgggtggggaacgacacggggttcagcaacatctactccatggcgcagtgctcgccggacctgtcgccggcgcagtgccggagctgcctcgacggcctcgtgggccagtggtggaagacgttcccgctcaacgggaagggggcgagggtcgccggcccgcgctgctacctgaggtccgagctgggccccttctacaccggtaatccgatggtgcggttgccggtcaaggccgacgagctcacgcaggtaagaataattcaggaagcaaaattctagtaattatcttgccgatagtgtcagttgcaatcatcatagctgtaatttccctctgtatctggaatgcacgtaagaagagaagattggcaaaagcagagcgtcaccccggaagtgagtcctctgcacacaattaggcataaattcttgttaaacattcttataccacgagcatccattaacagtttagtcaaaattatgcaaacttgccagctgatacaaatgaggactttgaaagtgtcaagtcaaccctgttatctctggcatcactgcaagtggcaacggataacttccacgaaagcaataagattggtgaggggggattcggtgccgtttataaggtatggcatgagtactcttaactttttaacttttgtatcattgttgatttctttgagaaaaagttgtgtgatttgatggtgtgaacccagaatatggtcaaaaatataaattctagatggctagaagtacgattgcactactgctcaattgttaattaatcacaaattgtggtgtacttctcttcttgaagtatatcgcagaggtttggtgcactactgctccagcccttggttttagataaaaaaaaaatgtgacgtcccagaataattagaggaaataataataaagcaggacgagaccttagtccttgggcctccagcagtagtagagcaattggcccggttgaccttgggccttcttgacccccaggacgagcagcggcagttgggctaggcaagctagctagctagctggcagatcacacgcagcagcaagccagcaacagcacatcagaaatgttccatatgctgccaaataggattaaatgatcagccaccctaaatctaaatcaaaagacaacatccacgcaaactccaagtaaaacgtgagagtattatagatattactatttgaacattatatgtgatatagtggatatgttgccaataaaagacataaataaaattagaagtagtagtcacatctattataacacttgctcttagtttcaacttaggagtttaagctgatccatgactataatattggtttaaacttattgcgtgaagcgagaacgtaaaacatgatagtgttacagtgtagggtgtattccatttagatgagtcgggtctaaaatcgtttttatctagtcgggcctagaattattttgggctataagcgttatatagtaaaatatatgcatgtgtgtagtctaactaaataagttgagcctagctataaccttttttttttcataatggacgttacaaaaagcaagaaaatatgaatgtctggttgttaaacttattaaaaagtcatctgagtccataaaattacaaaatacacatctctatccataactcttggtttaacgtatcacatgggttccaaagcgcacctataaatatttaagaccaaatttggtcaaaatttcaaattttgtatcatcaataattccttaaatgattaattagtttaaaggattggtatatattgatttgccttaaaattactactctcgtgatattataaatttactagtactaatataaaataaatggtccaaaatacaaaagttgatcgaaacttatcctaaatatcaaatatttatatccaggaggagtaagatactaagccaagtagttaaattattcagggaattcttcatggacaagaagtggctgtgaagaggatggccaagggctccaaccaggggctggaagagctgaaaaacgagctagttcttgtcgccaaacttcatcacagaaatcttgttcgtcttgttggtttttgccttgacgagggggagagattactcatctatgagtacatgtccaataaaagcctagacacctttctttttggtactattagcattaccctttttaacctacatattttgtcttttcactccatcaataacaatttttttcttttggtaattagatgcagagcaaaagagaaaactagactgggcggtaagatttaagataatagaaggcattgcccgggggctacaatatcttcatcaggactcccaaaagaagatcgtccaccgtgatatgaaggcgagcaacattttactagacgcagacatgaaccccaagattggggactttggccttgctaggctctttgggcaggatcagactcgagaagtcacaagccgtatcgccgggacattgtaattaagtcgaaggaacactcattatttttcgctcatatatagataacaaactaaaatgcaattcttctttgatgcagcggttacatgcctcctgagtacgtgctgcgcggacagtactctacgaaatcagacgtgttcagctttggcattcttgtcatagagatcgtgacaggccggagaaggaatagcgggccatatttgtctgagcagaacgatgaagatatattgagcatagtgagcatccctactaattcattgaggaatacatgcctattgtaattactgctgactaaacacatatgtgtgactaatgttgctaggtacggaggcactgggaagagggagcaattgcagagatgattgatcattccttaggaagaaactacagtgagaccgaggtgctgaaatgtgtcaatattggactcttgtgcgtccagcaaaaccctgtagatcgacctacaatggcggatgtcatgattttactcaatagtgacactacttgcactatgccagctcttgcacctaggccagcatatttgatcgatgggacctctggttactcccagaccgtaacacaatggtccggcaggtagcagggggccgaagcagatctagcaccgttgttggcttgttgctgcttgctttgttttatattgtaagtgtatcagttctcaatttgtattccatgataaccaagttcaactaataaagagtaaatatataccattgaccagtttgtctcgctcaatgtttatcatcgagtttgtgtccatccatgacatattccaattacatgctactagttattactccctccattcctaaatgtttgacgccgttgacttttttaaacatatttgaccgttcgtcttatttaaaaaaattaagtaattattaattctttttatatcatttgattcattgttaaatatatttttatgtatacatatagttttacatatttcacaaaagtttttaaataagacgaatggtcaaacatgtttaaaaaagtcaacggtgtcaaacatttagggaagtagggagtacaatataattacgttatactccttataaaatatagtagtggtggtgatgattttgtcaccacctacttttgcgggaagaaaaaaaaaagtggagctaagagcatcactaatagaatgtgtaaattcaatcttcaaaattctgaatttgggaatcctaaatgaaatttgataagttacagaagtgatccttccaatagattgtgtaaaattgactctctaaaatagaaaagtggaccgcatagtaaactatcaactaaaaaaaatcagttatatattcctcctccttccgcgacggcgaaggcaccatcacatcgattgttgtttacaaatacacgagtaatccaggtcgagcatgtttaactcaaaagaatcagttaattacgcacatcaatttacggagagatgggcatgatcatcagatcatggaggaagaaagaagtctagactctacgacgcaacgacgtgttcgtcgaggcccccgatctgtttctctcatacacgatcgggtgctacttcggcgcctcgatcaccttgattaattgtgcgctagctgccgcttcgcgtcctctgcttcttgatacacttcgcggagcttgcgctttgcagcgatcatggccttctcgtcggtactgcacgacgacgtggcactctcgcggcggctcatgttggccgtcctcttgggcggcgatggctgcaggattttggcgtgatggtcgtcggtctcatcgggttccagcacctgagagagcttctccatgacggctgcagacttgaggagctcgtccttcacggatgccctccacccacggacaaaaacatttcgcccctcgcccgggaacgggaggagagaggcgggagcgtgagattgggagtggtagaggcgagatcgtgcgccctcatatcaaccgagctaggatttgggagatggaactccagaactggatttttcaccttttagttcttttgaaaaaaaacttattctacaaataaatccttaaaataacttattttagaaatggtgcttttcgcggcgccaatgtagttggtgccgtggtccaacatgacagcaccaaggacgttggcgccgtcctctccaccctcgggtgaaagctaagtcactaatgtgaaggagaacggcaccaccaacattggtgtcgaggaaatttgcaaaaaagaaaagaaaagaaaaaggacctagttgtaataaaaagtgactcatttgtaaataaaaagaactcggaaacttcggcaggagagtagcggatccgttggagctgtgttttggactaaaatctctcaaattcaattttcgaaatgaaatactctctccgtcccataatataagggattttgactttttgcttgcattgtttaaccattcgtcttattcaaaaaattttagaattattatttattttatttgtgatttactttattatccaaagtactttaagcataactttttgttttttatatttacacaaattttttgaataagacgagtggtcaaacagtacaagcagaaagtcaaaatcctttattatataggataataagacggagggagtaggtggatagttggtgatgctctaacaagattcacatataagtaacaaatacgtacaacaattaagagataataataacatattaataaaaattttctttaattggaaacccgttgccatgcacaggcaatatgctagtatactagagtaatatttgaaagattttaacaaaaactgtcggaatgttatatagtttctcccttccacaggcaccatgcaggcaggccggcggttggtgatcatatactcatatcatgtcatgtccttttgctcctcaccgtgctcgtacgtacgtgctgcccgacgctgatcacaccggccgagccgaacgtgctgggatgcgcgcgcggaggacaccggcacatacgtgccatcgcctcaccgcgcgctcatgtaggagttatatgttgggtgccggccggcccgcatcgacgagagaggcggccatgcatgcgtgcgtgcgcgcgcgtgtgccgcgcgcgacccgcgaccttgctgcctctctccagtccaaatatagtccagtgactgattcgtcgcgctgcgcgtgctctcctgactgaaaataggcgtatattggcaaatcctaccctttattagccgaaaacctggcacggggtcatagttgaatcacgacgtacagcgcgcgtggttacacgcctccaagtttgaacgtatacgtacggtaaaaagtggaacggtttacacatagccatgcaccgatttttctcgatatcattccatacgcgaccgcaacagtcattttgagttagaaatgggtcaagtttcatttgactaattaagcgatatatagcatgcgtgttccttttttaaggcagggtgcaaacagctgctacagagaggtttccgtgatgtcgacgaatatataattagtccctgtcccacgtgccatttgacatccaccagacgggttcactgaattcagtctgacctgtcggcctcggccaatcggccatcgcatggcaattgccaagttgacaacttgtcaagagccatcacttccaaaagtataggtagtactgtactaaaagcttgtaaaaaagagaaaaaaaacaagaagatatgatacggagatggattctaatagctcgagtggacgtccacccgtttattgcatgtcaattagatggttacgaaaaattttcaaaaaaactaacaagacagatcaatatataatatattactccaacgaacatgcaaattcaaattcaacttctacaagttgtaacaaaaataacaaatttaattgtaaacatacctataataatttgagttttttttgttatttttattacaatttgtaaaagttaaattttaatttgcatgtttgtggattgatatattacatattgatctatcttattcatatttttttaatttttttatattcatctagataacatgcaataaatgggtggacgtccactggctattaaaacagtttaccgatatgatactgcagtagtggagtaggtaccattagcagaggattgcaaatttgcaattgcaatgcaaagcccgacgatcgaacaagcttgctctgacggcgccatgcggcggcgctcctctgtcctccatgccgttctcctcctcctcctcgtcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgcctccgcctcccccaccctcttcgcctccggcgtccgcggcgccggcccggacgccgtctacggcctcctgctctgccgcggcgacatgaacccctccgactgcttcgactgcggcaccagggtcggcgacgacgtcgcccaggcctgcaaccgcaccaaggacgccatcctcgtctacaaccagtgctacgcccagttctcggacaccggcgacttcctcgccgccaccaacaactccggcgcgtacagcctcctcataagcggcaccaacatcagcagcgccgacgtcgccggctacgaccgcgcggtcaccgagctcctcaacgccaccgtgcggtacgcggtggagaactccacgaggctgttcgccacgggccagcgggtgggcgccgacccggggttccgtaacatctactccatggcgcagtgctcgccggacctgtcgccggcgcagtgccggagctgcctcgacggcctcgtgggccagtggtggacggggttcttgttcccgcggaacggcgagggcgcgagggtcgccggcccccggtgctacctgaggtccgagctcggctccgggttctacaccggagctccgatggttctgctgcgagccgacgggctctcaccggcgtcggcgccggcgccggatgttgttccggccactacgttaggtgagcagcataccaattactctacccatcaaagtgatcacgtcacgtctcttcagtcttcacgtcatctgcacctaatgtttactcatctccgatgcttgaactgattatttttcactgaaatatgcagttaagaagaattcagcaagcaaaattctgctaattgtcttgccgatagtagcagttgcaatcgtagctgcaatttctgtctgcatgtggactgttcggaagaagagcagagcgacaaaagcagagcatttgtccgaacgtgagtcctctgcacaaatacaatatggcatcggattgtttacaaaccccacttaaaattcttaatcatcagtatgaattgattgttctatcgaatccatgcaaatttttgcagttgatgcatctgaggaccttgaaagtgtcaagtcaaccttgctaactctgggatcactgcaagtagcaacggataacttcgacgaaagcaagaaactcggcgaaggaggatttggtgcagtgtataaggtatgccagtagtctttatgtgtaacttttgagtcattgctgacttctttttcaaaaataattgttgatttgatggtgcgagtcaagcatggtcaaaagctcaaaatatgaatatctaaaagtttttctccattgatgatgatgatgatttttattttctacaaaagatctttcgatctttctttattagaaacaccaataattgtaaactattttacagcactcaggtttttaaaccattacaaaatacagtatatcaatgaaaagtaaaaaatatgcaggggcatctttttggacaagaagtagcagtgaaaaggatggcaaaaggttcaaatcaggggctagaagagctgaaaaatgagctagttcttgtcaccaaacttcatcacaaaaatcttgttcgtcttgtgggtttttgcctggaagatggagagaggttgcttgtctatgagtatatgcccaataaaagtctcgacacatttcttttcggtaatattaacacctcctttcagtatatatggtcatgcacttctttctcatgtgatggtgtgcaacaattacaatgatgtcttcatttggggctaattagacgtggagcaacgaagacaactagattgggcaacacgatttaggatcatagaaggcgtcgctcgtggattgcagtatcttcatcaagactcccagaagaagattgttcaccgcgacatgaaggcaagcaacgtcttgctagatgcagacttgaaccccaagattggggactttggccttgctaggctcttcgggcaagaccaaactcgggacgtcacgaaccgtatcgttgggacattgtaattaagcagaacacttgaagcttatgtgccaatatttcacttaaaaactacgtactaacatgcaatttcattcttactgcatgcagtggatacatggctcctgagtatgtgattcgcgggcaatactctacgaaatcagacgtgtttagttttggcattctcatcttagagattgtgacagggcaaagaaacagtgggccctattttgcagagcaaaacgaagatttagtaagcctagtgagtatcccttctaattcctacaaatcaatacactaatattgcttatgtttccagaaaaccactcatatgtaccatctatattactgataactggagatctatatataactaatgctaggtatggaggcactggacagagggaaatattgtagagatggtagactattccttggacagaaactaccctgaagccgaggtgctgaaatgtgtcaacatcggcctcctgtgtgtccagcagaacccagtagatcgacctacaatggcggatgtcatgattttgctgttaatttatagtcatgattagttataaacaaggtgacaccaatgaggtaaatcaagaaactgttgccaaatttcaccgttaacagaaactcatgaggtcaaacccgtctattcaaaagctattattaggccttgttaaatgggcttcaatccagctcaccaacatttgtaggccggtaatttgaactaaagttcaatgcatgcaccagaatctgtcaagattatgacccatccaatagaggtttaacatgatggattgagaaattatcctctgaaacaagaccatcaatgggaacacaaaatgggcttatggcgttgtatgacacattttcacgcagctgcgcaaggcatgagtctatagtgtgacttaacgagaacgaaaaacctatcgagcgatcgatcgcgaggggcgatcggttcccctcccccccacgcagtttccatttttggcaccgctttactttcctcttttagtaagtttatacacctaaagtttacacatctaaaatttatccacctaaagtttgtagagcgaatatttatgcgtcaaaagtttatatacccgattcaaatttaaattcggattcaaatattttatatatagaatatttctatacgtaaagtttatgtgtgcattatttttctcttttagtaagtttatacacctaaagtttacacatctaaaatttatccatctaaagtttgtagagcgaatgtttataagttaaaagtttatatacccaatccaaattcaaattcggattcaaatattttatatatagaatatttctatatataaaatttatgcgtgcaaagtttacggtataaagtctatgcacatgaatgagagtattaattttttttctattttttttactaactttgtttttttaaaaaaatatatgatgaaaagagagaagggagaggagtataggggaggggcgggtcccattaggggcgcccgagaaggaagaccagacaagcaattatattgttaaacagtaacctcgagattagggtaggtaccagtcttccaagctaacatattgtttttctttgtaaatacttgtttagcttaaaaaagtgcatgcacgcctattacaacctgctaatcattaattgcgaatttcaaacttaagttagtgaagtagttaagtgaagatttgcatatgttacatatttatatttggattcgtagtactaggcatgtatattttgagatgggtggagtaatttataatttaattattattaaattagggatttgctacccatctacctgctattgtttttggttttgtaagccgaatttgtggccgctagatcactccaagatttgtgttgatttggctcaccaagataacctttgatgtaccttgttcatacgcctacattactcgcgaggggggggggggggg

SEQ ID NO: 41450 - DNA, 17980 bp, Oryza sativa
atccccccttcctatttaaaactctactctcctcttcccttcctcctcctcacctttttttttctctgtctaggtacattccatagcttcgtttcgtgagatcaatcgattgagctagatgttagctgcaggagaaaggtttctaggttgtagaggagtagcgtgagggtgaggaggttgtggatgaggtaggcattgtgacggggagggtggagctgaagcggatcgagaacaagatcaacagacaggtgaccttttccaagcacaagaatggtctggtcaagaaggcgtacgagctcgtcgtgctctacgatgccgaggtcatgctccaccttctacatccgaggcaagctcaacgattttgctggttggggtcctagtatgtgcggctatgcgtgcgaacatgttgacaataatcccattctaaaatgttttgtagccatgcatgtagatgcatattgagtcaatgttgttatgctagcttttttccaaactttaaatgtggctagatatattatgtcgtcaataaataacaccagaattttgtggactagttttgttaggacctgaacataataaacaagaatagtcactagacgggaaactatatattttaatccctcgaggggacatcgttatttgcatgttactcaaatggttacgaaaaaaattggaaaaaattaagaagatgtattaacatgtgatataacactccacaaacatataagttcaaattcaacttttatatctcgtaacgaaaaaaacaaattaaacaacatctagttaacgtatatttacagtcaaatttgttttttcgcctattttgttagctaaaccaaatatcttaatgtcagttttgtcagtgcttggtggtcagttttgttaaagttttagtttcgactgaatttgtataagccaaggagcaatttggtcaacagttagttttgtcagcaattagtacctgattttgttagttttgtctgaattcatatataactaaatgcagttttgttagcagctagtttaatcaataattaattagttcatggtgttgttagttttgttggctactaaatatgacttgatctaattttgtcagcagttagttttgtgaatttaaaacttggttcagcttggttcaacttgaccaacttgaccttggaaggggtccccttgggatccttttgtaaccttgcttgtacaagctcggtttccctctcttctccttttatgaaataggcagagctcctgcttttacccctcaaaaaaaaacttggttcagctagctctagtaatttcatggaagctagttaattgacttcttgatttgattatatttttgtgagcaatcggtatctagttttgttagtttgtcagctagctagttttgtctgaattctactaatagtaattaggtcaataagccatttcaatcaaatacaagttgtcaagctgatctgcccatttcactagttcaaattcctgcagttgatttgtattccctgctttagtatatagatttatcagttacatatatatgtcaacatttcatacacgtaggtagtatagatttattttattttattttagtgtagggttgtaatcttgtaattttttttcctgctatatcaatatgaactttgcactgtctagtgcgagctgtaaaaaataaaagaaatagcggctatgagttcgttcccaagatactgttaatctcgacgaccaacttgaataattccatttccctttttcttcgttcaaacgatgaaacacgtctgcatgcacataagtacacacgtacctaatggtgatcagagaattcagtctatatggactatgcatggcatgcccaacttgccaaagacgagatcaatatccttctttttttttgacgcgatcgaatatcctttttaaggggatgcaccccgtgttagttttatactgccatctatcccacgcccctagctagctgcatcctagctctatcggcgcaatgttgcgacgccgacgctcgtctgtcgtccatgccgttctcttcttcgcggcggtcgcgctcctcgagtcgctggccgcccagccgtggccgaaatgcggcaacggcggcacgttcacagcagggagcacctacgaaaccaacctcaagaacctcgcgctcatcctccgcacgaacgcctcctcggggtcctcgcccaccctcttcgcctccggcgccctcggctccgccccggacaccgtctacggcctcttgctctgccgcggcgacctgagctcctccgactgcgccggctgtggcaccaacgtctcgagggacgcggtcgcggggccgacctgcaaccgcaccaaggacgccatcctcgtctacaacgaatgctacgcccagttctccgacaagggcgacttcctcgccgccaccgacaactccggcgagtacagcgccctccaaagcggcaccaacatcagcagcaccgacgtcgcgggctacgaccgcgcggtcaccgagctcctcaacgccaccgtgcagtacgcggtggagaactccacgaggctgttcgccacgggccagcgggtgggcaccgacccggggttccgtaacatctactccatggcgcagtgctcgccggacctgtcgccggggcagtgccggagctgcctcgacggcctcgtggaccagtggtggaaggggttcttgttcccgcggaacggcgaaggcgcgagggtctccggcccgcgctgctccctgaggtccgagctggggccgggccccttctataccggcagaccgatggtgctgttgccggtcaaggccgacgggctcacgccggcgccggatgttgtgcctgccattacgggaggtgattaattaaactacagtattatacttcctcgtctcgctcatgctgtcccatatttttcccgggtaattttgcacggggcttgattttaactgttaacttaaatttgatttatactcctcttagtttatgttacatatataaagggagaatagccaatatgatccctaaaattttgctcctagatcattttagtccttaatatttcatagtgtccaaacaagtcctttaaatttgtcacgtgggctaatattgttcttggtcctaccaaaatcactatatggacatgccatgtcaccctcctatgtaaaatctatatgatttgtctaatttactcttacgtatatcatagaaaaattagaaaaaaggaaaaaagttaaaaatatatatatggtatatgtaagagtaaaaatatacgtaaaagggtgaaaaaaatgggaaaagtatttgttcctatggttatgtctaattcacccttacattctttttctatgatatacgtaaaagtaaattgggtaattcatcatagattttgcatgaatgatgacatggcatatccatataatgattttttggacccaaggattattctaagccttatgaaaaagtttaagggttttttagaccattaaaaggttagggactaaactaatcctacattgaaactttatggactatagtagctattctcccttacataaatatgattatattacatatgcaactagcgtacagtctgtgtgttgcaacggttttcttttaaaaaaagagcaattttacggtacttgagaaggtaccatgaggtacccttttttctattgtaaatttggattctctcggtacctaggtactatgaggtaccatgaggtaccaaattttacactaaatttttggtacctcatggtacctcctcaaagaccgtagtgtattgtatatatttttaaagccttaaaaaactatttctaccgtgtaatatatcaaggagcgatgaaaattttatattgaaggaattcgattattttttaggttttctctcactttttgcgtgcacatattgttgttggtggtgggtatcttttactttatgtttttgtatatacaaattaatttatatacaactattgtcgatccatttataccatttatagtcaaaattcttttcttttcttttcttttctcatgagatagatagatagattgatggattattatcaagcgaaaaaataactaaaatttgttcactgagcagcagctagaagcatagaactgtattattgtgtaatccgtttcatatttagttcttcacgtacttgaactcattatttttcactgcaaaaatgcaggtaagaataattcagcaagcaaaattctggtaattaccttgccgacagtgacagttgccatcgtagctgcaatttccctttgtatctggaatgtgcgtaagaagagaagattggcaaaagcagactccagacgtgagtccctgcacataattttggcataaatattaacattcttatacactggcgtccgttaacatttcgtcaaattcatgcaaatttggcagctgatagaaccgaggattttgaaagtgtcaagtcagcactgttatctctgacatcactgcaagtggcaaccgataacttccacaaaagcaagaagattggtgaggggggattcggtgaagtttataaggtaataggccagtagtctttacgtctacttctgaatcattgttgatttcttttgagaaaaatgtgtcgatttgatggtgtgaattgactatggtcaaaatataaattctaaattaaagttgtgtttagttgagcacaaagtttggattttggttgaaattgaaaatgatgtgactgaaaagttgtgtatgtatgacaggttgatgtgatggaaaaggactgaagtttggatccaaactttggatctaaacacagcctaatactcccttcgtccctaaatatttgatgacattgattttttttaaacatgttggaccgttcgtcttattcaaaaacttctatgaatattattaaaaacttaagtagtagtagtatatgtaacaatgaatcaaatgataggaaaataattaataattacctaaattttttgagtaagacgaatccggtcaaataacggcgtcaaatatttatggacgaagggagtacctagaagtatgaatgcactactgctcaattgtgagtgagtcgcaaattttgtgttctcttgaaacaaatggcgaagctcctgcctcttgtttagaaaaactattagtgcaggttagttattgtattttattaatagtgaaaatatattacatcctcgactttagccatataatacataggtaacaagttaacttgaaaaagacataggtgatgggacaaatcctcaaatacctttggaagaaaaccaattgatagacttaaaaagacacataaattctagcaaaaagtaagcctatatgtattacgccacccatagaaagtaaaagacctttggtaactaactctaagaatatagcataatatactgctcctcccatcgtaataacatagaccaacatttggatcagttggacgataagaagataacctgcattgcagagttagacatcatttttctgttataaaaatcttttatcattttttttcaatgccaaattgatgaatttcaagtgtctaggcactccccgaagcgagttactatttttttttgggcacctcaggaggaggcatattgtaaggaaaagaacacattgtcgtgcaaaatgagcaacatggcaataaaaataggtcttgaattgtttcttgcacattgtagacactatattgcttgtctcctctccaattccttttatgaaggttatctttcattaagattgctttttctataaagaaatcacatagaaactttgattttttatagtaacctttaaaattagttatgttatattattatatttttaacccattacaaaattttgtatttctgttcatgtctccatgtataagttagtaagaaagtaagatactaagctaaattatttagggagttctttccgggcaagaagtggccgtgaagaggatggccaaggactctcaccaggggctacaagagctgaaaaatgagctaattcttgttgccaaacttcatcacaagaatcttgttcgtctcattggtttttgcctcgaaaaaggggagagactgctcgtctatgagtatatgccaaacaaaagcctcgacacccatctttttggtactattagcattatctttgatcatttgttactcctgtaatcatttcactccaccaataatagtgacattttttttacatttggtgaaaaaagacacagagcaaaggaaacagctagactgggccacacgatttaagatcatagaaggtaccgctcggggactccaatatcttcacgaggactctcagaagaagatcatccaccgtgatatgaaggcaagcaatattttgctggacgctgacatgaaccctaagattggggactttggcctcgctaagctcttcgcgcaggaccagactcgagaagtcacgagccgcattgctgggacattgtaattaagttgatggaatacttcatatttttgtgcttatattaactaacaaactaatgaaatacaatcctccttgctgatgcagcggttacatatctcctgaatacgtgatgtgcgggcagtactctacgaaatcagacgtgttcagcttcggcattctcgtaatagagatcgtgacaggccaaagaaggaacagtgggccatatttctctgagcaaaatggtgtagatatattgagcatagtgagtatccccggtagttcacataggaattcatgatattgctttgcattgcaatatttgcatatttgtggatagctgcacatgtctatcgtaattactgctgactgctgaagacatacatatttgtgactattgctaggtatggaggcactgggaagaggggacaacagcagagatgatcgaccattccttgggaagaaactacaatgaggctgaggtggtaaaatgcatcaacatcggactcctatgtgcccagcaaaaccctgtagatagacctacaatggtggatgtcatggttttgcttaacagcgacgctacttgccctctaccggttcctgcacctaggccaacatcttcgattgatggaagctctggttactcaacaggttactcaacataatggtctggttggtagctgggagctagatttgtcaccgatgttgttgctttctgttgtttcatattgaaactattcattctcgatttgcaatccgtagcatccaacttcaattaatgaagagtttcgggggactattactcctcaggggttatatatagtttaactagttgataccccgtgctttgttgcgggatatgtgaatgaatgcatgttatacattataaaaatggtaaatgtatatgtttaaataatgtgaaaatgatgagtagataataatttgccattgcttgtatattgagttctaataatacagcaaaattgtaaatgatacgtaatgtttgcatgatatttaaaatactctagataataattgctagtgtgggtgatgatgtcgcacacttgcatgatgagttttaggagttaatgggcatcaattttatagtaagaaaggattaatgaaaagtgtccacattgggagattcctatcccattcaatctctcaggcagctcgctccatgcttttcgtctcaactccttctctcctctttatgtgttaaagattgggttcagagatagccctttccattgtgaaatcaagttgttagattcaacctatatgatgaacaaatagtcaaaagtgagtgttttagaaattatggtgaatactgttttcgcgggtaaacagtgcagggtggcactaggttgccggtcagatcggcagattccgtggggagttggtttcggattgttttcgtggaatttctatgttacttcatgtttatgacttctagattgtttctatatgtatgtaatattgtttgtgtgttgatgtcagtcaatttagtgtgaacttgtactcaaatatggtatttctttgttagttcatgtgcaaatattgcttgaggccataggagtatagccagtgatagattaggactaggcttgggagaagctgagatccaaacaatcaaggatatcacgcgggatgtctaggctagagaacaatgcacgtggagatgaaagtttccatatatcatacacgaggtgttgtgcaagtatagaaagagtagtcaaatttggattggaatccaagtttggaaagattagagtgtggagttgtacggggatgttgtttctctggtttcttagatttcctatgtgattagaagtctagttctagttggattcctagttaggggcattcacgttatggtataaataaatagggcatatttgtcacttgtttgatccagtattgtgaatttcctattatgggttaattggatcatagcattacaaatttgtctgtttggaaatatgctattataattcatctaattgaaaagatgccattgcaatacttctaaaatctggttcatgccattttatacgcttgagatgggttttgaattgtttttatatattgtattttcgtatggaccaaactaccgttggtcttcagtcttcacagcttaaaatcatccccaaatgtagctccaaaccctagccgagcgagcgagcagtggcgatagcagagcaagcggcggtggcggcggaggctccggcaccggcaccgagggctttcgctgtggcgacgcaacaagctgcagcggtgaagcaagcaacggcgacgacggagccagcagggcctcggcatcacgcacaaagcaagtggcagcggcgctggcagcggagcaagcagcggcggggcaccgagggcttcggcagtggcgacgcaccacaagcagcggcagcggtgaaggaaacggcggcggcggagacggcggcagcggcaacgctggccgcggagaaagcagcaacggtcgcatcgacgacgaagcaaacagaaggtggcggaggcgagctagtcctagtcgcagcgcgacaagttcttggagacaacggcgagctccagtggcattttcctttcctttttcccttttttttctcctctctgtatttttttcaggatcaaatactgcatatcgattctgaatttttttttaacatcagcgatttcagtttatttatttgaaatattgtggttcaaatctgtttttttcattgcactggcacgagcgatttcaatcttgatttgaaatgctgtgggtcgtatggtgatttatttttacggtgcttgagtggtaggataaggggtagtttggtctgtacgaaaatacaatagacaaaaaccgattcaaaacccatctcaaacgtatagaatggcatgtatccgattttagaagtattgcaatggcatccttccaattagataaattataatggtatattttaaaacagataaatttataatggtataaatctaattaacccttataaaatatgtaactaacaaattagactaacaccgttagaaggctggttttcagaaagaataggataaggatacccctgcacacaaaaattcaagattgacatcatatttgccataaaaagcttacatattgatttgccctccaaaactgatatggtcaaatgagattcaactctaacaataattgtcaagaagccgaaccattcctacaacataagcaaaataaataaataaataacggtattgctaaaaatatgtcgccacaaattacgatagatttcagttggttgtttcaaccgtcggatgcagaaatcgcacgtgtacacatatccctccgattttgttctcttctgatctcttctgttgctttaatgttagtatttgctaagtaggattactaattaatcttaaaaactaaatattggtgtcatcacaaatttatagttttgggaattacatcaacttacacatgtaattttgagaattacatatgtaattttaggacttacatatgtaattttggaatttacattgtaaatacactaaaattacatatgtaatttagtgacttacaatgtaaatacatagcgactattttttaataaaaaatatggcgccataaatatagctactcccataaataaatgttctagctagtagatcaagaaggatcggttcagaacccacataaaaatgcataataaactagctagggggtcgcaagcattttcgatgtggagtatgtaatgttccatgttgctcctgctgttgccttgttgctcctgacgcgtgctgctgctgccgccgcccggctgttgctcttaacgccgccggcagctgctgctcccttgccgccgccacctcctgccgcctgctgctatactgccctgccgccgctgttgagggggtttggggacccattttttgggttgatttgctcttgatgtggagaaagtgacgaggggatttggggattagggttcctagagagaggagctgattcttcacggtggagtgaagagcactgatcagaacagatgggcagtgagggggatcatgttttttctttgttatgaattattttcgtccgtttatttgaactaaatcaaacggcagtggcaaatcgaaggagcacaaaccaagtgttttagatgcactttctaaacacatattgatgcatataaagtcaatatactttcaagagtttcgccgttttgtttttttcttgatcctgacggtctaactggagtacaacggacggttggactggcggcggtagcaacaacatcatcaagcagacaaggagatcgacaggcggtctgaccgacgacgtcatcacaacgatctgaccggtgcaacttcgtaaagtttgagggtaatcttttaatttgcaagaagaattgattttggtgtttctaccatacaaccgcctccggttggcttggttcttatattcgaaccaaccaatattttgctaacattttgtccggttgtcccagtaaagagcaaatatctattccttaccattgtattattttgatttgttcaaaaaattttcatccagttcgtctccaagttacaatgtactactgatttatcaattgcttctactccatgacatattgacaatggattggatagtttttaaaagggttaattggatccatgttactgcaactttgcgaaattaaaaaaatgccactactattcatcatatcggccacatgccactggaaatttctataattaaaactatgccactcccgtccctttttccgtctcctctctcacgccgtctccgttgccgtcctcatcccctccctccttcctcatttccgttcctgacttcatccccctctccggcgagcggtagagcttgaggagggagttggtaacgacagggtcccgttcctgcgcacgccttccctttccctctccgtcgccgacacggtctcctcctccccgccactacatattcctcttgctggtgaacttccattgcacgcgcacaagcacagtcatcacagacttcggcgatctccatggctccatcaggtggggtgcgcgagcgcatcgcacttgaatgcatgctcgtgggcgaggcgcgcaaagcctgtggatggggaaggggcgggaaagacgacgacgcgagggcggcgaggaggagggagaaggtgaacggggtgggcggcgaggcctcgcggatgcggtagtagagggcgagggaggcgaccgcgggcgcacagcgctgggacagcgcggcgtggagcgggcagcctcgggagggggccgacgagaaggcaccggcagaggaggaggaaggtgggctccggagccaaaggagcaggcagcggaggcggtgtgggagctcgggcatggcgggagggagccgccaccgtcgttgtcctctatccgtgacaggaggtctcgggagctgccgccgtcgccgtcctcgacaccatccacggcgggagtgctcgggagccactgccaccactgccgtcatcaccgctgtcctctttgcagtcgcagggatggaggaatagatggtgaagaaagaggagggagatggaaacgattaaacatgggggaacgagatagtgaaaaagtgatgggagtggcatgtttttaaaataaaaggaaaataaaaccgctccctttgccgtatgtgggagttcaaaaaaacttccactaattaaaaacatgccactcccagtatccttttattttgtttttggctctaattaattcaccctaaggtagcactatctttctttttctaatatacgacaccattgactttttgtttacatttgatcatttgttttattaaaagaatttataaatataaaaatatttaagtcatgtttaaagaatatttgatggtaaatcaagttataatgaaataaatgataattatatattttttaggagtagttttttttaaaaagacaaatgatcaaacgtatatcaataaatcgatggcgttatatattaaaaacggaggaagtataaaaagaatctatccatcagacgcacgatgcccaaataatcggacggtcaaatattccagttgaccaacgagcgaaacatcaagttataatgatgaaaaaaccatcaattggaacatttaaaagttatatgaaacttggtaaagatatacgttgaaacatgtcgctgtcacatatgaaacaactagtattaacggattgaagcatacgtttttctttcattaaaatataatcatgtgatatcttattgtaaagatttaattacaacgaatacaacggtgtaatcagatcgtagattggataattagtttaggagaaaaatcattttgaagctcaatagaatgtgcatgtatggataagatggagagagagtagtggtaggtagtttcgggaattttgtaaaatacactgaagacacatacgggtatatatcactatcacgtataaaacattaggttctgacaattttaaatatatatattttttattataatataataatgcgatatcttgttataaagatttaattacaacaatacaatgatataatcggataagcggttaatgagaaaaaaacattttaaatcttgagtagtacactggtcagtctgagcgttcgataaaattttgtgaaatcggtagaccgatcagtagattttcgggaagtatatgatcgacattcttcatgcaagttgccgcgcgactgcctttttcatggggcccgaccgcgcgaaggtgcaagcactcccgtgaccaataatccattgctcctaaattttactccctccgtatttcaatgacaatgttgactttttgacaaacgtttaacctttcgtcttattcaaaaactttatataattataatttattttattgtgacttgatttatcatcaaatgttctttaagcatgatataagtatttttatatttgcataaaatttttaaataagacgagttgtcaaacgttggttaaaaagtcaatggcgttatacattaaaatatggagggagtattaattatatattgagttctacaagtatcttgtttaatactccgtacattttaggagctaattaaacatgtcgaaacagcggctacggggaggtttcccttgagactagtcacgatcagctttgtttatttccattccccttttcctttcagcaactgttatctatcatatcaactgcgtccatgcatgcacgtgggttttgacaagtaagtaagcgaaagtaatttcattttatgcatatcatataaatagttaaaaaaaatttaaaaacatttgataacattgattaatacgaaatatatcactccacaaacatacgaacttaaattcaattaatttctataagttctaaaaaaatacagtaacaaatatagctgcgaatgtacgataattattttcagtttaattttttttacaacttgtagaagttgaatttggttttacatatttgtggagtgatatattttatattagtatatgttgtcaatttttttagaaaaatttaataactatttacttcagatgacatataaacaactagagtaagtaacggggttcagtgaattcagtctgacctgtggtggggccatcgcatgccaagttggccacttgcccagagctgtcacatccaaaatgatacgcattccagctcaaaaactcaaaacgaatgctgtgccattgctacatcgatcgagcttactagctttccatcatcccaccactgcctctgctaagctactctgaccggccggcgccatgcggcggcgctcgtcgctcgtccacgccgtcctcctcgcggtcgcggcggtcgcgctgccgctcgccgccggccagccgtggccgagctgcggcaccggcggcacgtacgcggcgaacagcacctacgaaaccaacctcctggacctcatcagcgccctccaggggaacgcctcctcctcccccaccctctacgcctccggcgccgtcggctccggcggccgcgacgccgtctacggcgtcatgctctgccgcggcgacctgagcacctccgactgcaacgactgcggcaccagggccggccaggacgtggggcgagtctgcaaccgcaccagggacgccgccctcgtctacaaccagtgctacgtccgcgtctccgacgccgacttcctcgccgctgccaccaacaactccggcgaggtcgccctcatgagctccaccaacatcacccgcgccgccgacgtcagggcgtacgacgccgcggtggtcagcctcctgaacgccaccgtgcggtacgcggtggagaactcgacgaggatgttcgcgacggggcagcgggtggggagcgacccggggttcagcgacatctactccatggcgcagtgctcgccggcgctgtcgcggccgctgtgccggagctgcctcgacggcctcgtggggcagtggtgggacacgttcccggtgaacgtggagggcgcgaggatcgccggcacgcggtgtaacctgaggtcggagctgaaccagggcacgttctacactggccaaccgatggtggtgctgcgggccgacggactcgcgccggcgcaagggccggcgccggcggctacgacgggaggtgagcatacaacatactccctccgtttcgaaatgtttgacgccattaactttttagtacatgtttgaccgttcgtcttattaaaaaattttaagtaactattaattctttttctattatttaattcattgttaaatatattttcatgtaggcatataattttacatatttcataaaagtttttgaataagacgaacggtcaaacatatgctaaaaagtcaacggtgtcaaacatttcaaaacggagagagtatttagttggagatgtattttcaatcctcgcggagaactggagatatccgctcatttcttacatatgccatccaaataatctatttaaattaatatgaaaaatatcagtccacaaaaatacatggttaaattcaacttctacaaaatccaataaaaaaaacaaattaaattgaaaatagttaacgtgcattcacaattatattttgtttgttgagaagcagctagcagcctagcactgtgttgttgtaatgaggtgctacatagaagaaaaggtacagtactttggatacttgaactgatcattttctatgcaaaagtgcaggtaagaataattcagcaagcaaagttctggtaatcgtcgtgccgatagtggccgttgcaatcgtagctgcaacttccttttgtatatggaatgtgcgtaggaaaagaagatcaagaaaagcagaacatttctctgaacgtgagtcctctacaaaatttagcgtagaattcttcaaaaattccatctaacattcgaatatcaattaactatatcaaattcatgtaaattttccagttgacgcatctgaggaccttgaaagtgtcaagtcgaccttgataactctagcgtcattgcaagtagcaacagataacttccacgaaagcaagaaactcggtgaagggggatttggtgcagtttataaggtaaactagcatgctggcccgcgcagattgcgcggctagcatcattatattttctctcatataatagcatatttgctttctcattatatttttcaaatatattaaaatgaaacataattttaaattttacaataactttatgaaactactaatgtgtaatattcatattgtatttttatatacgtgttagttattaattatttttaatatcaaattttagttatttgtaaattatatatattcctatatgtactatagacctgtcttttaatatttctttttttattccgaattttctgtaaattgtatttctatatagactctaagctcttcttccaatattatttatttttatttctgaatttttattatttctaattgtatttctatgtggactctaaactcatctttcaatattctttaatttttaatttcgaattttagttacttctaaatcgtattcctatattgactttaaactcttcttcccgtgtttttcttaatttcgaattttagttacttgtaaattgtatttttatacggactctaaactctacttttaattttattatgtgtattctgaattttagttagttttaaattcctatatggactctgtactctacttctaatattccttatttttttatttccgaatttctattctttttcttaattgtatttttatatggactctatactctacttctaatattccttatttttaattccgaatttcagttattttctaattatatttctatatggactctatgctctacttctaatattccttatttttaattccgaatttcagttacttcctaattgtatttctatatggactctagtctcctcttctaatattccttatttttaattctgaatttcagttatttcttaattgtatttctttatggactctagtctcctcttctaatattccttattttttaattccgaatttcagttatttctaaattgtatttctatatggactgtactctcctattctaatattccttattttttaattctgaatttcagctttgctttttctttttcttcgattaatgtgagaatttctatgccatgagagcggactgtactctcctattctaatatttcttattttttaattccaaatttcagctttgctttttctttttttccgattaatgtgagaatttctaggccatgagagcgaacgtggaggctactttttctattcctttaataatataatagatggtactccctccatcccaaaatataaaaaatttaagtgaatataatacattccagtactacgaatctgaacaggctaaaatatatcacatccacccataattctttatattttgggacgggagagtagtagttcacaggtaacttttgaacaattgctgatttccttttagaaaagaattattgatttgaaggtatgaatcgagaacggtaaaaatatgaaattctaaatatgtcttgattcctgagcgcactagtactccattgctaatttgttatagtttatttttacaaaagatctttgatctggctttattggaaaaaccaaatattgtaaattagtagcatatgcatgttagagtcttaagtcattacaaaattcaccatttctgtccatatctccatgtataaagcaaattagctaataaactaagaattattcagggacttctttttggacaagaggtagccgtgaagaggctggcaaagggttcaaaccaagggctagaagagcttaagaacgagctagttctagtggccaaactgcatcacaagaatcttgttcgtcttgtggggtttttgcctagaggagggagagaggttgcttgtctacaagtacataccgaataaaagccttgacatatttcttttcggtacaattataattaccttttaatctacatatatatacccctttcgtttgctgacatgcaataattacaataatctcttcatcacgtgtcaattag

SEQ ID NO: 41451 - DNA, 5593 bp, Oryza sativa
tgggcagtactctacaaagtcagacgtgtttagctttggcattctcgtcatagagatcgtgacgggacggagaaacagcggcccccatttcttagaacaaaacgaagatttaataagcatagtgagtatcctgctaactcatagacaaatacggagtatattgataccgcttacattttaatatttgcatttgaagataaccatgcaatatatgatctgcaatattaacatataactcacaatatgtaactgattctaggtacggaggcactgggaagagggaaatattgtagagatgactgaccactccttgggaagaaactaccctgaagctgagctgctgaaatgtgtaagcatcggtctcctgtgcgtgcagcaaaaccctgtagatcggcctacaatggcagatgtcatggttttgcttaacagcgatgctaccagcactctgccggcttttgcaactcatagcccaacaatttccatcgaggggaactctggttactctcaaaccgttacacaattgtctcctagatagcagggggctaaaacatagttggtactagaaaataccccgcgagttgctgcgggatataatgtatctaaacaaaatgaagtgaaattctaagagaacaattgatccatcacatttagacatagtgcataccaataaaagaaagcgaaattctatgaggacatttgatccatcacatttaacatactatatgggttggataggtccaagtactccttagcagagcttcatcctgtttcatcgattataggaaaatgaattttcttgactacaaattttggaaataatacaaactcatcttatgaggagattgtgaaacttgcgtaatatatgtgtaaggacaggaaaggtgtataacaatcaaagacctgtttattgcgctatgctacaaattaaatgaggattagttgtactattctttttagcaatatatgacagactgatagagatatataagagatggcgttatattatttgattggaataaataatattacaataataaataaaataatagagtgggctaagctgatgaaacaaaatggagaagcaaagacggagttattgaaatggatgatcctgggagctgcaacttctttctgtgaaccaaagaaatggagtcgactgaaggtgataatcttgaactttgttttgtccttttccccctactcaagaagagttacatctaagttcgcatgttttctttctcgtctgctacctactatttgtgttgggccaaagtattggctgaaaacgctcctttcttgtttgagctggtctccccagcctgtggatgtaaaaactctctttatataaaagctgggccatctggccttctatcaaaaaaaaaaagttccagaaatcattctcgttgaatcgtagtatagctcaaatatgaatagaggtagaaattaatgaccagaatttactttcccaattagctagtaagagcatctatgataaaatccatcagcatgatataacatgaatggaggggaaatgtgacattaaattttatgaaggataaaaaagtgatatcatgcagatctagccaatggctaggcagatgaagacaaacaggagcattgcctttttctatacaggaggaatgagtacaaccaataaactcatcccaaagccatctgtttcaaccttgtgagccaatgagctgatcagctgaacatgggaaaatgagggaagagaagcacctgattcagcaagaagaccccatgggaacagaaaaaaggtataggccaggaagacacgaatgaatgggctgcttgtgtgcaatgaaacaatctcactgaaggagaaacaattgtgtcggtttgtgtccaataaatcaatatgaagattggcgaatccagctgttgtgctgcaacaatttgtttcatagcaaaaggggaggctaaaatgcctgctaaaatgctgcatcgaaccgaagccaccagatgagttggacatgattacatgagcccttttacagatggaaaccgcgctaacaggggaaatggatttgatggatctttgtatctggaccaggaagaaacgttttcgtgggtatggatgaacaacttgttagtgccattgctaccaggtatacatgtatcctgtaggatagtagttggacgtgggtgtagctgcgtaggcgaacagattgattcgttgtgttgttgcttgtttgtgggagctcagcatgcaagaagatcctttaatagctacccttccagttcttttcctcttatattccttgagaagtggaagaggctgttggtttcgcagagggagagaccgtgggatggtggaaccatggaagatgaaccaaatgacagtttttgatcgagccatcaaggaggaggcgaatcgatgaggggaagaggactcgacaacgcacgatggagaggcctggtgatgcgccgcctacgacactagtcggaaggaggaagaggaaaggttcactggctggcccaggtgggaaaattgggctggcctcagcgagcaagagaaaaggcctcgaggaagcaatttgcaccgttaagaacgtgaatccaacggatggaaataagtggtgacgtggctcaacctcaaagcaggaaattgctaataactacactaagtggggatgatttgtataggtatataggatttgctcgttgatgcttgttttgttttccgttgaaattgtatcttttatcagtttgtaatcaagaattgtaaagttaaattataaacatggagatacgaggaaaaccagtagtatgtcactttctttttcccttttgacttcaattaattagtttctcataagatacttttagcgtaggagtaatggatatccatctgaccatccatgcaagttgttgcagctaccgcggctggttttttccacgggggcgccaggtgcacgcactccacacccaaccatttgattatttctagttaagaatgggtcaagtgttccaatcgattaagtgcgtgctaattactactagtactcgcatgttgaaacagctgctgcgtggtggtttccgctcacctttattttcgacaacgaatgatcgatgaaacgtcccccctgaatgaacgtactttacgacgtaagcatctgtctaaaaaaacacgaataatagaaaatgacctaatatcaaataattagaagagtgacttcgaattcaggtcgtctacctcaccaccttgtgaagctagctggaagactctgggtgtttctcatgaacatctgcctaacgttgtgtggtgacctcagtctctgtgggctatcgccatggcaacttgccaacaccatcgtacgtacgtgcacgagaaaaaaacatttcaatgccgcgcgaaaattctatcctcttttgctagcttccatcccactgtgcatcctgctgactgtgacagctgcgtccacggagcgccatgcggcggcgctccacgttcgccgttctcctcttcgcggccgccgcgctaaagaacaccgccggccagccgtggcagctctgcggccgccgcggaggcggcggcggcggcacgtacacggcgaacagcacctacgacaccaacctccagagcctcatcgccgccctccagcagaacgcctccacgtcgcccactctcttcgccgccggcgcgctcggcgccgccccggacgccgtctacggcctcatcctctgccgcggcgacgtgagctcctccgactgctacgactgcggcaccagggccggccaggacgtcgccccggcgtgcaaccgcaccagggacgccatcctcgtctacaaccagtgctacacccgcttctcggcggccggcgacttcctcgcctccgccaacaactccggccaggcgccgctcatgaacagcgacaacgtcaccaccgccgacgtcgccggctacgaccgcgccgtcacggaactcctcagcgccaccctgatgtacgcggtagtgaacaccacgaggctgttcgccacggggcagcgggtgggcgccgacccggggttcccgaacatctactcggcggcgcagtgcacgccggacctgtcgccggcgctgtgccggagctgcctcgaggacctcgtcgccaggtggtggaagacgttcccgcggaccacggtgggggcgaggatcgtcggcacgaggtgcagcttgaggtcggaggtatcccaggacaagttctacaccggagccccgatgctgaagctgtgggccgacggcctctcgccggcggcggcggcggcgtcgccggatgctgcgccgggcactacgggaggtgacaataccgcgtcatttcgataacatatactccctccatttttaaatataagatatcgttaatttttaaacatgatatttgaaaatttgctgggttcaaatttactgcaaatatgagaaaatataagtcattatacttttttatggttcatggatttctgcattgtttatgttataccggattacttttgaactgataagtctgacttttgttactcgtcacattcttggtgttatgtcagataatcaccgcgcagacagtcaagacccatagtttagcatggcaaatgctgtattacatcatgtcacgtatatatattagtagtatgtcaattaacgatgactatcttcatagctcattgttttcattgagtcttagaaaaatcataaattggcacacgaagagacagagacggatccagaaagaattaatatgagggtctgaacaaactatacaaaaattataaacccatcttctaattaatgtatgataaaaaattttagtggggtcttcgtgggggctcctatggttacgacacgggtaatggagggctcgagacccccatagacccatgaaggatccgccactgcgaagagaaagtcaattttgttcgttgagcagctggtagctcaataatcagctgctcagacaagaaaacaggtgctctgttttgaatacttgaactgattattttccctccaaaatgcagtcaagaataattcagcaaacaaaattctggaaatcgtcttgccgatagtggcagttgcaatcgtagctgcagtttccatcctcttgtggaatatacgcaagaagagaagacgagggaaagcagagcatttcaccggacgtgagtgatccttctcatcattggcataaaattcttatcaaattccactatacattgttaatcatccgtattcattaacagtttatcaaattcatgaaaatttgacagctgatgcagctgaggacttcgaaagtgtcaagtcaaccctgctatctctggcatcactgcaagtagcgacggataatttcaatgaaagcatgaaactcggcgaagggggattcggtgctgtttataaggtatggaagtaaccttttatgtgttcttttgaggaaataattttttatttcacggggcgaattaagcatggtaaaaatatgaaatgataactttttactatgagtgtactgatccttaattgttactttgataatttaattaattaatactatttggcaaatatcattcaagatcgcctaatattgtaaattagttacagcaccaa

SEQ ID NO: 41452 - DNA, 1136 bp, Oryza sativa
acccatgacattcagaaccccagagtccgcacattcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcctgca

SEQ ID NO: 41453 - DNA, 2481 bp, Oryza sativa
  unsure (1)..(2481): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatatttcaaactcgatgtataattacgttgataatatttgaataaattatttttaattattgtataaaaatattaataaaatttttaaacaccataatttaatatataaacttcaaagccactatacatataagggcatgtttagtagagtttaagattctaagaagcagttagctggtagccagcttctaaaaatctttcacttatggctttctttctagttcattttcagctataccttttaaaggaacttctgattctgaaagaaagtgcagctaacacaaacaggcccaagcttttcctaggcagcgctataataagataagctctaccttaccactatttaatttttatataaataatataggtgcatttattctaattttttatttataggataaattttaaataaataatagatgtgcccttattttgggaggtaataaggaacaccaaattctctttccacattcacgttaccggcaaaaataaattaataaaaaagggaattgctaaccttcagtcgggagaaaatgcatgcccaaatcttgcagatttttagccactggatgagcttcatgattcgtgctctagaccttctcctccaactccggcaccctctttttctccaacgccggtgaaagcacgacagaggaccctacaggttaggatctcgggagtgggataggggtgggagggggatggggaagaggggggttcaccggctttagagggatgcccatgtgaggcaacgaatcgggcggacgatgaggcgtcggtggcagtcggtggcagtgccagagccacggggatggagaagggtggtggaccggctttgatggcaggggcatctcgccaccgatggctcgaggaggaaggaggccggcggggggggagggggtctcgctggcgctgttgatgccctccgggcagccgacgagacgggtggtggggcggtggcggccgaagatcaggcagtggtggcgaaatgcgtgatgggagcggtggcggcagaatgcccgagagagagtggaattaaagggagatagttagggttaacggcttcgcacgaatcttaaagcatatccaacggttcaaaatttgaaacatggttggtgagattttctgcgaacaaatatagacattcccttaaaaaaaaacatatacatgacccattccatttcactctcgtcaccatgagcaatcttggccttgtgttcttgatcctgcaattgctgtcacactagcaaaacaggaaacccaattcgatcccttctatctatcgatccaatccaacgctgcagagaccctcaaacttcacctctactctctctctctctctctctctctctctctccctccttccggcggagctacggcgagccttctcccccgcgccgccgcgcggccggcgagcaggttcggaggagtcgcggctcctcctcctcctcgccttccctagccttctccggcctcgcgctcgctcgctcgagccgaatttggagtcggaggtatccattctcatctcgtatcctccctccctcatcctttgcgcgcgccttcacgtgctgtgtgctggcgtctgtaggtagattgggaaatacattcggggtggttggatcgaatcgattcattgcgctccaatttttaagtaattaattcttccagttcgtcccgatttgcggcttcttgttgcctgtgtggccgcagtgttgatgtgtgttactggcagtttgtttccacggaaatttgagccctcccacgttagatccgcacctgcatagatctagacacgaaatttcttctcaagtgaggggatgggtgtagtgtagatcaaccacagctcctcctttcaagaggagtataatgatgtgcttgtttatggaatgtgcactgtcggtttgggtgcaagtctcagaggcgtaggtctacagccagatgaaagatttgttttgtttcttatctcttctcaatttaccagtttaatttgattgcattgctaattagctatctccgttttactaattatcgtatatctcctagttcatgagtcggcaccttgttgtttttgttttactataaa

SEQ ID NO: 41454 - DNA, 22170 bp, Oryza sativa
gttttgaggttctccattatgagcattaatgcttagattgcaacagaacaaaaaaagagcattaatgtgaatcttttacctgtgctcaaattcattagttattgcatgcctttgaatttcagaaggtccgaaatttcagatccagaaaaaatcaaacagtactattacagtatttgagaaattaagaaccgcagaacatgaaattatagtaacacaattgcaaaatccacaagttggaatgtgacgttgcaaaaggcgttagattaacaaaatatcattctgttagttgttacattcacttgatggttggtcccacctgatagccacctctctctttcctcttctccaaatctgaatctctctctctctctctctccctcgcccattcattactgaaaacagtgaacttgtaatgtaaatttctcagcactaacagagccacagagaacacatgaactaaacggtggtgttattttcataattttgatctgatctttataggatgatagttgataaagatcttcttttgtggcaatatttccctaatttcatgtccctgctatggtagaaaaatagttttctcaatatattttagggttagtgactagtgactcgtattgatttcacttgttttttctatgtgcatttatatatgcttatattattaaactcatgtcttaattaaaatatgtttctaatgtagattgtgatactccaaaatccaaattggattagattctacatgacaagagaacatggcacctggaagcaaggcagagagaaaagcagcattagatgctggagcttggatgttcaacattgtgacatctgttggtatcatcatggtcaacaaggccttaatggctacacatggttttagttttggtacgataaattgataatgctttattatttactcatatgtgtgatcacttggaaagatgaatctgtaacaaactcagctactgaacacatgcttgtactaatatgggggtgctattgcttgtacagctacaacattgactggactgcattttgcaaccacgactttgatgacattagtaatgaaatggctgggatatattcaaccgtcctacttaccagtgccagaactaataaaatttgtcttttttgcaaacctatcaattgttgggatgaatgttagtttgatgtggaactctgttggattctaccaggtgaagaaagtaactaagtcctttaatgttcacttttagaattggatgcatatactaatttgctcctcatgcctttttcagattgccaagttatgcatcattccagttttgtgctttctggaaatcctgtttgataaagtccgatactcaagagatacaaagttcagtataatggttgttctagtaggtgttgccgtgtgtactgtgactgatgttagtgtgaattcacaagggctcatagctgccataatagcggtttggagcactgcactacaacagcatgtgagtattgccactcctagattgtgcctttgttgtccccattcctacatactgagaattctcctgtattaactaagtctctactttgatacttttgctcccaagttggtaatattcaaacctgaaaaaaaatagtatgtggtgttcccttctacagaatttccaagccattaatgtgaactcatgtgtattttgcctcatcctataaacctgaattttgtcccctttgttgtaggtttggtgagctaaagaatgtattagcttccatctaactactgttctgattaatcgtgtagaaaagaaatgtttagttagtaaaagatcttcaaatatttggatattgctcgtttgtctgctaatagaagtcttgtcccttttctacgcactttcatggcaaattttcttaacactattacttgttttgtttctttgcttctgtgctgcagtatgttcatcaccttcaaaggaagtactcgcttggctcattcaacctcttgggtcatactgctccagctcaggcagcatctttactagtactggggcctttcgtggacttctggctgaccaacaaaagagttgatactttcaattacacagcaatagttacggtatgcggtgattctctgtttatcttgttataaactgatcattagaaacccatatagctctactgataatttcaccaggtaaatattaattaccatgaaatatggtagtatatcctggaacttgaaacatttttctgcttgggttcccatcggtcggtctagtcttaggtggtgttcttttgtcctaaaaatgaagatgaagatgaagattaagttttttacgcaaaacgaggtgtcattaacgtatgattgattgagttttaattattataaacttgaaaaatatattaatatgatattttagagcaactttcatataaaaagttttcgcacgaaacacaccgtttagcagtttgaaaagcgtgccacgaaaatcttaatcttcatccaactcttgttggagaaaagacaacaagaaaagaatagggccttattataagccataacggcttattagcgattaaaaaatgatatgtgagtaaaacttttgtatatatgttcttagtgattgaaaagccaaagttgaaaaaaaaactacgttaaaaaagaatcaaagtcaaattcaaaatcaagttttaaaattcaaattttggctttggcttataagccatagggcaaacgatgaggcccttggtttggttcaagaatttcaagtaggcttgaaagcaatgaggactatgataaataatgtttggtataaggttaccgctacctttaacatgttcttttaagaaatgtgttttctgaagtacttgttgcattgttctgtactggcaatgtctctttctatctcctttgtgcatgcttattgtgtcaaaattcttgtaaatatgtcatattcaaaaggtgtaatcatgcataaacacagaattgcacatggatagcttttacatacccaatatcacacatcaaccaattataaatttatgaaacaaccatgtaaattcctctgactaaaaagatgtgtcattgaaatacggaagctgtgtctaatagtagagaagtgtatgaactaaaaaacgccttactggtaatgctttattgctttataaggttaggccattaaaaatattgtatgtgcatactatagatgcttcttagacaagcatttctttcaactatgaataaaatagaaaggagcatgtgacagatttggaggatatattttttataatctgttgttgccatgaccattactatttttatcgtggcagggcctaacattttctttttttcatctacctgcattgtagttcttcatcatactgtcgtgcataattgctgttgggaccaaccttagccaattcatatgcatcggaagatttacagcagtctcgttccaagttctaggccacatgaagacggttcttgtgttgaccttgggctttcttttctttggaaaagagggccttaacttccatgttgcgattggcatgatccttgctgttattggcatgatttggtatgggaatgcttcatcgaaaccaggaggcaaagagcgccaggtttactcagcacccagcgagaaaacacagaaacacaatatactgtcatcacagtctgagcttgaccagaaggtctgaaatacaatgttgatgactagtgttttattgaacatcttgaggaccatgatctgatttattctttttacacgttttttagatgcttctatagaatttgtaggctatagcagaaagagggtacctgggcaaactgtcctggctatacttttgcggcgtatatgtcaacaaaaagtaactagatgttaatttgaattttaatatttctttaactgcaagagcagtgctgtgtaacttgtgttcctaaagtttttatgtgcaccacctgcatggggtaaaagtacaaatgactctcccccttgtgttgtcttggttgttttgacaataaattgtgtcattcattcagtcgacaagttagcagcatttgtatttggggcactatctgtaaacagtactgaatcctcatgaagagctttgatacaaaggattggttcctcttaggcaagcaaatggttttcccctcgttaggaggtcgaaaattattttactaactgtaaaccaatatcttttgtggctgctattctctatctgcttctcccttcagactgcacacaacatgagcagattgtcacactgagtacagtccatctgccaagtatatatcaacatcgtctctttattaatctagtaagagctgacataattgacttgatcctctatgtccagacccttctgtcgatacaaagacaagccatctgcacatcagcagcacatcatcaccttaccccattcaactggagtgcatttcttgcagcattcaacgtcactctaattgatactaaataggtgtgatttttttttataagaattagcttctcctcccacactacagcgatgggcggccaagtccaattcgcaagcacgcacgagctctccctcggcgccaatggtttgagtcagaccatcgtagaagaccacgtgtactctatatacatcgtgtatcgtacttactccattctaaaatatatataactatctggtagctaatatatactccataatataactatatggtagctatattattttaagacgaatagaatagtttgtatctcagtactgacggtttctttgctaaactcacttgataactacttgagagaggtttgtaaaataaaaaagaaaagtagaaaactgattgaaaatttctagtaaatacgagaaccattttgattagagaatacatatcaaactatagagtggagttctcaaaaaaaaaactatagagtggaaaattttcatttagaaaccataaaactttgtaccccacccacagctttacgtaggaaatgtaacattttgaatgtgatattcaaatttggatagttttcataggatgcaactttgaacttagatgagatgaattgagcttcaacgaaaatagtaacggtgaaatatgtgcatatggaaaaaaagcgaaggcactagaggaaaaaacagaatctcgtataggccctcccaccacctgatatctagttttttttttattttaaaaacaagtctcgcctttcaaagaaattaattataacgtgaagaagaaaattttcacttataaccatgttcctttttataaagatataaaatttcaccttggttttcattagcacacattttaaaatattaaatggtgtatttcgtacgaaaactttttatataaaatatcagataatttaattttcaaattatgtaataatttaaactcaattaattattatatattatgctaatggttttcttgttttctagtatattctaactttgatcttcaccatgttactactacttcctctgtttcacaacgtaatgatgttaatgaatgtatatagcatcaatatgaatatggaaaatattagaatagaatgacttacattgtgaaacggagggagggagtacaatactagtttctttctccaacctactaccatttattattgacgtggcggcgaaaccgtgtatctcgttgatggtattcatgcacatccttatcctctctacagtctacacccttgtaatagcaccaccctctcctccatcgcaccaaccaagcacacagtcgctcgctagcgaagcacgcgatctcgcaattcgcaagcaaaccaaccaaaccaagaaaaccgaggaagaaggaggcgaaagccattagccatccatggaggccaacaagagcagcaagccggagagatcatcatctcagcccacccacgacgccgtcgtcccggcgtcggcgagcggcggcgctgcggcctcctgcgaggcgggcaggacgccatcgtccggtggcttgccgttgtccaccgccgcgtcgagcgagaagaggccgggctccggcggcggcggcgagctgccagggtggaagctggactgcctctgcagggagtccggcatgtcggcggcggtcatcagcgggggattcccctgcttctgatcgagtacaactaggctaggctcctgtatttggacgcaagaatttttgtttggatcgcgtcggaattcaaactattctcggtgaaatctctctgaaattctcgcgtttcaaacagggctttgcaaagcatactttactacgtacttgtcttgtctagtttggttgtgttgctgtgagctatgatccatatatatgatatatgttcatcatgttcatttgtttgtttcttttcactcttaagtataaggttgtaagagatcatgctgatcaagttctactgatcttgtaattcaggtctgccaattcttcttagaaaagcttatgattaatgatttattttatggacatagacacaccaaccaaaagcctgtctcaaattaacccaaatatcacgaattattacatgagaaaacattaggaaaaacaagaaatggaaggtactacatcactaatagcagtatggattttggaggcagggttatcggggttagtagcttccaaattatgaaaaacaagaattggaaaggtactacatgtggaatggcagtatggcacatgttttgaaagaggtgttcagttgagttcatagtcagcttcatcatgtgctaattgatttgatgctagtttgtatgattcagatccatatctgctactaataaagattgcaaggttcagttgtaatatcagaagtttcaagtacaacccagttttgcatgcaaagcttcaagagataagtaacaaattacaaaccagtcttcctggctgacatagacattagacaagatcatagttatggataatgcaaccgctgacgactttctatactctccgccagtgacagacagtgatggaaaggcaggctttccttgaccccttccttgagaccaaaaaaaggacagtgacatcttagatctgtaactgaacttcactgctcattgatcataatacccaaaatatcttcagatcattcacaggaacacagcccaagcacttaattggtttggtataaaaccttttgcaattcgatagcaaaaagttcagtatcaggcaacgtgcaagcatgtaagatttccttacttgcctcgtctgttgattacatacccaggtagggggcaatatacagcttacaaaactcagccaagatcttggaataacttcagctatgcctacattcctagacagaaactttgagctgtacacaaacaaaatcgtttacatgtaggtattggcgagctgctcaaaggtatacactaccatacaatggaagggcaaaatttagaggcattgggttggacctcaaccatcgatcctcatccttttgataaatttgctaggataaggtacaatgacaagtagcatctcatccaagtcaatttgaaccagaatggcaagagcgatattagctgtagggacgacgtctcaaaatatgttggttttggagtagatgggcatccaagtgatctgatgagctctacgactggcaagaccttaaatttcgttggtgtgttcttggcaacattatcaaccttatgctcatagatcttcccattcttgtcaaacttatactctgaggtgccttcaaatctgccagggccatccgagagaactctaggaatgccatggacaatccagcggatcatgattacatcctcgacaggctgccatatgctgataatgtcgatccatagtgctttgaagaaaatttgcccagtaaaccgtagagcccagaatatccttttgtagttatcaatacccgtgaaattattgataggatctttgaagacaatatcatctctggaggcagtatcacagcaggttaggaactaacaaggattgcatcttctttcagaaatgaatataccatgatagataaaatttgttctggtacatagctaaattctgctaaaaatcaaccttgaggtcttgatatttgtaagtttgcttgaatacaactagcaagaatttgttttatgttgcataagacttcacaaagaattttaatgctgagctgatctggtattccacatacccactagcatgcatgagtggccactccttgatttcttcatacatgaacgccaatatgcagtgtgcatgacatacaagcaagttgttcgatatcaagtactatcctaattctattactgtgatgagtagattttctaaccgatatgtgcttatatatcaatatttacacctgtttgctcattgacctaaaaggtttatttgtcatggaccagagatagcatcgctaaccatggatgagcacaggacattgttatcaagcagaatggagaacatctttcaagtagcttgaacgataaaagccagaagctaacatagaagtacaaaactaaaaatgtggctaacaagataaacaaaaggagatttattgaagcaaaggtgacttcaaaaataaaacaatcctagtcaaaggagtacagattatgggagtagccctagaatagccttccaaagaaagaaaaccatgggcagtcttgaatgagttatttattcattgcttaaccaccagtcaatcagttgtatttctgtatatgaccaacctaaccaaacactccctccgtttccaaatacttgacctccgtttccaaatacttgacacttgtttttgctatgtaaaccatatgttgttcttttaccaatagtactaaagtgcattgcatcacaaatccaacggtgacttccattcatctaaacagaataaatatgaaattagtagtagtcacaatttaattctccctccgtttcatattataagtcgcttcgacttttttcctaatcaaatttctttaggtttgattaaatttgtaaaaaaaaaagcaacatctacaacaccaaattagttttagtaaatgcaatatagaatatattttgacagtatgcttgttttgttttaaaaatgttgctatatgtttatataaactaagtcaaactagaaaaaaaattgactagaaaaaagtcaaaacgacttataatatgaaacggagggagtagtaagttaacgtgcgaagtaaatgaaaacaggcagagagttctcatttgttggccatctgttgatgagctagcaagttgtatgtagctgctgccccatggaatcccatattgtaactttcatggtaccataatgggctgcatctgacaatctgacatcatcaaccctcatttggctgcagaaaaccttgacacaaccagtttgtgtacaaataacatgctaatctaagaagttaccacattattttgttgatataagcaatggcctccatacatttcttaatgagtaagtgtatcttcttcaggcaaaaaaaaaaagagaggaaataatgctattgatgccaaacatttcgttctgtattttacaatttgtaatgtctccttaccttattggtaatgtgcgtatggattctgataccctctagaggtatatcaaatgtaattaggaaaatttgaatccattcaaaataagctgaggattaatgctaaacttaacttgagcgtggtttataacaaacaaaatgggccttttttgtagtctggaaataataactttgaataagaaatacaggcggcaaagttggggtaaaggatattgaagtaatcgggtgctggttccatacttggtgcttcacagacagcatgtgtggactaagaaaaccataatattttgtggctaagaataaaattgaaattttgctttgctcaattagtagtagcaagaagaacaccttgataccaaagttttattgtgacattttgtgtttttggcatccacaccaataattctctcatagttccacaagtctattatatactaaaagtccattaaacatactacaaacgctctcataccgccatgtggcattcctataaacgctcctaaatcgccacgtggcgttctaatagattaggaatatcgagccatcgattttcatttaaattggtgggtccattattttagaccattagatttaattagattaaaaacagaatttaatctctccctctcctctctctctctcgtgtacgtgaacctcacacgtacgtacacaggtaccgtaggtaccggactcctcatttcttttctcctcattcaccctcttttttttatttccctcataatatatttatattacctccggtctttacactattgacctttttatatttgatagtatcttttatcattcgtttgactaaaagaaaatacgtaattatcatttattttgttgtgattttacattcatgacttactttggctataattaatttagtgcacaatagaatacgacatatgatatttgatatgtagtttttcagccggtcaaatatatatcatttttttcatttttttaatatttgtttaaatgatactaaaaagtcacaataaaattcaaaataacatatttctttaactataaactataaataatccaatgacttaaaccgataaaaattagctatttattaactatggtttctaactaatatagagtgaaaacggtgataattatggtaagtggatagacattataggcatcatatgtacgattatctatctcattgtacttaatttatgtccggtggcactcctgtaaaagctcctacatcgctacgtggcactttcatttagaccggtagacccaatattttaaacaattaaattttttcaccattaaatcttatcttcaagaaaaaaatctgcacgttcccgtttcaataggtattatatgttccgaaaagaaaacataatgcgttcacatgtatgtacgtaccccattccaccccctccctctgactcttcccttctgtgtctctccgagttctttcctattttttaagctaacaaccaaatacacagtatataaaaataatctcttggtacatatgtttctatatagaaattattatgtcacttggatgaatatacccttcagtgacgaagtaagaaaaaattatccggatatcactttgatatataccatttcttttcagtggcgaacccataaaaaaattataaaaaaaattaattattaattgatatattaattaatatgacatgaattatctattattatatactaaaagtccattagatatcttacaaatgctcttaagctgtatacatggcttcctataaacatttctaagctaccacacgacgctctaataaattaaagtaagtataagaaattctaaggaaaaaaaattattttacccaaaccgatggatcttattttaaaccgttataaactgttagatctatatcttaaaaaaaccctaccaaacgatcagttcgtcagagtgcgtatgtacaacacatgtatacagttccctcctcatggacgagacgaatccaacgcctctttgttttccttacaacaattgttaaccaaaagatcctaaaaattaccccccaaaaaatccaccttaatgttttaataaaatttgtgtactaattactttataccattagatatctaacgactttctaccaacttaattatatttctcaacttgcatacgaagtctatttacctatacaaatatgtaaagctaaatcaatctcaaaggtacaaataaatatgtctatgaatgaagctcttttttattactatatatctccatcctataatggattctaaaattttataggaattaaggaggaatgaaaaaaaaaactaagatatccatcattaaataaggggtatttaaagagttagaagatggttagagtaatgttggataacaattaaatgaaaaatggttggatgaaatgagtagtattaaaaatctcttatattttaggataaaatttgaatccttcgatttatggatgtaggtagtagaagtaaatataagtacgtgagtatgtctttaattagataaagaagtcatattatcatatttttaatagaaaatttcttaaattattgtcctaaaatctacaaagacatgtttagtatacaaggaaaaaatattacttaaaagtttaaattaaaaaaacacagtagtataaaatgatagtttcatatgaaccaactctattgttgagacatttttcttataaatttaagtgatttaatttgtttacaatttgtaacaacccgtccttcaaaacaaggcagctcagcatgcatccaactggcacgctcacttacgctatcacatcacttacactttcattcttatggacacaagtgcacacaatgcttatggacaacacagatcatatcctttaaataaaaaaaacatagaccacatcctaattgcactaggatgtcacataaacccccttaaaggacccgacgtccatgttggtccaccttacctccatagtcacataagcatatagacaaatgtccaggagcatgtaccttcttaacgcgtgtccgtacatccagtgattgaaaccgactttcaaaacaatccaaaaaaatattgataaacatagatttagaagagtaaaaaatattttttaaaaacaatcctatatataaacattcgttacaaaatttcaaatatcactaaataaggtgcccgcgcatctgcgcgggctaccttcctagtttaaattaataattaaaaataatgaggccagtacttttaccaacaagataatgagtgattgactttttataactcatagcctttctaaccacaccactaaaccactgagaaagactctatcgcacttgactatgttatctaagtcctgataacaatcctttagctatggccacgacacgactaaaacatcaaaaattttgcaaatcatctctccaattcggcctaagaacacctcataaagtatactagaaatcaccatttttctctccccaatttttgacttaagagagcacattagagtgccactcgtgcgctgagaaaagggtcaaatctacgccacagtttcaccgtcaacgcaaatcaacaatcatcatcatcccccgacaagggaaagcatgggaatctaggtcgacgactcacgattcacgaacctgtagatatggaagctgggctcccggtagaacgcggcggggagctcctcccgcagcgcccggatggcgtccccgacgttgacgtggtaccgccgccgccggtcctccccgtcgtcctcgtcctcccccttcctccgccgccgccccgccgccggcgagggggcgtccggggacgagaagagcggcggcgggagccgcctctcccgcaccgggtccgacacccgaatcactattctctccttccccctcgtccccttctcctcctcctcctcttcctcttcctcttcctccttgacgcccccgccgggcgccgcggcggacaccgagaaccgcgcgccgccgcgggccctccggtggccgccgcacggcgatgggcggcgggcgccggcgaggttggggaggtggacgaggaggcccattgccgccgtgaggtgagttgttgctcagcctcttttcatttctctgattttttttttggtctgaatttttgattttgtcttttacttattcgattctggacttctggagtagaatggatatccttctcagttccagccatgaaaaatggcattttacctgcggatatccgtttccactgggccgcagtccttactatggtcttatgattgagactttgtcttttcttaactctcatgtactccctcaattccaaaatataagtccctccattccaaaatataagacacaaccaccattaatccaaagattatcatcttgtagtttggatcatcctaataaatataatgcatgtatccaataggattagataacatgagagtggaggatttaaaaaagtactccctccgtcccataatataaaggattttgagtttttgcttgcaacgtttgaccactcgttttattcaaaaaattttgaaattattatttattttatttgtgacttactttattatttacagtttttaagcacaacttttcattttttatatttgcaaaaaaaaattgataagacgagtgatcaaacgttgcaaacaaaaactcaaaatcccttatattgtgggacagagggagtagtaatttaatagagaagatgtcatagtaaattgcatgcttgcatgcatgccttatattatggaacatctaataaaagcggttgtgtcttatattatggaatggagggagtattttttttttaaaaaaaagagagatttagagtaagagtcgtctcttcaaacatttttgagaaaaaaaatatgagtgtattcgggattgaacacgagacttagttgaaactatatatctcttctcactgcactgtcaagtgctcttaacttcaatttcaagcaaagttatttgtcatcatgaacgtatataaactacgagaacatatccggtgaaaacgagttaagtgttcgaaactcatgaaaataatatctaaaagttttgtaaattcatgaaaaaatactagagataggtgtagatatgaaatacattctcaccaaatttcaactctaaactctacttcattagagaaaaaaaagaaacaaattttaggtgaatagtgtcatgttattattcacttaaaatttgtctttttgttactcctaaacaaagttaagtttgaagttgagatttggtgagaatgtatttcatatctacacctagatctagtattttttttcatgaatttatgaaacttttaagtatgatttttaccggtttccaatacttagctcgttttcaccggatgtccccgaataactacaactagtatttaatatctatccaataaatcactaactcatttatcatttttacattctttcattcttcattcatcactcaacacttttagattatttgtgtgaaacccaacgcttaaaattgtcttcggggagcgctacaaatcggacgtccgatattatgcaaaacatcggatgttgttgcacaatattgttacgaaatgtttcacatgttacactacttgatgaacaaaatgtttcaaatgtttcatcaatcaggaaaaaaatgtgtcatttcataaatgaaaatatttctgttctcaaacagaaatatttcggcaaatagaaacaatgaaacccaattgactcgcgccgtgaaacattttagtgtagcgtttgaaactttaggtttcatgtaatgccccgagtttcaaaatagtatatttcggggaatattagcataaacgcgcaaaagtttaatttttaaaccgttgttcgaataggcgatcaggaaccgtggatgcgtagagctcgccgagtagtgcaaaatagactatgagtttataataatcggagtccgaacgaagtactggtgattaaattaatttgggccattcgatcttcatcaggatatctatttaaccaactgaaaaaaaaagaaaaaaaggagaaaaggggaagagatcgataaccctgcagccgctacaaaccctagccgccatcaccccaatcgctgctgcgccgtcgccacaggtttagccatcgccgtccagcgccactcctgctcgactccttggtgacgtttctgtttctgttaacgttccccgctgctgctactgatgctggtctgttgctgtgcttctggaacgaacagagaacaggagtttcaggaagcggggaaagcaggaggagaaaagaaggaaaaagggaagagaggcaaaagttggggattttctgggttttcacaaattgatctcaaattcgatttctcctctgtaagggtaagaggtaactcctcttagtccatagaaatacaattttcacgtggaaatcgattaattgccggttgagtgttttcttagttgttgattatgggctaacaatagtattttcaaatctggtattaaaccatcgtgattcaggttagttgtcctaaataaagtttgtagtcatcgtcgatatctttctaacgccgctggtttcactcaattccgacaaacagtttgggataaacaacaaaaacagtactgccgaccgggtccggaaatcaggacagcaattcgttttccttaatctgggattttcagaggcataatctgattttgtgctcaacatgaaagtggtagacaattttttctagatgtccgaagttgtattatttgctaggttccattagacggtttgtgagttacgcataaaacagtaatggaagagctataggctatttaatacaaatgggcaaaaatttatatgaactgggtttcgattttagcaaatatccttgtaactattattagttagatatagtagtttatgcgtagttttgctccacaggtgtggagggttccaatgttggaggagttgagtcggattattgaaggagttaaggcaagtataagatggacttgtgtgatggataaactgtgttactttgtttggtttcatttatccaattattattcaaagttttctattatcaattatgtggttttggtattatgctacgtattcatatttcacttcatgttcaagttcacaacgttattcatgtttcattcttctggcggaagtttttgtttacattattcaagtaccatgcgtagtcatgggaatgcaatttggatcttcattcatgatccttgagaagagctgatcacacttgctcggcttatcggtaatgctaagaggatattcacacctgcccgggagggaactactactttttgcctccttcgttttaaattaaaggaagacaaatgtttcatattggttttcttattgcattaaacctgtgtatgttttactagttcaatattatacttgcggagtatttttactcactcttgtgtttaatttggtttttaggtacctaatgatattgatcggcacgggacgggagtagcacccttgaactacacattattattgcacactattaaaatttagttttagattatgtttctacttagataagttttgcgtagaacttatgaaggtcatttaaagttctggtccttatttttacgtggaatttgtagagctaggatgggttggattgtgtggtttttatcgttattgagttattttataactacctgtcgtggatgtctgtatttttaggtgactctgctgaaatttctaataattttgggagttagtggtttttgagtgtagtttggtgtgacactctaggtatgtggctacctggggtgttacattttatttattgagacatccacggattacacacacaaagacagaaatatgtgaaacaccaccataatacccacctagacattttgatccaacaaaatgaaacaccaaaaaaatgtggactgaagcataaaaaaatcgtaaaaaaaaagtacccgatcctccttcctcctctcccgtgagtggttggccattgccgggctcagcaccggagctctcttctgtgctgctaacggcccatggtgaaagctgaggccaaccctaccaccatcgaggaagtcaaggccaaccttgttgccgttgtaccgtgctgccgttgagaattaagacgacgctgaccgcaccaccatcgaggaaggagaggtcgtagaggtcatcgccgtcatggtgcactatcagaggaagccgaggccaacctcactgccccaaaaatgttgaggttgagttcgtcgtgccgttgaggccaagctggtcacgctgagccaccactgagcttaagagtcgccgctgctctagatgagatatggtagagtcgtataaatgacatagagatatgggaaagagagagaaagagtgggaaaaagtgtgctcaagaggataaggggtgtcatccaatatttagacttgcattggacggtccatctaaagcgtctccgattgtcttcactttccacaatcccacctcgtatgtagctggcgtcccctgaacacgtcctttccatccccatgtcattccccatgaatcccgcaaatcacacacccttttcatcactcaacaccctcgtcctttacttcacacaacgcatccatcggttgtcctcaccgtcacacccattcccctatcgctgccgtcgcatctggaccatcacaccacattttcgtcatcctctaccgcactgtcgtgcccggccgtcatcctttgctgcataccggtatgtgctacatcatgggaggcacttgttcacgacaagctgacctcgatgaccatatgtttcgatcttatgtatatatcaccctgctaccgactcttgttattttacactaagtttaatagtggtgtgatgtagttcttgaaagaatacattaacgagctgaccaagaactatcttattctatgttttatcgccaaaatatatattaacctaacctcttttggttgtttccttttaatatcagatgacaccgcgacattaccacatactccatatatagtactagtttcatttcattacccaaaatataatgcagtaaacagtgcaaatgacgttctaaattagtagaccaaagactgtgtaccctctgtttatgttcacttggcacttttatcttgtgcacacatgtttaagcaatcattttcaacaaataaatactccctccatattttaatgtacgatgtcgttgacttttcaactaacgtttgaccttttattttatttaaattttttgtgcaaatatgaaaatatttatgtcatgtttaaagaacatttgatgacgaatcaagtcacaataaaataaatgataattacttaaattttttgaataagacgaatggtcaaacgttggacaaaaagtcaacggcgtcatatactaaaattcacttctcaacgaaagtcataaagtatttctacaaaggaatctttacgctgaaggataaggcaaggtggggattagaagaaggtagcaagagagggacaaggtcggtggcagcctgcgatgttagcatgtgttatccagtggttataatagtaccagtttacacttgttactatatatatatacgattgaattttgaataaccttttagttttgacccagaactggtgaattttaatagttatttttaagtaaattttataaaatcacaagtattatgatccaacttacataaaaccacatggttcatggcacatgctacataacccataatatagttttataaaaccacacattaattaatttgacaaagtattctttgatccaccattatttaggagtttaaaattatatatcaaatttacaacttctttgactcgtcgcatactagcatttttattttgctacaataacaagttaaattagataatggtgtagttttgtaatccttttgaactgtaatacccagggttatacatcatataccaaaacccatgtgattttgtgtaacttggacataaaacttatagtatggtaaaatttactctatttgttaaagcaacaacaaaaagtgagtagttttaaaggtaatatattatatattagtaaagtacatctgattaaaaatctaaaaaaattgattgattaaacatattgtcagtcaaaccttagacatcttaatgtaaaatctgacaactattttttactgcagtacagtactatgaattgaaaaacaatgttgtagtcaactatacagtgttatcaccaaaataagaaaattgctcctacgaggaagagatacatgtgctttgaaaaagttgtgaatctctaggatctagtatattatataatctatgaattccatcaaggcaattaatcagagttgactagtgagctttcaaattcattgtacacacacaaaaaaaaaaaaactggcacaccgaccaattacaacgatttttttagaacaattacaactaacgaattggttggccgcgaatatatggctggaggttcatcgtctcttgcgagtgatcatctgaaatacgtagtaccactaccgtgcatacagtctctgctctctactcgccagtgaagttaagaagaaaatcaccgtcactcataaagaacaaacaaattttggaggttacgagagtaggatgaaaacggaacggatagtttccgtccgctacgaagaaaaacgaatacggatacttttggatcggataattctcggttagtttggatgcagatacgaatacggatattttctcctgaatacgaatatgatatcgggatttccgtcagatacggataataattcagatacatgtagaagccattagacataccatatttctttataactctataacctttaatataccttttttaaaatttaatagtgattcatctcttaacactagtccacactattaatattatttaatttttaaaaaatatttataaattatactacagtttatataatatgagctaattatatatgttgatatttgtttctattagaagttgggttgcttttcatgttctgagaaatatttgtttccgtattcgtatccgatcatatttcattcttattcgtattcgagataatccgtatttgtttccgtatttgagctatccgtattcgtttccatatccggcaaaaaaaatgaaaccaaatatgatatgggcattatgcgtccgtatccgctctattttcatgcctatacgataggcatatttatcatatatttaacagataaaaattactggcatttcttaacatgccttttcagacttttttttttaccatgttttgcgaaagcgcacgattctaagacaaccgatggaaactgtaaaatgtcgactttaatgttaagtttactcaataaaataccatgttttgcaacagcgaaagtcacactggagactttaatgttgactttatatcaattacctttgttttgccaatgtgcaagtcacacggtagatttccacacatgtgacttgtgcaaggattgaacaacctttgctcaatcaaataccatgttttgcgaatgagaaacgcatttttctaaaacaacttattgagacgttaataatgtagactttacctgtctatatatgaaccagaccaaacagggcggactagaaattacttaatacttagggctcggctggagctgaactaatgaattatgaattttctctaaaattttcaaggtgatttaagacaatcgaagtgtcctaaactattttagccttgtccctgccctcgagaccaagtatataatcatctattggttatatatttgattgatccggatgtagtgcaaatagtctgcattaaatttcacaaggtcaaccaaagcaaatttgcaatatgaaaaacacagtacaaaatgatttccactgatcatttcatttttaaccaaccgtagatttccacacatgtgtgacttgtgcgaggattgaacaacctctgctcaatgcatacactgctttatcattgagttcaccaatccgcatcttcaacatttctgcctcctcccctttcatcactcgttttatcgtatttgcaatctcttcattcattataaacctttcatttccgacattaatccggatggctacctttgcttgaacctccatcattgctgcattcatcttttgctccgcatagagtggccatgcgatcatcgggactccattggaaacactctctagcgtagagttccatccgcagtgcgtcaagaaacacccaattgatgcatgcccgagtatcgatgtctgcggggcccacgacggcaccagaagccccacccctctagtcctctcaatgaatccctcgggcaaaaaatccattccttcttcttcacctctactattagctgttccaaagaatgctccactcgatgtatcttggtcgggcctcttgatagcccaaatgaacctgtgctgactaagctccaatccgagcgccagctcagctgtctgctgccacgtaagcgtgccaccgctcccaaacgacacgtagaccacggatccacgtggctgctggttcagccagctcaggcactcatggtcccgttccatggcgaccggtctggtccagatcagcggtccgaccgcgtgaaccggcggcagcttgacgccgtccgcgccgtcgccgatggccggctcgagctcgcggaacgtgttcacgaggacgccatcggccctcgcggcgtccctggccatggccagg

SEQ ID NO: 41455 - DNA, 49271 bp, Oryza sativa
gcaggaagagtgacagcagcatccgcggtgaggtgaagaacatgtagaacggcaccccgagctctttggcgacggcgcgcgccggggcgccgatcatgtccaccacgagcgcggcgaggggcgccgtcgcggcgagcgaccgggcgacgtcgcggacgcgcgggacgctgcgggcgaccgcatgcgcggcgcgctcgcgcaccgaggcgtcacccgggagcgcgtccgcgggcgccggcgctggcagcgcgacgaggtcgacgccctcggccaggacggacgccgccacggcgaggtactgctccgaggggggagacctcgcggaggcgaagagcagcgtggcggcgaggccgtggtcggcgacgaggcggcgcgcgagctcggcgaacgggatgaggtggcccaagcacgggctgcacagcagcagcacgcgaggctgatgaggccgccgcgcacgcgcgctcgccgtcgccggagctccaccacggccacctcccatgcccgccgacgtaggaccgaacgacggcgacgacgacgtcgccgtctcgccgaggagagctgtgtcgcgcgcgcgagctagctcggctggatgtgcgcagtggagtgtactcgatggattgcatgtgtgtggatgtcgtggggcatttgaagttgtggcgaggctagtatgtccaggcgacgttgcgtcattgctgtagtcagttgtcaccgagagaaggaaaagaggtacgtagtgacggaaaagttaaaatttctttaaaaaaaagtttgaatctgaatagagcctacgtgtcgagacttgttcgtttgtaatgagtgcatgggcacgtttagccaaaaggtggaatagcgagtccaggttgggagtggattgattggctatcgtaaccgctttagcactttcttgaaaacgatactccttccgtcaaacacaaaataaacctgggaataaatataacatatcttaatacaacgactttatataaaaagtattagaatatgtcacatctaatcttaaattatcttttttacgacggagggagtatgtcacaataacgctgctacaacactacttcctccatctaaaaaacaacatactttaaatgaaatattctaatacaataaatttaaataagaaacgttccattgaatactagattggttttctgcaggatagagagagcagtgcctaaagctggagcgaagctatgcagtcccgaggggttcctaagaacccgggtaggaaagtaaaattagtgattaattaccatgtgggcacccctggctcatgtatgtgtacccctagatggagaattaagctacgaagatgtaaagcccaacgcgtgcattgcagaccaccaagccgaacaggtgctactaggctggtataatggattcactcatattggttagtacttttaatcgttgtactcctcttttgatacaattgacatcacatattgatttatctcttttaataattgatgggaggcgcaattatttagtacaatattacatgaaaattctatatgactccattggtatggacacatgattaagtgaggcaacccctccgccactgcctaaaggctaatggataaaaaaatgtgacacatttctaaaagaaaatatgtcgacagttttcttacctatccattgatgaataatgagaaaaatctatagcactggatcccgttctccacgggataatccgaatccctcactcccctctgtctccatctcccctccactctctctcttttgggagaaggccaagaaggtggagatgaagccggacggtagaaaggggtcgtcgtctatggcggccaaggaggatgacgatggcacggcctcggcgaggtcaccctcaagatcgcctcccttgctgcaccgctctggctccccgccctcgtcggtcttctcatcggatgggcatggcgcccacgctaggctatcgccatcgtcagggatagggaacagccgccgctggtcacccctgctctgcctccaccgtgcgtcaccgaggactcctgccgcaagaaccaagtaggagctagtgggtgcgtgggtgcagagctgtggtggctaccgctgcgccagaggaggatgagggagctacaatgagcgcaggtggctccaccgccaccaccaccaccgcagaagcaaaagaagccggcgatcccggcaccccagtcccggtatcttctctaccaggtatcagtcctgatacccagataccaaagtctgtgatacctaggtaccagtcggtaccaggtatcagatactctgatacccaaggtaccaggtgtcaggggaacgcatgtggaagctcactggaagacagggaataagtcacttaaaattttccattctaacgggatcccgttctgtagtctctctccatcggtaagtggtacaatattccatatttgcatccggagggctgctacaaaacaggatcccgttgcaacggaatagacatattaactattgtcttgtacgggtatcacaggtatcaggtcctaggtatcaaaggtaccgagtaacaggtatcacaggtatcgggtaccatgcaactgtaccacaacaggtatcatttactgtctcataaaagagtatcttgtttcaacgggataccattgtctaggttttctgttacatccgcgatactatccgagccacagtcggaaccattttcgctcccttgtttgggctgggcgtataaacgtaatctatttcagaccgggacaccacggcctacttcgcagcgtaattggactcggattccttcataataatcggcctatcaaaagcccgtgggctcatcactttccataatttgactaatttctctacgtgccgccgtctttggattaacatgccgttgtcatgcttctcgtcggtgctggcctcgctcagaggcggcgctgctgcggcggcggaggacgacgccggcgaggaggggacggcggcgctgctgcggcggaggctgctggtgggggaggtggcggcgaacctggaggaggaggtgggcgccctggagcgcgcgctggccgtggccgtggcggagcgggcggcggtggaggcgcggaggctggacgccgaggcccgcgccgacgacgccgaggcgcgggtgctcgcggcggcggaggagaaggatgcgcgcgtcgaggagctcgtgatcgcggcggcggaggcggcggcgaagcgcaggcagatccgcgtcctcgagttgcagattcaggccgtcaacaatatgaccagcaagtttcgctggtactaaattactaatttagccgacggattaagctgctgccaatctgactaaatacaggtggctaagcagacaagcccaaagcgattatatgcctgagttgaagcacaaaataatcttttgtttttctatgggattactatttcgatcgaaattttctcgctacgtgatgtgctcctaaatccgaatcgatgtatcaaacttgtccaaaaaatcaactatgtgtgaggagtgctaaatcttttttggttgatttttgttgttattataccttttttttccaaatttgctagaaaacattcataagtttactgtccctaaaactttcagatttgtgaccatcggatcatctcgagatttatgcattaagagaaaatattgctagaatgaaatttttaaacatgtcacgcgtaaaatcccaatgctatctacacacaaggttgttagcatcgggattctagatagtatcatttttcttaaagtagtatcggattgtaggatcgtatcgtagtatcgggatatcatgaaattttatattttaagtttaactagcaatagtgtccatgcgttgcaacgggtaaaacaccatttgatagtgtgacaccttgaaaacctcaaatcggtaaaaatctaagtctaatttgatatattaacaaataggtagaaccgagtctaatttgatgaattagcatagaatttatgatttagtcttatatttatttttcgagcctacttaggagcttatccgacggactttgatttaaaaaatatgagccacattgtttgatcaaatttgctttcggcccaggtcttcctagccaacccaaacttgggctggcccatcttcggcgagctgagtcaattcgacagcccgcaagccgagcagctgagcgcggcccacatatgcggggatggttcgatgtacttcggcggcccattgggcgtagcgtaatcagcagcggtagaggcccaacgctgggcaaatctgagccgttcgatctaatggacggctccgattgtccccatgatggatgaagtgccgaccggaagagaggggcaaaaccctagctcccaaatctcttctctccggtgacgaacgagcggaacgacgacgaaggcggcgatagcagtccggtgagctagtgcgtgcgtgcggtgttgaccaacgagcggctcctgcttcgcctgctgagggtgcacccaagggcggcgcaaagctgtgccacgacatcggtggtccggctaggtgggcgtgcaaacaacgatgagcaccgagcggcctggaccttttaagataagataagattttcagggacaacgaaagtaaattgaatcggactttcttttttgttttaatattttttttcgcccttttttcgttattacgaacgatggaaacgtttcaatttttaagtagcatagatagagatagagaagatatagatatataataccgtgttacgtataataggattcgaatttttttaccgcgtcacatataattattttttttaattggacagaattcgtttttttattttttttcacctttttttactgcgttcacggaatcggattcgttttttccctgttttttcacctgattttttcgctcagtttctttcccgactcttttttttaatcggacagattgattttttttcgcccggttttttttccattccttttttttaatcggacagattgattttttttcgcctttctttacacggaatcgtcgttgtttttttgcccggttttttttcacctgatttttttcgctgggttttttttgcctaattctttttttaatcggacagattggttcttttatttttttttcgcccttttctttacacagaataggatttttttcacccttttttttcgtccgtctttttccgcccgattttgttttcggatgatttttttcgcccgatttattttgcacggatgatgggagattgttagagtagatagatagaagtagtggaaacggatgggagattgtttcctatttttgtggaatcggacatattcattttttttatgcttgatttttcttttactgcatcgatagaatcggattcgatttgttttttttaccgcgtcgcatttttttaaccgtgccacatataataggatttgatttttttaccgcgtcacatgtaatttctttttctttggaatcagacatattctttttatatttttttcacctttttttaccgcgttgacagaaatttttttattttcttattttcgcctttttttatcagacaggtttggtttttcttttttttcgcccggtttttttcacccatttatttggataggacagatttggttttttttgtccgtttttttcgcctggtttttttaaggacgatgaaagcaactcttattttttaatttttaagtagcatagatttaatatttatattaataacatatagccattatataataaaaatagagtaataataatatataacataaattcatacaagattcatgtgtgtttggaaaaactacgatatatgttgattggatggacaaacatcctcataaactctttatatatctaataccagtacctacttgccgaattacttcccacctattgactaggacaaatattgtgttccaatcgtaaacatttatggaggtccaatactctagatcaacactagactttatttagacagactctctaaccataatttcaattatagaatttaattttcaacctcgagaatatttgtagtggttttggatggcacggcactggcattggtgaattcgaaaaattgataaaccgtcgacgttctatataggcgatactttaaaggggaagcacgtgagatctaaaagttgatggactgtagggacaaaagtttagacaagtttaagctctcaatatgagaggtaatgccctactactattttgggaattgatatttgctgagtgtattacgttgataatgatcgatcagcttctttctcttgaacttataagctaaagggcgaccaaagatgtggtttagctcaactctgggtcttggaaaccatccggattagcttcaccagtattgtccttgttctgtcctgaagttccttttccagctgttagcttcaactgcttagcattgtcttcaacaaatttcttgaatgtgaaacagtccttagcagagtgtttggaatttgggtgatttggacagggcccgttcaagattcggttgtaattttctagcacgccgacaatgtgactgaaaataagacgttgcggccaccaagttttcaggtgttcgattgcgatccttcttgtaatactcattattattattcaccagatgtggagtacttgattgcttgtcctcccgcacaacattgatggcttcggctgaattggcgtatgaattggctgttttgaagagcttcatgacggtaagtggcggtttgcgggtgaacttgccgatgagattttcgtcacagattcctttttgaaaagtagcgatgatgacattgtccgtgtcttctggaatcttgttgcttgtctcaaagaaacgtcagatgtgtcagggttacggataaggcatacctactatcctacgatttaccaaatatacaagattggcatacccgtatcctacgatatgtttctgtatgcgataaggaaatatacgagatagcatggaaaatatcctcacgggctggagattatcggagtcctactcgtgggaataatattctatatcgtgcagggttcgttatctctgagttctacttggagactaaaacaactcgcggtataaaaagcatacccctagaggggttcagaatcatcgaatcatagcgccaacacacccaccatagtctacgaagccgaaggactcaagccgaagccgccgggaggtctcgtcgaataatctcgataaggatctcgtctgtattaacaagttcatcagttctctttgtattctgtggtcttccatatcaattccatataaattgaattagggctattaccttacgagtggcctgaaccagtataatccttgtctcttgtctattttgatgtcgtattgtgtagatccttgtaccaacataccccagtaccccatttatctagtctacaggtatccaccgtcgataggatgtagtcctttaataattcatttttctgttgtatgacatggtaaacatctaactgtatcccgggcctcacgtaggtgccttgaaaatttgcaacaaaccgataccgaagccccaaaagccaacttcttactgaatcagtaagtgccacatgcaagtagttcaccatggctttgatatcttctcctgttgcgcgaatggccaaggtgtaaatggtgagacatgactcagggccggttttgccatcgtacttctcgataccagttggtttgaagtcagccagccagtccactcgacgtaggtctcagctaaaagttgctattccttcatcaccataattaggtgatatggatcgatggggtgagtgatgaactgcggcgatcctggtcttctctctctcagtgacaacggtgttgttcaatcctgaggtcttcgccttcccggtgcccgtggtcgtcttcctgtctacggtcgctttcatggtggtcatcttcacgatgattgttatcacggttttcaactgaagaatgtgttatgttattctcctcgtggcattgaagatttgaggctgtgtggccccaactgctctcggctgaccggctatcctttgaagggtgaagagatggccgtttgcttggtcggttgcccgatggattcttggtgtcttggtaatagactcctctggtggttggcttggtcgctgagtgcctctagctccttttcctgttgtgcggccgtagtgaccatcatggcatcgatcttgtcgagcgtcggagtcatggcattgtctaaggcatcgattagggtgtcaagtagcgttacaacaacaacgctattctgctgcagtctggatgatgctgtcatgtgtcgtgcatcctcgatgcattaggttacattgtttccgcaagcggtctttctcctctttacgtaggtgctcctcctccgcttcctagtggatgcgggcctgctcgtcctcttttggcgctccaactagaaagacttccctgagtagggtataatcgttggagtacttggagctgtagattgtttccatgctgaatctggcatagtcttccgagtggttgaggtcatagaccatctccgtgatgttgcaggagtcatcgagcgaacgaatcaagatgcccaccttcctgggcccatgtctggacatggtcgaatcatgcctagattgaattcacgaggatggagtgggtcctgaaccgtcgcagcgagaagcggagggagttgcatcagaattttggggtagttttccgcgttgttggagatgctgtctaggtaagcaggtggcgttgactccccagaccagtttgaggccaagccatggaaatccgacctggagtaggccacaactgtatttgagagatcaaaagggaccgaggaagtctcgaaccccgccaattggatgctgttggtatttcttaatgacattattagaaatataatccccggcaacagcgccagaaatgcttattggtatttcttaacgaaattactagaaatataattctcggcaatggtgcagaaatactccaggtatattatggttacagagtttatccgcaagcgcacatatatacaattgtagcatttcacccgagagtattccaagggtatcgtatttgtttaattccgtgggaagattatagtagagagaaccgtactaataatttatatattacttgtaataatcatagtctaagcaggagttagtataatacatagggtagaatgacacacaagcatagaactactcattctcatactaaattatctaagctaagtggaaagaaaatagaaaagaatctattcctatacttctagtatacatagtatacatacattctagttatatgattaactagctaataccctctttctgatgccctcctagtacttcgagaagccacccctgactgccgagttccttacgatagcccgtcatgaccatacaaccggggctaaatacggaggagtaccctccccagaaaattaacttaggactatatacacgcgcgcaggaatacccgtactgagctatgttgaagagaaaacatgaggcctgggagatctgcttaactccagtgcaggtccaaaaagcttgtctttaggttcgtgagcgtgccagttgatttgatcctgcaatcaacaagaaataaagacaaagaaaccatggttaaatccataaatgataaccgatcggccaggcgccgatgacatatcatttaactttgagccgatgtcatatttgaatcgatcggcaatcatgaataagtaagaaagaactaaatctattcgatcggctgtagatattaatggtatataatccttatgttgatatatacttaaatcaagtgattaggatagatcggacgtcatgccgagacagtatgaatcacttagatcgaagtatatattaataatgagattatagatgttcatagcatagccgatcagatagatctagcacatatcggctaatactccgatacaactctatgttaagatattagagcaagcaaaatatatcaaacagaagcttaacatactttgctgtaataagatcgtaatataaagggcagatctagcatatcagttaagcacataaagtataaagctaaattaggtaagatcggctgaaaccctgacgctaccataatccgcaaccagaaaacaggctagagattaagattctaatcacgacttataaggtcaaactcaactgatgcagctataagtatgaaaagaaggacaatatatagacaatcaagccgctggttgtttcatagagtggtagataccctatataatctgagccaacattggtatttaacctaatcggctgccttctaataatagatgttagccgattgaaggttaaatagcaatattgtcaaatattatataggaaatatgataactcgacaaattacataagcaagatttgagtatcataacgatggaagcactaatcccgagaacgcaagccgccataacaagttttacctctagttgaagatcgcaactgatgcagctcaacccgaaagcaagaactcgtcaaaacaaaatgaaagtaaaagggtggtgatgcgccgagattgtattgaacgtgtgtttttgtattacatggggctcggggtctatttatacccgagattacaaaatatgtccatgtcggacacgactctcatctctaacaaactctaagataccataagtctttgcggcagacttttgcccaaacttatctctaaggaaattacaagaaataccctaattaatagatacaattgccttttcaggactcaatccatgcatggcaatcctcatgaagcacattaactcaacccgacaatgtgtaccgagtcacattgtcggaatcggcttaattggccaaccttctccgactcgaactctgtcgatcttgatcgtagccgattcggactttagccgattcttgctctgtttccggaatgatctccatcttggattccgcttcaattttatcttcatctccgatacctaaattaccaaatttagtcgttaacaagctatcaccatcagcggcccacctcttatccgcagtatataaccccaaataatgatacccaataatctagacaccacgcttaaactaccagatactactctaatattatcatcctgacatagagtaattgcataagcaaacattatacccgtacctatgcatctcccagataagctagcagtataatcagtataacatgaatataaaataaagttggcattcatagacttggaacgtatttcattaccagaaatgtataaataagaatattctaaataaagtacaaggcttacaaaagaggaaaggagagctactagagccatacccgaacacttccaaagacttccggactctgatttctattctattcctactccactagcttgataatactaaactaacttgagagaatatgagagagctcttgcttgaagtgtctgaagaaatggagagagtgaggggtttatatagcttgagactgacggttatgacggttggaaaggtcggtaatacccaccaaccgtcattggggactcatctcagccgtccctccaatccctggatcaaacggcggagaggggggttcggtcgaaccaggggttggcccaaccagcccacagttcggttggcggcctcctctcttgatccctgttgtagacttgtgaactttggcccaattcatcgtgtcatttctgagttcttggcccattcatacataagtctgattctcgacatcatccgattgactgatcgtctgatttgatgtcgattcttctccactttattgttattctctgcaaaaggttagtaaacctaatactggtggaatattattattctaacttaaatatgcattgcaagcataactagttctcgtctattatggtaatattgacggttgaaactgatcgctaacaaccgtcaacaaatgcttgcagaagttgtcggtgagaaagatgaaaccgccaaaacaaaatgtttgccttggagggaagacgaatttgacaactcctgaagatgatttcatcatgattgtcactgaaaaactcaatgcaacccctacctggcgcgccaactgtcggtgtcgtatatcaacaatgctaaaatgggtagtatacaaatacaagatctaaacgtggattgattatcgggacaaaggtttagacaggtttaggccctctcgatgagaggtaataccttctcatgtttcggaattgttgatagtcctttaataccaaatataactatcaattcctgtataaaagcaaatcaatgaaatattaaacctagtgataggatttattattaaccattttcacgagtgttggtgaatatttgtatgcatgtaattatggaagaaaaccacctgccatgcgaagaaaaccacctccggccactcaaacgctagcagaagatccatgggccaactaatcatatgaagctaacataattgaagccaatttactatgcaccgtcatgaggacccataggacaatgactaaggcgaaaatgaggaagaaaggcggtgaaagtgattccctctgaaccatggttcggtcgaaccaagagtgtgactgatcactgccacagcttccacatgtcgcttcctcaggcctcccctatggcggttatgcttgattcccaggctacataaggaggagaagttcccactctcaaaacaccagaaagttgagtacaactcacttttatatttagcctactctatagtagagttagaatataggaagagaatgaggggaagctccgaaagaagtgcccaaaatatcggagttctctccgagttttggaggagtgctggagatgtcgacattctctccatggggtgtactggaggattgccggagatgtcggcactctctcctatcttgtacctcgacgattttgtcttttatataagtaagtattcatgattttctttggtatttacttttcttatttaagtatgatatatttttatctttgcgacaggttcatcgcttagtatttatactaagtgctctagtactaagattgtagataaagaagaaagttcttggccgagttgtaatcaatgttgtagaggtgttgtctaggttagaagttaccttcatttattgtgtgctccatggaatgcaaacgtaggcaacagccaacatgtggtgacaatcatgtccgtctttcttaatccttcacgttcgggtacatcatagagatacatgctggagtcccttggtagaccaggagtgaaccgttgctcgaagaaactaatagagttttaccttaacttaactaagattatttacatataggaatcctgatacgaacacactcgcgaggggtggcccgatcttcacagcagtaggttcaagacagagtgccggcgtaaaccgaaacacaagagggtaactagctacgagcagcaagaggataactatctttatacctaccaaggtcggatgcgatgaagtggtgagggtgagaacaatccgaagcctcccggactccgatccgtcacaccgagcaatcatagaaccacgatccggaataactagctttatacctaccaaggttggatgcgaccaagtggtgagggtgagaatgatccgaagccccctggactccgacccgtcaaaccgagcaatcacagaaccacaatccgggactaatccacacaatatggtgcagctgaactagaagccgtagagcacgaactagggggcaccagaggagccttctcgcaagtccaaaagaactcacaagaacaaaggggtaagacacttatgcagtcttcaggaatctctcatatatgaggttttcaattgaacaaaagttgtctaatggatggagtagaggggtatttatactaggaacatccctcctagctaaggtgtgaacataagaagccacgttctggtggtcaaggctaacaaaaatgagaatgcaaagagttttctcgggtttgcacacagccctacagctcctgcgcagccttcagtaaaaatgccataacttttgattggagaatgatattgaggtggggtttgatgcgttcgaaactatacttgtccctctttccaatcatgtattccatgcttcccgtctcttgattggctgggtcgcataagccttggaagttgagccgttgcagcgtaaaccatcttcttgttggtgtaaaaagctgctggttgggaatgggctgaatcctcctcggcgtaatccttgtcgtcctcaacgtaacccatcttccttggtgtagtgatgatgtcctcgggtgtaaaccttagcaatacaaaggtagagcatttaggtagtataaaattctcactaaaatttgggttaagttgagcaaagagcgagttcacctcttgttgtattttcctagcacggctgtgcgtaattagatcatgataagcttgatcattcttgctgagacgtaatctatcaacttggtttatgtcatcttcattttcttaatgtgatgtatgacgtaaaccatcacccttgtttacgtcaagtgtagctgggatgtcctcatcaaatcctatctctcttaagcctatcatttaattgttgtccttagaaaaatcatatttgttggattataaacatacgtttcctgtgattcaatacacttgcaatactctgagatgaaatgctatatcggtttgtgtgcttgcggatttatctgtggccataacaaatactgacagggattgtattcgtcgagtgttccttgtgattcatttaatttgttgcctatggcagcctgttatatatgtcttttaatacaagttcaaattcaatatctatatcgagaaaaaaattgaattgtggaactatatatggtaacttttactatttgatttgttttttttacaccatgcatatattgaatttgatcatgcgtgtttttcaataaacatgcgatacaattaataacatacttctgtaattttttgaaaaaaaaaacattcataactatttgaacagcttgtaaaaaaaactaacttctcatggactcatccatcgatagaactgagccaaactaaaattgctctattggcgaatccataaatttactagaaatagacatgcatgttggatcattcaaagaataccgatagggagtcgggtaaccccaggccacactatgattattgttgttacactatcagcctctgctcaataatagaggcatgaggcatccgacatgccgcgtcgccggcggagctgtactggaagatcgcgctcccgaccttgccgatgcccggcgccattcgcgacctcatcaacccagtgagctcagcggcctcagcttcgaaggaggacacggtgaacaacgtgttcttcctcgagaaggacctcttcccgggctccaagatgacgctccacttcacccgcgccaccgccggcgccgcgctgttgccccgcggccgcgccgactccgtcccgttcgcctccgaaaagctcccggagatcctctcccagctctccgtccccgccggctccccggccgccgacgccatgaggtccaccctcgccgagtgcgaggccgcgccgcaggccggtgaggccaagcgctgcgcgacgtcgctcgagtccatggtggagttcgccgcgtccagcctcggcacccgcgacgtgcacgccgtgtccacggaggtcgacagggcagggccgacgccgaggcaggcgtacagggtggaggccgtgaggcccgtgccggtgtccggcggcgacatggtggcgtgccacggcatggcctacgcgtacgccgtgttcgggtgccacacgaccacggcggcggcgtacacggtgacgctggccggcgccgacgggaccaaggcggaggcgctcgcggcgtgccacaccgacgcggcgcccagggtggcggaggcgtacaagaggctcggcgtggcgcccgggagcgtgccggtgtgccacttcctgccacaggacgacatgctctgggtgcgcaactgagcgcgcgcgcgtgaaaggggataaaaattgtgtgatctcaaagctagctccttcctacaatttggagctatgtgcgtatcatgtcttatcatgcatatatgtgtgtgcgacggcccgatcgatcgacatgccactatacgtgtggcagcatgttaataagtctgcatgtaagattcatccatgcatcttgtccggtgaaatatataaactacgacgatgttgcacggctgtacacaatactcccgaaaagattgtgttaaattttgtatttgttatatagcaaaatatagacatatgtatcttatatcgttgatttgattataaacagagcaatagttagattaaaaatcagacatggagcttataatatagattatttttcttttagttatactccctctatcccataatataaggcatgcacacattccaatattcaactttaaaaacatttgaccaacaactattacaatataaattaagttttgtttgttgaaattaatatcattagattgatatttaaatttactttaagatggttataattttgttgcaataaaccttatagtatatgagaaatttaagtcaaagatttaatcttttaaagactgtgccaagtttgaccatgccttatattatgggatggagggagtataaaataggaaggggagagaaatgagaagcgtagagctcgcgagctagagaggaaatgaaggagtaggccggtgtgtagtgatagacgcatgcgagcgtgatgtggaggggattcattttttgtaatttttctaagtgatttaagtgaaaaccaattattagatgttacttttctaggatttgtatcacatctttaaaaaaaatcttacaaatcctaggaaaatagcatctaataattgtctttcacttcaatcacttggaaaaattacaaagaaaaaatcccctccacattaccctcacctgtgcccatcactacacacctactccttccctctttggctcgagctctacgcttttcattcctcttccgttgctattttgtattactaaaagagaaatagtttacaattataagctccaggtctgatttctaatctaactattgctctgtttataatcaaaccgatgatataaaatccatatacctatattttgctatatagtaacaaatacgacattttaacacaatcaacctattacttataaatgtctcaaatgcagcctaggatgcatgcgggctaacttcttagttgctcaataatagaggtatccggcatgatcgtgaatgcgatatagcatctttcctacatgacatatttgttttgttctgcataatccagtggggccaatgcaatgtattatttgttcgtattcttccagcatccctccataaatagctcccaaaagctatgaactgcttgtgctcagtttcactcttatcagtgaattagatcatatacttgtgtccttgatagctcgttaattagcatggctaggtcactcgctgctgtcctactccttttggtgagcagaagcacatatatatcgctctttgtatggtttagtagttttgagctagaacagagataaattaagttgggagagagagatatattatttagagattgaacataatacaatttttacttattctagttgcaacttttggctctgattgttttcaattcaacttgtttctgactgcaatttaggtcgccgccgcgggagccagccatgccgcgtcgccggcggagatgtactggaagatcgcgctcccgacctcgccgatgcccggcgccattcgcgacctcatcagcccagcgagctcagtgggctcagcttcgaaggaggacacggtgggcaacgtgttcttcctcgagaaggacctcttcccgggctccaagatgacgctccacttcacccgcgccaccgccggcgccgcgctgctcccccgcggccgcgccgagtccgtcccgttcgcctccgaaaggctcccggagatcctctcccagctctccatcccggccgtctcgccgaccgccgacgccatgtggtccacgctcgccgagtgcgaggccgcgcggctcgccggcgagacgaccaagcacaagcactactgcgccacgtcgctcgagtccatggtcgagttcgtcgcgtccagcctcggcacccgcgacgtccacgccgtgtccacggaggtgatcagcacgttgacgccgacgccgaggcaggcgtacagggtggaggccgtgaggcccgtggcggtgcccggcggcgacatggtggcatgccacgggatgccgtacgcgtacgccgtgttcgggttgcacgggctcaagggcgcaggcggtggccgcgtgccacggggacgtggacgggcacggcgcggtggcggaggcatacaagaggctcggcgtggcgcccgggagcgtggccatctgccacttcctgcctcaggacgacatgatctgggtgcgcaactgaattaatgaagcagctaccttgcgcgccatccatggctaattattttagacatgctccttcctatattttggatctacctgccggctatcatgttatcataaatttacgcgtgtgcgcgcgacgatccgacatgcccacactaacgtgttttactttgttaattaataagtctgcatacccaggtcatcttgtacggtgctactccctctatcccgaaataaaacaacttatagagattgaagtttgtcccaaaataaaccaacttctaccttcttgcctaccatcaatgcctaccacctgtctgcaaaacaataaattttattacttcaataccccgggttggttcatgtgcagtacttaggacaagttttgtagtagatgtaaataccacatctaatttaagtcatgtcatcttctcattaattaaaagatagcaagtgcaacatattgcacttttcttagagattatatagagattgccccctttttttgataatggaataaaatatcccggcatttgctcaaacgagctacaaccaattattacatagttcacacaatagcaaactcacatagtgagtccaatgaaaatttcaaacaagcacaactaatatatactgacacaagataaagatcccacaactatttaattctatttgagaacctccatccaaagttaacaaagagttgcataatcgttgactcaagtttacgacatgccatcattaattaagctgatatcttcttcacacctttataattaagcccaacaatggagcaattacgttgccctgaaaagtacctgcaaataaaattttgatggtgatatatcaaaaaccatgtcattcctactaagccaaagaacccaacataaagcggatgctccaacaagaataagattcttaatttttttatcaacaccaacaagccaattcccaaacatatgagatatactttgtggaggatgtaaaccaaagtaactccaaagaaatctcgaaaaatagcaatcgaagaatagatggtagatggtttcattttttataaaaaaacatcttaaactaccatttcaattcctcctagccaaattatccttagttaacacaattcctttaagtagataccacgtaaaaatcttaatcttgagaggcatcttaagtttccaattaatcttattcctctcaatataaccattattattaaagctaaatacatagatcaaactgtgaattgaccattttgatgaaagttccatctaaaactatcactttcttctgtcatatcaatatgcacaattgaagcacacaagctatgccataagggggtggctcattctctctctctcctaacttctctcctccaccttatcaccaatgtcacgtcctgataaattcatcccgaattaaaaatcattctctaaaaggaataatagaattaattaaaattcgaaaagaaattgacaaacactaaaatacatacaagaaaaattcgtgttgcccggagaatttccgttaaatcctccttggtctaaaaggtgccctcaaattttacttgtattttcagagcacggaaaatagttattaagaaaaaaaacaattattagagtttattaaaaagaaaaactaaaaataaaccctccttcctcctttgggcccagtccggcccaaagtccccctcctctccctcggcccgcggcccaagtctctcttccctccctctcttcttcctctcctctctctctcccgggcctccctccctctttccctctcggcccagccgcccggcccaagcatggcagccgcgcctatccgcgtccaaactaaaaaatattttcaatttttttctggaaaatgctacgcatacgaattttttgtacgatattggtaccatcaaacgtaacaacgccgacggcagggaacctaactcaagcgcacggcgcatgcgcacacggcagtcaagagcgtcatgggccctaaagcccaattagcctctttgcatctaactttacatcttcctttgttaaaccctaaacctgactttccctattccatgttatcagcgcatctgcaattctgcatttaatccagagagcatacggcatacgaagacataggtatgccatcttatttgcctgaattcctttagcttcgcaatcatcttttttggtacactagtctccctctctttcttttttggtcctgggtaatgtccatggccatgaaatgcttcttttttattatagaatgaatctgaatttttgctttgcaaaacatgccattgtttcaatttacatgtttcagtaatggagaccaatttatctaccaatgaagtagaagatgatattgccatatcagacaaagatgattttattattgaggaggtccaaaatgaatcagatgaccaagaaattgagaagtttgtttcaaatgagcaatcaacagaggaagctatgttacaagaaccaaagaagggaattctatttgatagtgcaaggtgcaaggaacatatatgtatgagtaatttgcttaacctgccacatgataaatgagtgctgagtacaattactatataacatattattaggaagaatattgcttaagatatgattagaaagaagattgctttggttggatgtgcaaccagaccaacgagaaagcaggccaggtcgtcaggaggagcctgggctttggatatgggctttgcagtgaaggagggatctgtttcgtcactacaaatgttaggagagacgtttcatcgtacaaacatcgtataaaaaataatcgtatgtatagcggaactctttttttctccgcgatactatccgactcggaaccactttcgctcactttgttcgggcgtataaacaacgtattcgattcagaccggtgtaattcgattcagaccgggacacctcgtcttacttcccatcgtaatcggactcgtattccttcgtaataatcggcctatcaaaagcccatgggctcatcactttttcccaacgtaattaatttctctacgtgccgccgtctttggattttcgttttctcaacgcgactcaaaaacatgccgctgtcatgcttctcgtcggtgctggcctcgctcaggggcggcgcggcgtcggcggcggcggcggcggaggacgacgccggcgaggagggcacggcggcgctgctgcggcggaggctgctggtgggggaggcggcggcgaacctggaggaggaggtgggcaccctggagcgcgcgctggccgtggccgtggcggagcgggcggcggtggaggcgcggaggcgggatgccgaggcccgggccgacgacgccgaggcgcggctgctcgcggcggaggaggagaaggacgcgcgcgccgaggagctcgtgctcgcggcggcgaagcgcaggcagatccgtgacctggagctgcagattcaggccgtcaacaatatgaccagcaagtttcgctggtactaatttagccgacggattaagctgctgccaatctgactaaatacaggtggctaagcagacaagcacaaagcgattatatgcctgagttgaagcacaaaataatcttttgtttttctatgaaagttttagggattattatttcgatcgaaattttctcgctacgtgacgtgctcctaaatccgaatcgatgtatcaaacttgtccgaaaaatcaactttgtgcgaggagtgcatccgagattgacttggactgactacatcttttttgttgatttttgttgttataccattttttttttcagatttggtagaaaacttatgaaagttttatgtccctagaactttcagatttataaacatcggatcacctcgagatttattctatgcattaagagagaaaattgctagaaagaaatttttatacatgttacacataaaaacccaatgctatctacacatagtaatatcgtagttacacttatagttacaatgcagttaaaatataattacattttaattatactttagttacgtctgaaagtttttgacccaaaaaaaattacgaaagttctttagatactttttttttcttttctttttttagaatgctcccgcccgggcatcctatgctaggcaaaaatcagatgcccacacccacacacatcctggtcatccaggcctccgattcaatccgatggctcagatttgttttagtcgatgaacggtaatctattcattcctatccactagtttcatcccatctctctcactctctccctccctctctcttcttctgtcatgacaacttagccaaatgaacatctatggttgttgtgttgctggaagctaggggaaagggaggtctggtcccgtgggcgtcgctcgacagcagcgtagtgaccggcgtcgaaaaatatgatgtggatgcggcagcatgcagtgactttcgtgtcaagcttgcgaatataggtggtgcgtcccttcttttctcttcttccaggaggtcggcatggacaccgatgcctcaccgccggtagcatggatgcgctatgaacttttgatgtttcactttgtattggattaaaatgttgttatgaaaattttgacggtgtctcataacattgtcattgattcatatggatttgttggtgttttaatagcgtgaaactcgatgtttcatatgttacaccaaaatgtttcaatcatagtttaaatgtgtttactgtctaatctattgggtgaaatattttctttacgagtagtgaaacaacactcaatttttaggaaattcaaatgctcgatttgtaatcgtgtcgatgttttttctcttactaaatttatgaattttggagtgtagctaagttatgaatttccactaaggttgttctgttatggcctaagcgaatccttatagctttggtataaatgactactttggggatttgttacgtgttcattagggcttttacagtgtgcctaactgtcgttcagccccagcctctcatgtaagagatttcatgccatgtttgcctctcctattaccatgtgaagactgcagaaacaagtcgagacctatgttccttgtcagggatttgttagggcgcgacgaggcacgactcgagcagtgcgttgggagagggtgtggccccatgcgacgcctccacaacacatgtaggcggtgacaggcatccaacgagtggccgttgtaagcaaggtcaccaccacgagctcgacggggcgttggtggcaacctggggagagacacatgtgaggagaagggaagatggtggcgggaaatgaagtcggtgctctcggcggaactggcgagctcggtgatgccgtcatccagctttttcttactccaccaccctcaaggccagatccgccgagccccatgccggatctagcaagctcggcggcaccatcgtcctcatcttctggccctgatgaagagaggttgtagcgcccgatctattccatggatggggatgggaaggtggtggcagcggagaagaatcgatggagttggtggtggtaggctggtggtgaggacgaccacgtactacctatatacttctactttgcccgacgcttgtgcttgaggacgctatcactgcttgggccggcattcagcccggagcctcagcttcctccactagcgggaaaggcagagaagagagaggaaataaaaagtgagtagaataatactggtgggacccattaaaaatagtagggcattatccttccaagggcatgcctaggcccaacaagcacgtgaccagcactgctatgaacagattacaagcctttttgagaatctgacattgccgagggccgaggcagatgattcagggggcaccaagctagcgcgtgcgcgccgctagcgagcacttctcccctattaactacctctattaacactattagttaatatatttaactacctctattagttaatatacttaacactaatgatagtaattaggaaagattctgaagatttttttactaatagattgaaaattttttaagttagatttgaaaattttcgatttaaattttaaactttaaagtcaaattttcaaaactgtcaacttagattcaaaaacttttaagtccagatttgaaaaatttgaaaactttcaatttgagatttgaaaactttcaactcgagattcgaaaactttcaactttgagattcgaaaactttcaagtccagatttgaaaaatttgaaaactttcaaatcgagatttgaaaactttcaagtcaagatttaaaaactttcaagtttagatttgaaactttttaactcaaaatttaaaaactttcaaactcaaaacatgctaaagattaaaaaaataatcagaaaaaagtggaaaagaaaacgaaaaaaatcgctaaagaaaaacgaaaaaaaaagcgtggaaggaggcgcgcgccggtgctgggccttatgggcctgaaacgcgcgctggtggcgcgccgattagcgatcgcggacgattcaagacatctgaacttaattgtttcaacttagcaacttaatgttgcaatgctgtaataacctttgaccagatatatgttattatcaaaaagaactttctcctactgcatgccctgaattttcacataaagatgagagcaggcaaacagatttgacttccaaaagttacagccgcacacattaaacaataagccacttcccggcccaaaaccgaaatatgatttacaaccacaaaatttaggttttactagttacaaatttcggttaaaccagtacacgaccgagcacaggaaactgaccctgattcgagatttgcagaatgtgcttgaaacaaaccctgcattttcagtatgagtaaaatgcaccggcggtccttaaacttgtcaggaggtttcacttaggtccacgaacttgcaaagcgcacatcgaggtccctaaacttggtttattgtatcatcccggtccaaagccgcgtttaaccgcgatcttgcttacgtggcacgccatgtggatgatgacatggaatttttttatttttttctcccttcttaattctttttttctctttcttccttgtcgaaaagacgaaaatgccttgtacacgtcatccatgtcatcgtcttttcataaaagagaaaaaaaagaaggaaggagggagaaaaaatttcaaaaaatccatgtcatcgtccacgtggcatgccacgtagacaagaccacggtcaaacgtggctttagaccaggatgatataataaaccaagtttagggacctcgatgtgcgctttgcaagttcgtggacctaagtgaaacctcttgacaagtttaaggaccgctggtgcattttactctttcagtattatctcagaggcttcatcagcccaataccatcttcataacgagatcattccaagcgtcgatagggcctggtacacaccaatgcaggcaatcattctgaactgatttggcatccttgtcacctttcaggaatggatacctgtaaggcccaacatggccatcaggtctcatggacgaaatgctgtaggtatccaagagcttcagattcgcagagttccgcgaaccacctagtgccgccatggcattcctgaactcctcaagttcaattggtctcatgatacgatccatgtcttttccgctgtactctcccttcttgtaaggcaaaacccggctacaagttcccccgttgaaccattccgcgttctcgaagtgatcgggtgcccaagtcctgaagagaacagctggtttgtggtttgaagatgcaatgaatctgaagatttgttgcagagtcctgcgatagaggtgttcaaatccaagttcacgtaacttcttgtcctgacagtaatggcagcctatcaccctatcattctcccagtagaccgcgaccttgagaaaccattgtccaccggcaataacaacatagtcgaaggtctcatactgacttgtccagattgggtcaagtatgtcaaggtgaagctggatttcagaggtggattgcccattctcattttcaaatacctcagatttggtgaggaagggactccagacgagtgacacggtgaagttgtatgattggaagtgccatctcctgtttctgtattccttgtcatggtacacttcaataggttcttcagcctaaataaaacagcaagcaggtctgctcaggatggttatctgtataacactaatggggataatgttcagtatgcatggaaggtaacatgaaacttatctggtattcttgcttgctatcatatatcatcccttattaagttatatttaagaattaggaaaggtgcacagaggaacatgattattcaaggaaagcatgaacattgcttcataacagggttgggaaagtgaattagtgaaaatatgtaatgttcataacttttaccttagacaaaaggcaaagcagtgactgaacttgattacgaagaatggagtcaccaatcagaccccaggatttgttcctcatagcacttagaaatctcacttcatcaaattgtggcagttcacactcatatggtttccacctccagtgtaaatatgacatgtcaggtctaccattcaacatacagttctggtgaccatcaataaatcgacaagttttgttggtataggctgggccagagggatttggtatccattcaccatcaaaaaggttacatttccctacaaaagaaatatcctatatgagatgcaagacaagagcactacggaaagaaacatcacaatttatacgttgtttcttatgtcaagtatcctaaacgtactgtggtggaaagtagccctaaaatcttcttttagatacacaagcagtaatagattcataaaacatcaactatttccagttcaacaaaatatctgtttgttgttggaacaaaagtgggaaggcagatctttatcacaggaattaggttggtacaatagcaggtcttgaacttgtgaatgaatacttgaatagttgaggactcacaatgttcacaaaatactactacattttaggtttcaggaaattgtggatatatagatcagccacttttctcatttacccattcgaactagtgaaagagtttaagaagtttgtcatttgtgcttcaagtgttcattcatacaaatttgccatcaaaactatttccataaatattacatcctaactattcagtcacaaccaaaagaaaacttggagaagcaacacatgcttggcaccatagccacaatccttccttaacgaccagtactttagttgctccagcttgtcaagataagcaaattctgctacagccaattgtttacaaattaccactcacatatgtcaaaagtcaacatgccgtgagtaaatgcatggttgactgtggatgggcattctacgtgttactgagatcctaccaagtgatttctaatgggaataatatgcaacaagaactaaaaaaatttcaagattactacgaatagtatcattctcataaaaatagacagtacaatttaaaattgcagaagcccacttaggacaatataacaaatcaaataatgtgaataagtacaggataggaactaaaagtagtgagacaacatttgcatatgacagatgaacagaagagttaattttgtttcatgttttagctgaagaactaatttactggctacatttgaagggcatatttatattctttgcacagatatttactaagcagtggttgacaagatcaaaacagacagctttcttatttgtcttccccatacgaagcaaacgtatataaaggaaatattgttttcgagatttctggttcttaaagaataaaaagaactgaatctctagtcttccatagagaagagattaaatatttccacttggaggataagaaaaaagaaaagtccaatcgcaattgcacaagcatgagatctgtaactgccaaactgctccatcagagaaagtttattcggagctttccccaccaaacccgccggaaaaagcgctacccagaatttgagaaacaaaaaagaaaaaagcgttcaccaattcgaaatgttttcctactaacacagcaaaacaaaatttgcacgccattccacgagataggatgaacggaacaaaacaaattcagactaatcatttggtccaacccgcagcaagattcaagtggcatcaaaatctctaactcgtggaggcatggaaccgaagacacccaagaaaaccactaatgttcgctccaacaacagcaaaatatgtcgaaatgcaccgaatctcgcaggccccccaaacccaccgacagcattaaaccctcccaatcccctttcccactgcatccgcattcaagatcaggaaacgagagagctcgcaccttcgctgatctccggcgaagaggtggaggaggggaaggagcagagcacacggaagaggaggccggcgaggaggagccacccgacggccttcaccagcgcgggcccgcccagcccccacccctcccccttgtggtgccgcgaggcggaggaggagaagggcggcggcgtcgcccacggccaccaccaccaccgcctcgaggtggaggccatgggaggcaagatttcgagctcgaggtcctccagcgccgatgccgacaccgacagtggcgcggttgggattggcgattttgcagtgctcacctgcttgcttaagtggttacatgtagtgatataggtgtgctttattacaggagttttcttgtattatttttattattgaaaatgttactgtactagcaccactgattgactctgtgatgtactattattgttaattggagtacatttatgagattttggagggttctattccacatgatttcgttattgcaagatccttaggattttgaatgaataaccactcaccaaatcttcgaaattgccagtgctcgggtgcccaaaaagattgggcgccccgcgcagcccacgctcgcatgccccaccacgcgtcttttgcaacagccatccagatataacggaaacgccctattaaggaggatctgtttcatttttttaccaacaatgtttcagctagtgttcttatgatgtttcactatgtatggatcaaatgttacagcagatttttgataatgtttaataatttcatcttgatggacacgtggtttgttaatatacatgggtttaagtgttgcaatggctttaaatcgtttgttgtatatgttgaaccaaattttttcatctaacgatctgaccgtgtttcacatttttttaagatttgaaacatcgtttcgttatttgttgaaacttgaaacattatttttatatagggtgaaacaacatccgatttttttggaaaccgttatttcatacgctgtagcaaaatgtttcataaggtgatttggttgtgtttttgctttttaaaagactgaaacatttttaacctatttagtgaaacattttttatctacttggtgaaacagcatccgattttggaaaaaaaatcgggcgcctgatttgcaggcacccccccaaatcctacatattggtcttctatatgacttatggacctgtttaaggcagcttttagcaacttgtctcaaagcccccatgccttgggtttattcgtggtacgacatatttgcaaacgaaaaataatttgtgaataaaacttttatatatatgttcaaattttggctgggaaacataagcttaagaaaaaacataacacctcaaattcttcggcttcaacacttccgatttttacctagcttctcaaaatacgtagctacaaaatctatgaaatagactagaagttaaaatttgggatacctagtgttttgaaactcttaaaagctaaataccaaccagttgcttattagaatattaattaagcttccaaaatgggtctatgtatgactcctttcaattaaaatctaagtggggtcgtcaaacctattgaaatagtttttttttccaatgacaccaaaagctctttctgcccttttgtgcctcctttggattgaaagaaaaataagaaattttggagggtcgttatccttataaaagaattagacgatataccacgcattaaacggagatttgtagatattcatgtgtacatatatgtaattggacaacagataaagatagcatgcacttagatcttcttttcagagaacatttggatgaaagcggtaaataattatacaatgcaataaactttgtgtcaatgggagcatgagactgactggaccaaacagctcattctcttcttcagttggtgcgttctgtacattgaataatcacgcttgctggcgaatcatgcccgctagtgccgactatattgacagattgagaacattaataaaaaaaaagaccaccaatagacactagcagattctcacaactgtaacgggctatctatgacggttcacaagatgtgaaccgtaattttttttgcctaattatttttacatctataacgactcatggttccgagccgttacatatgacacacatctgtaatggtcgaccaaccgttacagatgacatgtcacattatgtacctattgtactataacggacgcctaagtcattacagatgatatttttcagctattatagataaatagatttgtgctattgagaccgctacctgactttgcttcacattacaaagtgaaaaatgaaaatatcctagagaaaggtaggttataaaaacaattaataaaataagaagaacaattttcatggtcgaacccttttgccactgctgtagccaattcattcatgacgaattttagggagatgcttagatactggacagaaaactgaagaatattattctccttgaaattgacattctgagatgattttagaaaaatatatactcaccttgatcatgtttgttcctatataaaactcatctttgagtgctactgcaatgacctgcacatgtttatacactggagtcttgcaatcttgtcaggcaagtgtctataataaaagaaagaaattcattagctaccagagccttctttgtggattgaaattgggtagtgtgcaagaaaccaaatcagccagcgaataaaaaggatggagcccgaaagaagcagatgcattgatatacctatatcctgactgaccagcagtaagtaaacataagaggatagaaagatctccattgttgaatggcagctatgagctgcagactgctgttgttggtggaagaggagagagcatcatttggatggataagagaatgaggccttctttagtttgcgaacgaaaagttttggcgtgtcacatcagatatacagacacacatttgaagtattaaacatagactaataacaaaacaaattacatattccgtctgtaaactgcgagatgaatttattaagcctaattaatccgtcattagcaaatatttattgtagcaccacattatcaaatcatggagcaattaggcttaaaagattcgtctcgcaatttacacgcaatcagcgtgattagtttttttctatatttaatactctatgcatgtgtctaaacatttaatatgacggaataaaaagtttctgcgtgggaactaatcaggttctgagaagggtcgcaggaaacacatcttagtttcaggttaaagaggggagacgaggaatccgagtcttggaattcagccggtcgtgaactactcgtgcatgactcatgagctcgcgatgcacaggcgcgacttcgatgtgaacaggagaaaggaataagttcatttggtatggagaagtgttgtttagtcccggtttataacccccttgtagtaccggttttctaaccgggactacgaatccgggactaaagatcgctatctttagtcccagttcaaataactgggactaaaaatcgatctttagtcccggttgatgttaccaaccgggactaaaatccccatctttagtcccggttgatgtggggagcatctttagtcccggttagtaacatcaaccggaactaaagatattttttctttttttctgtttttaatattgaatattgatttcacatcatcccctcccatatccaaatcatcacatatcacagaacatctccaaatcctcaaattctcaaataaatcatctccaaatacatcacaaactcttaaaaaaatatatcatctctaaatacatcacaaactcttaaaaaaattacatcacagggttctaaaaaattcgtcacagattcacatctcacacaaaaatacatcacagattcacatctcaaaaaaaaaaagaaaaaacaattcggccagcagccactgccgcctcccctcctcccctccgcgccaccgtgcggccccccgcgccgccgtgcaggccgcctccgcatggccctcggcgccgccgcgctggccgcccgccgcagccgccgcgccggcttcctgcacgcttcttcactgtgtggtgaaggaaaaaaggaaggagaggaggggagttagagataaggaaagagataagaagttagagaggaaaaaaaagagatagaggaaggagtttgttatgtggacgggaaaagatgatcggtactatagattatatagtgtgttttgatttttattcccggttagtaacaccaatcggaacgtttttagtcccgattggtgttactaaccgggattaaagatcctagagccctgacacggcctgacatgaaatcaaccgggactaaaaatgaattttagtccgggttggagttaccaaccgggactaaagatgatttttagtcccggttggtaacaacaactgggactaaagatcttcctcttattaatcgggactaaaaatgagtcccggtttttaatggaaccgggactattatggatttgggtcgaccgaccaaagatggtttctctaccagtgttaactttagaccgaatcccattttcatctttaacccaaaaccagatataactggtcactatcaaaatcagtgtaaacatgatttctcggtggttttggctaacgtggcgcctacttggttggtttgactaggtcttcgtgacacgtgcattggtgtggcgcttaggtggtaattcgatcctagaaaaataataaaaacagtgggcccacatgtgagcagcacacaaaataataataaatgtggggcccacgtaggccccacatgtcatcctctctcattcctcctctctcccctctcctttcttcctcatcctacctgtcgcgtgcgtcgtgtggggatgtgtagagacggccgacgtcccacctgccgccacatgccatgaggagcagaggctgcggagggagctcgtccccggtgagggtgccggtgatctcccatcctcttcttcctcctctctctccccatcttccctctcttcatctctctgctctctcctctctgttctccttgacagaatagtgtggaaccatcatagttgaagtaaattatttttatagggaattgaaagttttgtcatgccaatggttatattaaggaaatagcaaatgtactacttgcaaagatctttatacatcaaagtgattgtatagaatttataaatatttttgttgggtttttattttcgagtcttttggcaatgggccatgaatttgtatatgacaatatttccaaattttacaagtgcttataatattctctagtgtatatatgttgtgcaaatgtgcactgcacatgctcaggagggtgagcataatattgttgtagaataatgtgtaagcacgacgcctctttggcttacacttcctggtagtgatgagagattaggcggaggtcttggcagacgaaaacaatcctggccctaaggtagtaggtgacatggtgtgatttatacttatgatacaaataatttttcccgtagcaacgcacgggcattcaactagtatatattattccgattactgacattcatcatactttattatttattaatgcagtatagttggtatacatgtatacaggatgaaaaccggtaaacaagtgtgagtatatcgaaaggaccacaacattcatcttccatcagattagtttttaagagacattttattttttaattacgatatctttagtcactactatctgccttccaaacatttttatttgccaatactgccatatataaagtgagtatgagtacaacgagcggcacaagccaggtcggctttaggttggagttttgctagctgatcctagaaaaaatggaaaaacaagcctaaaaagtagataaaagatgggaaacctgagagccaaagaaagagagcagagatacaaggaaaaaaaaaatcagcaatggctacatccacatctacttggataaaaccgtaaggtgcatggctgcggggtgatggagaagaataagctactaggcgatgaagccaaagaagaagaagaaaccagtggcaacaaatacatgaggacagaacaacgcaaagaagacaaagatgagaacgaagtacaaaagaggcggacctgcttgtgttttctttttgtgcttgcagtgttgtattcctctaggagatcttgttgtgatcttgagccagatcaacagcaattttttctctgcaataataatactttgggttatctagctttgcttgtagttaatcatgcatgcatgtttaatttctcatggttaattgttccatggttcagatggatttatgggcaattctttgtattagctgatctgtgtgagtgttagaggggattacaagggtgattataatcccgttatataaaaaaaattgtattttgtgcggtgtgccaatatgcagaattagtaattatgaggcacatgcaagtgctatttttgttggttgctaaaagaattttggattgtatttatctggtcttagcaagaactatgctttaatagtctaatttcgggcatgtaattgacattattattgtaagaaatattctaatttcaatagtctaatggaaacaggaatatagaagaatctagaaggccgatcatcatagtcgctccatcatatattgccatgcatcaaggatcaacagaagggcaactgttttgtttgaaagacttacctagcattcacaaagatagacacttgcttatggtattcacacaagcaccctagaagtggaagacacattttttttggtgctgagcaccattttattctcttctattcaacctcaagtattatttcaatggtagcagcgagaggcaccataatacctgaaaatttagagcttactattgttactcaagatgggacggcatttgatctactgaataacacataaccaactttacaaaatcagctactgatagacagtttcatggaggtgcaacaaatttcatcaagttcactacacaatttggatataattgactgctctcttcttaaaggttttagtgcttgtttggaacacaggattggaaaaatatagtacaggaaaatcgagggaataggaaagaaattcatgtcaaaaaaagaaggattaaaacacatgaatataggacatgttcggttggttgtatcggcctgacttgcatctttgcatgcaactggctacttgtttggttgcctgcacatgtccaagacagtcccaacagattcaaaatgcccgcagctagactgatcaggaatggccggatcaagcttcactgctcatcctggcctgacgcgtgtagtagcacagcccaccctgcatccgtgtgtccatgagtttcaccaccgcgtaccaggggctgacattgggtcaccagtcaccacattgtccgcctagtaatttgtcccccaaaatataaaactagggtttgctggttttgcaatgaagtcaccaaccagttccctcctgccaccttcgttagctgcgacgagctggattaggggcgaagagctccactgctgaaaatctggcgcccaagatctctagttcatctagatcatggagaaaggaggatggcgagaggaaggagggcttgagaggatcatagatctggaggctcaaggggcattgctgtcattgtcgacataaccttgccgttagtttgccatcattgcccttcatcagttccacactgtcgccctccatctggtcctcacgtcgttgtccctgctagagccctccaacacctccagctaccctctccagtagcaggacagccgaatcaagcaggcacgagctcatgaccaccagatctggctgtcgtgatggcgatggcggcgagcggtgggccagagcacagcgggaggcaatggtggtgaactcaacgaagcctcctctttttccttctcttttttagttgtccttttctctcttttttttgtcactagtttgattgcttcaaatatctagtaaccaagaggattagtactatgtatggaagctacagtttatgtttttgtatgatatatagtgattgaatttgaagaaggtgattttaatattttccaaagtattttggcctataaatggtagcagtaaccttatcatccaactaaataggtaactgcactcacacattatgcatcgaacaaaatgaaatatgttctaaaccgtctctctcacacaatcaaccaaacaaaatttaatgctagccaggctaagctcacgcaaacaaccaaacagctggatgcctaacctctaagccagactagactcaacctaggtggagggatggacaacgctaggaaaatgcgggcaacactatataagtgagtacaagcatagtaatcggagtaaactagctcagctttgggttggaattggtcaccgtgccattgccatctgcttgtagaaaaaacaaaaataaagactaaaaagtatattagaataagtgaaaattgagagccaaagaaaaaaaggaaaaaatttgtccttgccacatccatcactacccgggaaaaccctacggtatgctgttgctaggtgatggtgacaaacaagctgaaggtgccgatgatggccatggtaggagccttcatggtgcgtgagctcgctgcatccaagtggcttgacctccttagctggaacaacatatcatcgtccagtggcgcccactccaccatttgcatgcccttaggctcctacgtggatgccccaatagagttggtccccttcctaccaagtatctcggcaacgaggagccggaatatgactagtaggaggtgctcagtacttggtgaatgaagaggctctactgcctcatgtaggagatctaccaggtgatgaaaatgaagaagaggaagaagtgaatgataacaaagactacagtattctacacctctctaagctatgccctttcactacaacatacatctattgcatatatggctactaagttagacatagcatgtatcatgtaacaccatgactaagcatagtgtcatcggcagcaacaagttctgttcctcagtcacacatatcatgtacctaaaaactttggagcttactagtgttgccctagacacaatagtgcttgatctactgaacaatgcatgcctagtcttgcaaaatctactattgatagtctgtttgatggatgtggaagaaatttcatcatgctcgctagaaaatttggatatgattgatcacattcttctcaatgaaaactttgtaattttttagtgttttccatgtaaccttgtacatattttctctctgataaaattacactactaggcaaagccctggtagttttccccagtaaaaaaaaaaacaattgaagggcaattctttatttggaaactcttatctaacattcacgaagataggcactaacttatgataaacacacaaatagtcaggaagtagaagacacatttagggcccatttgaatcgcagggtagaaaaaacggaggaataggaaaaacataggattctgacaggaattgaagtgtaaaacagaggattgcaaaacacaggaaaaacacaggaatggtcgtttgattggagcgcaagaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggcccttgctttgtgctggacactgctttgctatctaattcacctcaagcaccaccccagtggtaaacataagcagcgacctgtgagagtaggatgatacattttggttactttcctggttgacaagggatgaagatatgtcacgattgatgggtggttgaatcctgtgaattgtggtttccgagttaatccaaaaataaaactaaatgtggcaaatacacacagttgcttaccataaacacataagcacatgcttaccataaacacaaacacatgctaggtggaacatatatatatttttttgcagtgcagagcataatactctaggtattctaagtttctactagtgaccaaataatgatatatacaaggacacaaacatctaacaacataagagcattcccaattatagacactgttaagagtgtctatacttggcacataaaaaatggatactttaaatagaaactagtatatattgcaatccattttatccaactatggatccaacattaaatattctctcttaatttacattcccctctgccctctatctctgtctctcttttgcagcttctcctttctttgttgggcttaacttttcctctctactttctcgatacggatggtatgtaagcagggttcaatctatcgggaaagggaaatttttcgggggtcagcgaaataacaagatttcagaaatatttcggaaatttcgaacaaaatttccaaacaaaatttgaatttgaacaacaaaaattactgaaatttgacatatatcagaatataaacatgcattgagtccatccaatccaaaattacagaatttggacaggatcggagaatgaaacgcaaggattgtatcgtcgcgtcctctgcggcttgcgtgccttctgtcgtcgtcgcggcggcgcccgacagccgcgccgccgccggccactccaaccaaacacaaggatgcgaggtctgcggcttgtgtcgccgtcgagccgaagccgcggagccgtcgctggcactccagcatgaggatgcgaggcccgcgctgccgtgtggcttgtgttgtcgtcgtcacaccggagagccgcggagccaccgccagccactccagccacccgtctgcctctggttcgagcaaccgccgctggtgctgctcgcttgtgctggaatgatgggaggagctgttgggggaggacggcggataaaggtgagtgaggaggggatcggacactggggatttttaccagaaaattggggattttgccatgaacagtgtttgccgaaatttttgaccggagctcactgtctatcgggacccaccaatagacccgaagtttcggaaatttccaaattttcattccggaattttcaacccggtatgtaagtatgtgacagatgtatggaggccaaccagcaatccttagggaggataacacatatatgtcagctaccattgtctgcagtgttgtattcctctaggagatcatgttgtgatcttgaaccagatcaacagcaatattttctttgcaacaataatactttgggatatctaggtttgcttgtagataatcatgcatgcatgtttaatttctgatggttaattgtttcatggttctgatggatttatggctaaaattctctacattagctgatctgtgtgagtgtgagaggggattagaagggagattatagtccccatatataaaattttggattttgtgcggtgtgctgatatgcggaattagtaattatgaggcacatgcgagtgctatttttgtttgttgctggaagaattttggattgtatttatctggtatgagccagaactatgcttcaatagtctaattttgggaatgcaattgagatcattatggtaagaacttcttgttgcgttcaataaaatgtagataggaatatagaggactctagaaggttcaaaatggaatagggattggacaaactgatcatcatagtcgcttgtgatatattgtcatgtatcgaggaacaaaagatgcatgggaaattctttaatttgaaagacttacctaacatttgcaaaggtagacacatgcttatgatatgcacacaatcacctgagaagtggaagacacattttttgtttcaacctaaactattgttagtctagatgatggtatttgatctatcgaatatcgcatgcccagctttgcaaagttttctactgatatactttgtttgatggaggtgcaagaaatttcaccaagctcactacatgatttggacatgattgaccgctctcttctcaaggacctttagcatttgtactcctaacttggtcttgttgcataccaaggatcaatgaaagggcaattcattaattttgaaactactacctaacattcgcaaaggtagacacctagtgatgataaactcacgaacatgtaggatgtggaagacactttgtttttctttttgtgggcaccattttggtccaaaatagagaaataggagaaaaggtatgatggtaaagaaccataagagaaaggaaaatttactttaaatgctttacttggagaagccctatctaatataatgttccatattttcctacacaatggcaccatcattttaacctatatttcaggaaaagtcatctttctccaaaatcacagtaaaaattatgaaacgagcagcacatgatagtaaactgaccttgtgcacgtattttttttgctggtgatgaggtggtggccatagcagcagttctccttgcaagttgcagcttgtgctggcaatgaggtgctgggcagcacggtgcaggcccctaggcggagcaggggccttgagctgcggcagcatggtgtaggcccccacgtagtccgctctccctcctccctagcttcctcattgtcaccgacccaccaccctcccctttccgtctcgcctactctccctcttctcgccattgccaagtcaccatgctcccctcccttttccgcccatggcctccttcctgtcggcaatggaagaggtggcacaacatctagatctagtggccctgccgccagatctgatgaccctaaccacaagcaccgaggttgatggagtcattagggattgagaaagggagaggagtggcagatctagagagagagggagggtgatggtggcgaatctgagaagagatagagagagagagagaggcgaaggcgacatatcaggggagagggagaggcaacgataactgatctagggagaaggagatgcaacaataggctaacgagagggccaaagacagtgatgggaaggggaggtgcacgatgttatgaatacgacttgtatacatcagagggcaatagcccaaatatatatatagatacaaggagaaccaaaagacaggaacatggaaagccaaaagacataaaacaataaatacaacctatctaatacacatctaacaccccccctcaaactcagggtggatcaacaacactgagtttggagagatagaacctgtgttgagctctagtttgtgccttggtaaagaaattagctaactgcaactcggaaggcacgtactaaagagcaaccacctgatcctgtacctgtgtgcgggtatacgaggcatccacaccaatatgcttagtaagctcatgtttgataggatcacgagcaatactaatagcacctgtactgtccgacaataaagaagtcggtgaagtcacagaaacactaaaatcctcaagtaaccatcgtagccaagtaacctctgctgtcaaaagggccatagctcttaactcagcctctgcactagaacgagaaactgctgtttgtttcttagtcttccaagcaatgagggaaccaccaagaaaaacacaaaaagcagaaagagagcgacgatcggaggaatcactggcccaagtagcatcagaattaccctgaagttgtaaagatgtggagcgtggaaagaaaagacaacgcgagatagttccacgaagataacggaggacacgaagaagatgactatagtgaatttgtgtgggggcagaaacaaattggctcagaatgtgcacagagtatgaaatatcaggacgagtgacaccaagataaacaagactccctacaatatgacgatagcgagtgggatcagctaacggttcaccatcagtggcagaaagatgaagattaagctccatgggagtttcaactgtgcgttgatcagtgagagaggccctatccagaagatcctgaatatacttggcttgagagaaatgaaatccttcaggagtagaggaaatctcaatgccaagaaaataacaaagaggaccaagatcagtcataagaaactgctcactgagacgtgctttaacaaaagtaataaactccgcatcgtcacctgtgattagcatatcatccacatagagaagtagaattgtgcgactgcggggtgaagtgtgaacaaagagagcaggatcatgagcactagctgagaaaccagcatccaggacaacagaggaaaaccgttgaaaccaagcacgaggagcctgcttgaggccataaagagagcgtcgaagacgacaaaccataccctctggaactaaatagccttgaggtggccgcatgtaaacctcttcatgcaattccccattgagaaaagcattcttgacatcaagttgcgatatattgcaatgacgagcagaagctattgcaagaagtgttcgaacagtagtcatgtgagccacaggagcaaaagtttcatcatagtcacgaccatgttcttgttggaaaccacgcgccacaaggcgagccttatagcgttcaagagttccatcagagcgagtcttgaccttatagatccacttaccagtgatgggacgagcatgagaaggtaagggaacaagatcccaagtaccagtacgctcaagtgcagcaagctcctctgccatcgcatgttgccattcctgatggacaacagcatcacgataagaacaaggttcagcaagaactgtagcaacataaccatagcgatcctctggacgaatcgtaactaaattacgatcacgaaaattgtatcgaggaggagcaaccggagaagcatccagagaaggctcctggatacgaggtttacgactataaacctgggtaagaggaggcacataagaagatgcagaattctcagaagaaggtgccagctgagaggaagagacaggagaaggaatgctagcacgaacaggagtatcaggaaaagtgagaaacagaagagagtcatcgggagaggatgtggagctgggactcatcaaaagtaacatcccgtgaaatccgcatccgccgtcctacaggatcccaacaacgataacccttatgttcagcactatacccagaaaaacacactcaacagactaagccgtcaactttgtacgctcacgtggtgcaagaagcacatagcaagcacaaccgaaaagacgcagattagaataatcaggaggctggccacaaagatgctcaataggaatcccaccctgtagagcagaggaaggttggatgttgatcaagtaattagcagtggaaacaacctcagcccaaaaatgaggaggaacagaagaagcaatcataagagcacgagcagtctcaagaagatgacgatgtttacgttccgctacaccattctgagcatgagcacccggacaagaaaattgagaaagagtaccctgctcggaaagaaaaacacgcaactctctagaaaggtactcaccagcagaatcagcacgaaacacgcggatgggagaatcaaagtgagtgcgaatcatgcgagcaaaagatttataaatagccaaaacttcagagcgatgagtcatgaagtaaatccaagtatgacgagaaaagtcatctataaatatgatataatagcgatgacctcctttggaaacaaaaggggctgggccccacacatcagaatgaacaagatcaaaaggacgcttagatacagactcactagaatgatagggaagttgtatttgctttccaagcttacaaccttgacattgatttaaagagacagctcctgacacagaccctaaaagaccacggcgaactaaagccgacagacgagaaccacaaagatgtcccaaccgatgatgccactgagcaaaagacaccgtagaggaagcagtggaagcaagaagactagcaggcgcagcggaaggaagacgaagccagtcaagctcccaaagacgctgagaatcacggcggcgagggccagtaccaaccaggagacccgtgcgatgatcctggacacaacaagagtcagaatcaagaattacacgacagccatgatccgtaagttggccggctgacatgagttgcatggccaatttgggaacgtaagaaacagcagggacactaaaggaagaaatagaaagagtcccacgaccaacaatagcaagaggagtaccatcggcagtatgaacagtagtaggaactaaaggagaacatatagatgaaagactagatctatcatgagtcatatggaaggaagcaccagaatctagaatccatggaatagtacctgaagcagaagatgatccctcagtagaagatgaagaaccaagaacagcagaaccagactgtgcagaaggtagagccacagaaccaacagaacctgtcgcagcagaagcagtaaggcgacgaagtaacataagaatttcctgtgaatctgaacctccagaactcttctgagaagaaccactagtacccttcgaagaattgccacgacgtaaatccttcttcttcctgaagcaaaatgactccacatgtccatctttatcacaataggtgcagtgaaggtgacccctagtagatggtacaactgtggtaggaggacgcgccgatgaagaagaggaagaaactgtagaatgaacagccggtgtcgaagaagccgaagaagccacagtacgaacagctaacactgaagaaggaagtggtagaatacccgcctctcgaagacgaatctcctcagaacgaatctccgtaagagcttccatgatagtaacacgcggatgccgagaaagtaactgtgcacgagtggactcatactcggatcggagacgtgtgagaaaatcgtagatccgacgaagatccatgtgagaacgctgacgctgacaacacggataggtatgacaaatagtcggtcccaaagaatcaagctgacgccaaatagaggataactgtgtatagaactcatctaccgtactatccccctgctgcaaagactgctcctgacgcaccatagcaagataaagagcatcactagtaggagcataacgatcatgtaggtgtgtccacatgagatgggctgaagtaagagtaaccacctcaccagtaagatgaatctccatactagctacaagaatagcagaagctcgagcatcctcatccaaccaagccttgtataaagcaaactgactctgataattttccatggcatcatcaaactgctctttagccttttctctatcgtcatcagtagcttgacttgcaagtgaaggcatagttggagcaatagggcaaggaggacagggtagctcactagataaaacatcccaaagacgctgaccacgcatatgaagacgcatgtgctgagcccaatggctgtagttgcaaccatcaaaaagaactgggcaatgaggaacagacacagtgccggataaagacgacatcatcaagaaggaagaagcgacggcgagagagcaaacagaacaagcggcagcaagtttttttttctaatgcctcagcccaaaatatagagccaccacgtgcgatcagagcacaacagtagcagagccagagaagcctttttctttctttctttcttttttttctttttcttttttttaaacctcccgatccagatccggatcggggaaacagacgccaagcgacggcgccctacaacccaggcggaggcgcccgcgacgaggggcgacggcggccgcgacgagcggcgacgaccggaggccggtgacgaggggcggcggctggaggcccgcgacgaggggcgacggcggccggagtcccgccaccagaggccggcgacgaggggcgacggcggccgggggcccgcgacgagcgacggcggccggcgatgagaagcgacgatagccggtgatgaggacaaccaccaaccctctacactgttctgaagaaattgatgatgttggggagcagagatggatgattctcagcgacaccatactagatcaagaggaacatcatggcttcaagatgaagaggccgataatcctcaaatcaaatcatggagaagccgagagagaaaaatctaagaagatgagaagtctaaaccatgctctgataccatgttatgaatacgacttgtatacatcagagggcaatagcccaaatatatatacagatacagggaaaaccaaaagacaggaacatggaaagccaaaagacataaaacaataaatacaacctatctaatacacatctaacacacgacaatggtggaaggctgacagtgaaagggagaaacatgctagaggaagagcctgagggatcaatacttaatcacacatccacaccgactcgacaaatccttttatccactcacaaataaaaccggcagcaatatcactgctagtttttattacaaactggcagtaatgctataaataaaattgataagtgaatgccctgccggccatggtgcaagctgtgtccatttccaccaagtatctccgtgatgaggaggtataatatgatgagcaggaggtgctcgggactcaagtgaaggatgaggttctactaccttatgtccatgatctagtcattattgcagcaatatttttctgcaataataatacttcaagatatctagctttgctcgtatgcatgtttaattttcgattgttaattgtttgatggttctgatgggtttatgattaattctctatatcggtttatctgtgtgagtgtaagaggacatcagatgcgagatttcatcccatatataaaaattagtctagatctaaatagctccatggatacatatggctagctagctagcttatgattttgtgcagtgtgccgatgtgcagaattagtacttacgaggtacgtgcgactgctatttttgtttgttgatataagaaattgggattgtatttttctgatttgggcaagaactatgcttcagtagtctaattttgagcatgtaaccaagatcaaaaattattgttgccttcaatagaatggaaacagcataatggaaatttctagaaggttccatatggatcggggattggacaagatgatcgtcatattctctccactacatattgtcatgcatcaaggatcaatggaaggacaattcttcattttgagacacttacctaacattcgcaaagatagacacttatgataagcacacaagcacccaaaaatggaagacacatttttttgtttggtgttgaggaccattttgttctctcctatacaacctcaaccattgtcccaatggtagacataagcagcgagggcgtcatgataagcttacagttactactctagatgagatcgtatttgatctaacaagcaaaggatgccacattttgcaaactctactactggtagactttttgatggaggtgtaacaattttcatcaagttcactacacaatttggatatgattgagcgctctcttctcaatgatcatagcatatgtactcctagtttggttttgttgcgcatcaagtacaacggaaggcaattctttaattttgaaactcttacgtaatattcacaaacataggttcttacttatgatatacacacaaacacccgggaagtggaagacacttattttttggtgctgagcaccattatttggtctctcctactcaacctcaattattgtccaaatagtaaatgtaagaagtgagggtgtcatgataccttctagctactttcccagttggcaagggatgaagatttgttaggattgctgagtggtgcatcatgtggatgaaggttcctgagttaatcccaaattaaacggtgctaaagataagcagttgcttactataaacacataagcacttacctaatacaaacacaaacacatgccaggtggaacacacatttatttttgtgatgcagagcatcattttgcagtaccatacatgtacactttcagatcaacatacatacacagtaggattacagtttgcagtcctacacacttccaaacattcatacacaacaattatctagagcataatacagagtgaaaagtatctgaatttatgccaattattgtggaattcccaaggttttggacggaattgaagttgatattctctctagttcttgaggagataatgacagatcgagctgctagattagactgaattggagaagtcttatgtgttatactataatttccccattctatatatatagagaggtaattacgctataacacccaaattctatcttaaaattattgttttcaacttttcatttgaacataaaatagaaaattaggagaaagagtatgatggggaaaggaaaaataggagagaaaagaaacgagtgaagcaaatattactttccattgttcagttgtagaagccctatctaacataatgttccgtacatgcctagagaatgacaccatcactctagg

SEQ ID NO: 41456 - DNA, 9546 bp, Oryza sativa
  unsure (1)..(9546): unsure at all n locations
ccccccccccctcacctcaccattgccgagtcaccacactcccctccttcctcctaccatgaccacgttgctgttgtgatggatgaggtggcacatgcaacatctggatctggtggcgttgctccagatctgatgacccccatataggatctgatggaccctttaactgtaactagttccccaatagggaaggggtgaagatctctcgggatgatgtcacccgtgctttgcatggtggttcctgattcaagctgatgataaactggagctaacaaagatacataccaacttgcactattttgttccctccttttcagccttatctttatctttataaaactgaatatgctactgaaataggcattctaactaacgaggaatgactaactaatcctatctcaatacctgcacgcacacacatctaatttacataagagtatttcatatactacactaatgacagtgtctatacttgccacattaaatgggtgctctagatagaagcaagtattattgtcatctttaataaccaacatagatattgtcaatggaagattatccttcatcaggtctgaagaaacatcttcaagaactcaacttttggaagttgactaacaggatgagccacaacatcttcccagtacacacctgcaattgtatcatcctgatcaaatacagaacaaattgcttcaccatgtctaccactgatgccgtcacttggaaatcagattgggttgatatcaccctaagcccatcttacagaatctttcctctgagtaaccaatatgccttcaaatttgccctctgtcatacccaagcattgcttgaaaatcatctatctaaatagcataccagctctttgcatcacagtgattgaactaattgaccttttcatctatatatgccctgctgctaccataagaaacaaaagaaccaccatggtatatctcatcagtgaatttgccatcagtatgagctgcattgcacgttacggcatcctaattagcaatgttgaaccctagataatgaactacatacttaaatcgacaaataactcaaccaaacagaccatattgaaagaataaaaatttcatcaaccaaatttacctacgtatgaatctaactacaataggcacaagatacatggagatttcaatgtctcttccaaaggcggttccccttcaacccagaacaacgtcctccacatgactaccattgggcgaaggccaagccagagaatccactccctttccatgagcacggaaaccctatctcatcagtgatcacctccttcacactctccgacggtcacctctactaaggcaaagaagacgaagtggtggcagaattgaaaatagagagaaatagaggggactagagaaaaaaaggcagggcacaggcagcgccacacatgtcgcaagagagcgcgttggctaccgggcttcgaggcttcatcgagccagcaatcgatgggccacggcatcgaggaagtcgaagcgacgggtagtatgcacaaagttgagggtggcagagctcaacatggttggtgtgtgcaatcacacaaggaagaattgaacaccatgcaatagccgatggatgggtcgacctaggaaatatgggaatagaattagaattatactaggtgattccccgtgttttgctgcgggaattactaactaatatttattgtctttttgtaatattagttattaactacaaataaaattggtttatccaaccatgtttggagagaaataaatttagtacactcggtaagagattgtagatgaaatattagttggtcaagatttgcattgtaggaagcgggaggtaggaaaaattgataaaaagtttttgtttattagtataaatcacaaaagaaactaaattatatcccgcactttgaaaatatatggacaaatatatgtgaagtattacaaaataatggatagatatgtttaagaactgtagaaatgatgagaggtatagatatatttgatgctgatggtcctttcatgtgatgggccgtatattttcagggccctatagtgagatttatcccccaccccggtcctatgtgacgtctgggccatgactcgatggcaccgtagggcaagctggccagcatcagggtttatcggaggctgcaagctggcgcgtgcgcgccagcagcgagtactcctcccctcacttagtcttaactaactatattagttaatatatttaacactaatgatagtaattaggaaagattttaaagatttttttgagatatttttactaacagattgaaaatttttgaagttagatttgaaaactttcgatttaagtttcaaattttaaagtcaaattttaaaaactttcaactcagatttgaaaacttttaacttgagatttgaaaactttcaactcagattcgaaaactttcaactcgagaatcgagattcgaaaactttcaagtccaaatttgaaaaatttgaaaactttcaactcgagatttgaaaactttcaactcgagattcgaaaacttccagatttaaaattttgaaaattttcaaatcgagatttgaaaactttcaactcgagatttgaaaactttcaagttcagatttaaaaattttcaactcaaaaattaaaaactttcaaactcaaaacatgctaaacataaaaacaaacaagaaaaaagtggaaaaagaaaaagaaaaaaagttaaaacaaaaggaaaaaaaaacctaagcgctccgcgtgcgtgcctgcaacgcgtacgcgctatttagctttctcgcggtttatcaatggtagacgtaaaatctaaagatatttcttgtctgcggttttgatctggtatcgagattgtcaaccctgcctagaggtttcctactttcctggtccatatggggaatttgccacccaatacaatgtctgttcttcgccatgaataaaaagttatcattacatgttaaaaagtccattaaaaatacataatacatagtatatatacttttgtttaatgaccgtactaaacaaaatcttctatggaacttaacagttaacaatgattatggggatccgtacccctgccaagtgccaacagaaaggaaaacattgggtattctcttgcaagcagaaactacgatccccatcctacctgtgtatgtgcaagaaagtacaacttatgcaaatatctgagatatgtatacttcaaagatacttgacaaaatggtacatgcatgcattcatgcatatcgtgttcaacatatctactgataatgtggcgctgaaaaaaaaaaactattactgcgggactcgacagtttatttgtttatctgatgaatgcacaaactgaactaatggacagacggaaataaacgagtactatgtttgagcattaaatttgttgtcgaaagacaactgcatacgtcgaaaaacgtggttactcaacagtggttgaaaggaaacgaagtgtattgaattttgaattgttttctttcttttttcccctccccccattacatggccctaggggactatttatagccccattacaggttcttactattagggtttaggttgtacaggggaatttacatgattacccttacgaaaaggacatttacaggggtacataatattataggggctcatgggcccctgatgggccgtctggcgatcgccggccctatagcccctaggcttgttgggccggaaaggcttcctcggccctcgcgggggcgaacttgccatagtgaagtcgtcttccttcggcagatagtcttcgccttgcacccttccctgagacgcctctggcctggcaaggcactcgtacgactcttcgcctcacgccgttcttgctccatagccttcgccacgggtttcggcagatttggtcgaagggcctcatgccatccgccaacaagcccctcacggacaagggtgagattggagcttcggccgagaccgtgcaaaccatgtggtatggtatgcggtgccccctttcgaccgatgctcctgccgaaacctacattatttctgcgaatgaagtttgttacttgtgcggctggtattattttgccgcgcttcgcctcctgcgattggtggttatatattttcttttcccgggccgaacggaacagtattgggctttcccttcgtgggctttttactgtgccgctcggacggtgggaatttaccgtttcgcctacccttgcgacacgtggcgctttattactggtgggtaggcgaacggtcgcccgggtgagctatatattcccaccgctctttccttttcaccgccacacttgccattttaccgcgtgcgctctcttcctccgtttctttcttccacagcatctcttgacccctcaagcgtttcgcccgttctctttcttcgccatcgcaaacgcaccgttcgccatgacccctcgcaagccaaaccctgcttcggcaaaagagccagatcccggccgagtcaatgacgacagcaccacctttttgggggtttctcttatggacgacgtcgagctggcgaagctggtcagctctggggcgttggttgaggggtaggctttcgccccagggaaagccgtggtgccgaaaccaatcgacaatcggacggtggtgttcgccgtcttttttgatgcagggctacggtttccctgcaacgtgttgttgccggagatccttcgcctcttcaaggtggagcttccacagctgagcccgtcggcgcttgttcggatcgctattttcgactgggcatgccggacttccgggtttgagcctaacgccgagcttttcggcgccatattcttcgccaccgtgaactcgaagacggtgattaccccaactgggacaaagaagaccgagttcaggagtgtgaacttcaacgttcatcctgagcggtccgatctctggccggtgaacgctgccatgtcgaagtgggaccgccattggatggctaggtggttctatcactccatccccttcgaggctggttctgactcggcgaaagccctccggtgccggcgcagggcgatcgcgccgaaccggaaacccaagatcaccgtggacggcgctatggaggcgcggttcgttctgctgcgcaaagtttgctcccgccttagctgccgtgacttggtagaggaattctgtatgcttcgcatctttcccctctcccaggcatggcaagtcacggttgatcaaggcgaagaggttgacggtttgccgaacctgattcttcctgaggggacgaacagtaagactgttcttttgctatatactgctgtgctttgttattttgctttgtctgacttttaacatggctacacacttttacttttgcagtgttgaccctcgaccaggctgaaaccgaagcccgcaggatgatcggcgacgtatcggtcgtcgagtatagccaactgctaacacgacaagtagggatgaaaacggagcggatagtttccgtccgctccggataaaaacggatacggatacctttcggatcggataattctcggatagttcggatatggatacgaatacagatattttctaccggatacgaatacgaatatggtaccagggtttccgtcggatatggataataattcggatatccggtgaatagtgttattcggatatccgcaggacccatgagacataccccatttatttctaactctataaccttcaatatacctttatagattttaatagtagtttatctcttaacactagtccatactattaatattatttaaattttaaaaaatatttataaattatacctcattttatataaaatgagctaattatatatgttgatatttgtttctattagaagttgagttggttttcgtgttccgagaaaaaattgtttccgtattcgtgtccgatcatattcgattcttattcgtattcgagataatccgtatttatttccgtattcgagctatcagtattcgttttcgtatccggtaaaaaaatatgaaaacgaatatggtatgagcattatccgtccgtatccgctctgttgtcatccctaacgacaagcgtctgggcgggcgaaccgggtttataacagcgagttgcctcctcgggcaaacccccacaaagcggacgacgatgcagggccttcgcgaaagcgaatgcgcgggcaagtgaagcttgcccctaggaagcgaagggtccctgcttcgtcggactccgacgccgacaacgaggacgatgccgaagaacgcgacggcgagaatgaaggagaggaggaggccgtggccgataaggccgcgaaagaggcgatcgaagatcgcgtcgatacccccggctacactcctaccccaagtccaggtcacaacgagaccggggtggagtcgaacagctccctccttcgacgaaaggatttggaaggggcgaaggctctagttgcgttctcctcgggcacggtggcgaagggaggtccggtgaagaagatctccaaaaagaaaggactcgtcaacatcgcccgcattttcagcgacgacgagtcttctgacgagactccgacttcgcctgctggccgtagtttggacctttcgactgctccccttgctccgctcggcgttgctggggcaggcagtagcaccgccgccggggcttccgcctccgccgaacggatcgtgtcggctacggcgagggttttcgggagccctgtgcatgagccagctatttcgccactggtcaaggcgaaggggaagtgtgcggccgccgaagcatctgcctcggagtattcccttgcagcgccccactttgcccctggtgacttcgagactcgggcagaccttattccctttgtggagggtgtgagcaaccttgtcttgcccgccggcaccccgagcctgttcaccgaacttaacaagttcgacgaggggtgttccaccattaaaagtttggcggttcgggtatgccttttcttccttcttcgttttcctcctcttccctcttttttttacgtctcacaattagccttttgttcttttcgcccgctcctatctttcatctagattcttgcggctcactgttcgacggagcgaaccgtgcgggcccgttttgacggttttaagagccgtcttcgggccaaggatgatgaaataagccgcaagaacttggaggtggaggccctggcccacaccctcaaggaggcgaaaactgaagtcaaacgccttcagtccgaattggataaggggaaagaggccagggccgaggttgatcgcctcaaggccgaactggagaaggagaaggcccattcggcggtgctcatcgattactacaaccttactgagccgaagatggaggctctttgccagaaggctagcagggccgaagcgagcgccgcggaggagtcgcagcggttttcgcgagagatggcgaagaccaccgaatctgcgagaatggcttgccaaacgctccgcctcgcccttaccgacatggacgcgaaggtgcggggggtccctgccgaggatgcctcagccttcgacttctccgagtggacccagcaggctggcggatcggtttcggactgcgccaccgcgtacggcgattgctgtgcgcgtgtatcggcggccttcaccttaggccttttgcagcagttcggctgtgagcacgttgccgagttccctacctatgcgaagggggactgggagattagtgcgcagaacattttgaccgctcttcgcgcgtggcgaaaacagttttggcagaaagacggccggtccgctgccaaggcgcaccttctggagcaactggcgaaggcggaggcggtagatcggtgcgaagaagagggcgcggtgggcaaagaggttggaggcgatgcccaggatcacccagaggtgtgaggccctccaccctttctttagagttttgtagtttttctccctcttttgcgtttgcctagagaggcgaatgatgtatattcagcaagttgccaccaaaccttaaaaaaggcttttttgtatatttggaatgtatgacacaatgttaaattcttttttgatgatcgaagtctttagcatattattatttcgctcatttcgcattatgccatacctcccccttctttcgcctattcttactatataagctgtgttttgctttttctgcgctgtctatcagggggttcgccaaaagttgtgcattcggcccccttccgggagctggcgaagtcaaaacgagaaatttgtggcattgaaggacctgccgaaggtgcgatgtccatttcgccctgtttatcgcaaaatggagataaacggtcagagctataaggttatcaaagttgccaactggctacgagcgcaccccgggcgaaccttagaagattacgatcttgttcattcaagacgtttggaggatatggctcgcttttggcgaaaccatcagaagactaaacgtcaggaaacgatctttcagcgtcgttacagtttagtctgtgtttcgccccctactcctcttaaggttgtgtatgatattagtagtgatgacgaacctagttcgtctgaccattccttagagagggataatgattacgggggcgaagatgtaatttacttgtagagtgaattgtatcgtgttgtgaaccttctattcttcgattatttttttgaagttaataaagaacgtgctttatttccttttcgttatttttcgcatcatcacattttgtgcttttgttaggtcggaacatgccggcccctttgcgtatattagcgaaataggtgtactgtcttttcagtttttcgtcgttcgttttcgatctgtagcattctgtgtcgaaagagacgcttttgcttttatgttgatcgaatcgtaacgtcattcggctagttatttttcgagacaagctgttgcggtttcaacgttcggcgagcgatgcttcggccgattcgtttctcccccctggcttttttcgctgatcaggcgtttgccttggggtttttccacaaattatcaatcacgcgaaaaaaaataaaaagaaggcgtaggacacagagattttatactggttcgggcctccatggtggataatagccctacatccagtttttttttcctttttttctctcttattttttttctttgccgaaaggcttacatagtgccgaagggcttacatgactgtatgtacatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41457 - DNA, 10560 bp, Oryza sativa
gatcttgtgggggtcgtccgaagggcccagagaaccgatagcaattcctctggccatttgcctttcgctgccccctcgagttttttctttagtgcttctaggatcttgccatttgtacgtttggccgccccatttgactgcgggtgcgcgaccgacgcgaacctgatttccaggttaagcccttcgcacatttctctgaacttatcagagtcaaattgcttgtcgttgttagtaatgaactcttttggcactccaaaacggcaaacaatgtttttccatacaaacttctgtactgctgccgaagtgattgctccaaggggttcggcttcaatccatcgagagaaatattccacagctacaattgtgaatttatacccgtttcgcgccaccgggaacggcccgatgatgtccagtccccatctggcgaagggccatattggcgcaatgggctgcagatcatactggggcgcggtttggcttcggccatgacgctggcaactttcgcacttcttgatttgctcaacacagactttcaacacagtgggccaataaactccttgtctaaatactttggaggccactgttcttgcagcctggtgcgcgccacatagtccctggtgtatttcctttgccatttcttcgccttcggcaaaagagatgcaacaaagtaagggttgaagtaccccggagcggtaaagctgacccgagaccatcttatacttcgtggctctaagttgcaaacgctttgcttttgcttcgtctaccggaagccagccagtttcaaggtgtttcacaaatggggttcgccagtcatatgggtcttcgcccagtttctcctggtcgattgccatgacttccgagctgtccatggacacacttggagcatgtaggacttcgaaaaagatgccaggcgaatgtgggccaccacaagcagcggatttcgccagggcgtctgcttcctcgttctggcttctaggtaagtgttcgaccgttatgccagtgaagtatttttccatgaaccgaacagcctccagatacctcttcattccttcttcttttgcttcgaaggagttgtcaacatgacctgctaccaacttggagtcgattcgaattagcaagcgccggactcctagtgctttcgcctttcttaggcccaggaaaacggcttcgtattctgctgcgttgttggttgtgtcgaactgcagtcttgctgcgtaccgaatcggcacatcattcggcgaaaagaggactgccgcaatacctgcccccctgtgcgaccacgagccatcagagcacatcacccagaattgttcggcgggctcggggtcgagggcaagtaccggtgtccattcagctacgaagtcagctagcacttgagacttgatagcagagcgtgcaacaaaatgcaagtcgaacggggatagctctgccgcccacttgctgagccggcccgtgacttccttgcctcggagtatttcgcccaaggggtactgtgatggcactatgactttgtgggcctggaagtagtgcttaagctggcacgaggccatcactagggcgtaagcgagcttttccatttcgatgtatcttgtcttcgctccttgcagtgcttcggagacgaagtagaccggtttctgtccgaactctgtttcttggacgagtgcagcactgactgccaccggcgaagctgctaagtataatagcagttcgcttcctgggggtgggcttatcagggctggcgggctttgcaagtattgctttagctcgtcgaatgttgcctggcactctggggtccaatcaaactttcccgcgcccaggagggtcttgaagaagggcaaacctctttcggctgcctttgagaggaatcgactgagtgccgcaattcggcctgcaagcttttgtacttcatgtacgcttgacggaggcttcatttgctggatggcatcgattttctcgggattcgcctcgatgcctctttcggaaacaaggaaacccaacaacttgcctgcgcaagctgtcgaatgtctcctgcagatcaatcgcatggtcgaaagccttgcggctttttacgacgatgtcgtcgacataagcttccacattccgccccaactgctcaccaaggactttgtacaccagtctggcgaaggttgctcctgcattccttaagccgaaaggcatcctgaggtgacaaaatgtgccaaacggagtgatgaaggatgctttggggatgtcaagcgggttcatgtggatctggtggtagtcggaatatgcgtccaggaaactcatgagctcgcatccagctgttgaatccacgagctggtcgatccgtggcaaggggaagtcgtctttcggatacgctttgtttaggtctgagaaatcgacacacatgcgccatttgccatttgacttccgcaccaacactggattcaccaaccactccggatggtcaatctcttggattacccctgccctgagcaatttttgtacctcggctttcgccgcttcttggcggtcggcagacatcttgcgcaacttctgttttcttggcttaatgtccagcttgaccgccaggtgatgcatgatgagatctgccggaacaccccccacctcgtcagggctccaggcgaatgtgtcgatgttcttcttgagcacctctaggatactctcaacttcttcttcgcccatgtcgccccccagtgatacaagctttgtggggtcggcatcatcaatctgcactttcgttatcttgccgtgaggggtgggctttggcatgttcttcggctgttcatgcggttcggtctcaacgctgtgcactgctctgttgattatggctagatcgcttttcgaagcggccgaagactgaagccccttgactactatcacccctgccaggccgggcatcttgagcttgaggtaattgtggtgggaaatggcttcaaacttgttcagggttgcacggccgaagatggcgttgtagttgtacgggatgtcgacgacgtcgaacagtatttgctcttcacgtctgttctcccccgagccaaaggctatcagcaagagtgcttggccgagtacttgaactgcttctccgccgaaaccgcggagtgatgctggtgctggggtaagtgcttgggtaggcaaccccatcttggcatatgcttcggcaaagataacttcggccgaactccctccgtcgaccagtattcgtcggacctcgaaactagattacgaaaggatcttgatgcgggaacataactccttctgcgtcttccggcccaaaagaaattagctggtttagatattgcggcgccccttcgcccgccgaagtgatgctgtggaccatacggatctgcatcttcttctgccgcttggacaactggcttggcgggtcggcccttgtaatcacttggattatccttcgctgtgcatcttggcgttgtttggctgggggtgtttgctcctgaactgcttcgcggggtgcttcgacagttgttccctgctgcagccttgggtcttacgcgttgccacattgcctaatgtttcggcattgctccgtggtgtgcgaagagcgtccgtgaaaggcgcagtagaggtcttttcggaccttcttgcgggctggctgctgatggttgcttgcttgctgggcgtctcatgatatatgcctgcatatacatttgcgtataaaaagacacaatgaggttcagttacaataaaaggctgaccaagattatctatccaccctgacaattttgttttggctagtttcagagcctaaatatttcgttgttattatggagtagtttcatatgataaggagcaattctgctgagatatatgtttggagaaaattcatacttagttgcttacctgacttgatgcctgtaagaaagcaagccgaggagccaatggagtttcaaagaatcagatcggaggcggtgaaactggcgagaagggcgacgagcggcggagtggcgcgcgacggcggactggcagcgttagggtttggagagtgatggaggcggcgtgaggagcgagaggtggagggggcggggcgtgggttggaggcgcagtggagcgagaggtgggggaccgatggcccgcgatgcggtgccgggggaggggagcggaggaatttcgcgatcggaacaggaaggaaagtgcgcgtgattcgggggcgctgctgggtgagggaaggcgatgggtacgcgggagacgttagattgagatgagataatctggactgttgagtgacaaatgaaagaatgagtgataagtgatgagtgaaaccatttgttgaactatagggtagatagataactctataatatttatgtattctaaaccaaaaatataaatattcacaggatatttttagttggtggcgcacccattttataatatatggttgaaaataagactatttgtcctccctgaacttcatgttgtgccatgccaaggcggcagcccaaacatgacccaactattgggtcgggccaacacgggcccgacaccattcgggccgtgctatgcctaggccgtaccaaagcggcgtgccatgggctaggccgcgggccataaggccatctaaagttcaggaatgtgctgctgattttttttattagagcatgtgttaatgggattgtgagtatgatgttgcgggtagtgatatgtgtttgtgtgtctctgccacgtttcgaaaaaacaactgatatactccagtatacaaagattgcatttcaaggtagttctcatcttaaacaagatccgatgcgtccatccatgatcacaaggctgggaacattcctccctcgtaacacctacactacacgtatgagctgaacccaccgctcagtcaggaccagggtttcccaaactgctggggccggggttaccgcgtcccggcggtaagcacggttaccgcacggtaaccgtggtaaccgtgataaaccgtgcaaaatttatcaaaaattcaaattattttttaaatttatttgaatttaaaaaggttaccgaagtatttatattaccatacccccgcgataaaccggttaccggcggtaagtccaaccctggtcagactcaggagagactcccgcgggaaagccgaggagtttcccgccctgtagcgcccgccgcttcactccctcccaatcccccctcctaaacccagctaggtttccgcctctctcaccatctccatctccatggccccgaagcgccgccgtgcccgtccggcggacgagagctcgacgccgccgccgccgcctcctcccttgcggacggcgccttcgcatttgcagccggtggttgttttcgcccacggcgccggcgccccctcttcatccgactggatggtccagtgagctctcactctctttatctctctgtcctgtcttctctcccccctttgcgtgtgcgcgtatggataatcggaattgtggcgactattttgttggtagaggtagcgtcttttttttttttttggtatgtgcgtgatgatgtgcgaaattgagggagtgatttctcatctctgttagttggaaggatatggtgaaggatgcgctcgatgctatcgaagttgtcacctttgattacccatgtgagtttgtctgatgagctctaagtgctgatttgttgacccctcactgttcgctaaactcgttgatgaaaatctgttggggggagaatttcatggtagagcaacaatttgttggctgcagatatgtcaggtgggaagcgcagggctccgccgaaggcggagaagcttgttgatcatcaccttggtgtggtgaaggacgctgtagcgaagcatccagggcacccacttgttctgatggggaagtctatgggttcaaggtgatatgtgggagctttaatctcgtttattactttatttcagacttgtttgtgtttttgacatctgtctcaagattgtagtcctcatacatttttcagggtcagctgtatggtggctgattcagatgatattattgtttctgctgtcatatgcttgggttatccgttaaaggtatcctctgtgttgtgtggggtaatatgattgctacaatgtatgaggatgtaacccacatcaaaaaatgatttagccttcggtttccattatataataatttgtaggacctgaaccagtttttcaggaaaagggttgctgtgattttaaaacatgctccacttggttattttcactctctgttatggctctacttagggatgttttgttttgcatccttgctttcttcctcttagggagtgaacggggcagtgagggatgagacactactgaaactgaagattccaacaatgtttgtgcaggtatttctttctgaacacactttgaaatgaaaaataatattcaatattttttaagcttggtatgcaatgcatttttgttcacagggcaataaagatgggttatgccctttggataagcttgaggccactcgcaagaagatgaactgcaagaatgaactgcatgttattgatggtggtgaccactcctttaaaatcggcaaaaagtatcaagagtctactggagtgaatcaacaagctgcagaaatggaagctgttaaagctattgcaaaatttgtgcagaactccatagcaggaacctgaacttagctgtttatgtactatttagggtgttgcaagaattagtatgttcatgccttttggtatcacttagatgtaatagaaagctattttgctaagatggcaagaattaatatgttcatgcacttggtatcatttaggtgtgaaagaaagctattttgccaggatgctagttttgatttgcgcatccgcatccaacatctatttgttttcttgtcaaggtatgccatggttgaaatcattatcctgactactttacatagttgggcaatactgcttatctgcgagtcatgaatttgtctgtgggtatcacgatttaattgtaggtataaacataactgtaaacacagtgaagtttgtaattatcaagggatttctctttgctatcatcagagcaatatgaagtactttgtacaagatttctgttgtttaacatcaatctattttttagataacttacaccaatccaaatccatgaagatcttttgacatccattcatggtgctgaatttatgtacagaagttggcaatcatgcatgtaagtttaccttgcgttcctacatatatatttttttggaagttttgtttcatcatgcatgtaagctattatgaatgtaatattctgtacaatgttcaatgtcaaaagaattgataaatctgtcctggtgttacatccataaaacttcttagaataattctggagttacattcatgctgtcgtctttgtttcatcctggttccatctccatggttttgcttagtagacacccaatcatgggtggagcttcttagaggcttatctaggctatagccctcccctgatttaactactacaattaagtccctttactttgtgacaggtagcagaaagtaactgtagaatggtccctacgctgaaaatagtttgaacattatccccctcaaaatttctcttcaagctccgccactgcgcccaatgttgacgataaatcattttaaatccttatatgctttgatgcaatccttgtgtctatggtaaatcatgtttggtagcatgggaggtagactcttattccgagatagagatgctcaacattggatgagttgaataaagggctatatttccttaattttatttatatatttgaattgtatgatgtacctttgaacttcgttactgtgtttgttttcattttgcttgaggagttgttttcttgctgaggtctagggtgtttcttccagtatatggaccttgtgttttgttttctttagaattgaccaggagctgtggccctcagtgagatgggcaactggaaataacatcctaataaatgtaggcttgtaatagcatgcatcaagaatcatatttttataaattgagattttaaccccaacttaagaagtaggaatgatcatgatatgaaactatgagcgcagtaaacccattctttatttttcacattctactaaatttcatatgtcaggtggtaatgatcacttaatttgtgaatggtctggttttgaagccatctattttattaatgtttgttgtaatatgatgaaccttttgaatgatagacaagaaaacttgccaatttactgatgttaaacaactccaactcttctaggtgaatatattaaacaaatcgtaaattcacctggtgaatatggtgtgctatagcttcagttttcatgaagttccaatttatggacatgtgggctgcatgcctgcacatgcattcaagtgatgtggtacaatgatatatcataacctccgtagaacctttcaaataataagcttttttttatatagggagaaacaagacagatacatgaatgatcagagacaatatattctatgtaaccaagctttggtaagtcataaaacttttgctagtcatatcatagaagagggcttactcaatggcaagccatagaaatatagaatcttaaaaatctctaatgcatggaaactttcacataatgtgaagcatatcgtccttgtgtagcatttatgggtacaacagacatttcttgcaaacaaaacagataatatagttcaattttcagattaagggttatgcccttttgtgtccacatgacttgttggaattttcactacatttgcttgttcaatatcgtgaagcaccttaggtgcttccttgcatttgctgtaaatgcagtatacaaccaactgaagtatacccattatgctgccgatgcagtttggggtcttcacaagaaaaaaagcatgtcagtttgatatatagaagtttattgtggctaaaattgattatgtccttaccgcgataaaaggatcccttcctatgactccatatgccatccaggttaaacttgtgaagagggtaaacaatgacagatagaaaggcatgaactcaacactctttgtcctgataacttgtttctgcaattatggaagtacatattatatttttaaccattcaaaataaaatatgtgtagaagttgtcttgttttgtttctctaccatatctaattgaatgctttgttcctctattatactttctgatgtgaatagcatttcattgaatcatcattatatcttgaagcacatgttactttttagcatttttcttttttattgaagttcagtatgagatcaatgttgcaaggttttatcttgcaggctgatattctattatctgaatttcataattcctcagtcaatataagtaacaatactcaccatagctaccagcggagagccgtacattgatatggaagacactagaccaacactaccaacaaataccttacgtatatgatggttgtgtattgaaaagcttgagaaaaacacagtcatgcaaaagactgctagaatcagagatgccatcagcatgacttgcttctgcaagagattatcagtcagtgttaacataatcaatcaaaaaattcacatcctgtaaaatctctctagtaacatgccatgtaacatcaaacttttataaccacttaggcacaactatgaaataaaatcatttcttgtttcttctgaaccggaaatgcgagtgtttgttctgtcttacgtgtgtctgagaagaatcagacataatatcctttctttcaagagaacaagaagcaccgatggacatcatatttttagtgttctattttggtatagtgctaaaattttgggggtgtgagatcagagattttactactggctaggtacttatgatttggatcttacttagtttgcctctggttcttatcaatattaattgattcatgttgtcatgactatataacatctagaactttctaatctcacaactttgaaccaaaactgcatcacatgcacaagttccctagaggcctttgcacatggttatgttagagctaaaaagaacaaaatcttatatgactgactttgtgctgaatatagtactgcttttggagtacaaacagatagaaacatggtcatttgagttcaaaattttggatagatttttttactattttatccaagcaaaagcttgcattcgttcctactttcttctgaatatgtcataattatacagctgttgtcgtcttactatattttgttgtattcctaatataaaatattagtgcaaacaacttcaaaaacttgatagacacagaagtaaattagtttacccatggaaatcattgaaatgctgaaggaacaatagaagagttcttcagaaatgacctactttttttcctcttggagcaaaccatacatatatgctgatgaatgtgccttcaaatagcaccccaagtgagctgatgctgcagactgtcatgttctcccacccatagctcaccacaggaaaaccataccaactgtatgtgaggcagctgaacaaagctaagatatatggtatgcacgagaattcttctacactggccttctttatcactcttttaaatgtcaatctaggaaacatagtaaa

SEQ ID NO: 41458 - DNA, 1731 bp, Oryza sativa
aagctattttgttgcccctggaactagatttttggatagttcattgtttacaatatgggcaggctatttataatgtgcaatggctgtttaatgtgggaatgtcgagatattgctcaaaccactaaggtagaatatctgtttttttttgttgctatgagatttaacacagtttttttgcaaacatggagtaatgctggtattctctttcatgttattaccagcatctaactattttattgcacctatgtacctatgataataatataagtttcatgttaattttgaatctggtccgtcactggagtaggaactagcgaactagccaatcagtatctattgtacttgcaacatagttagatgtgaatatggtactcaacttctagattttaattgactacgaagatacggaacagcagggttggaaatttcggtcatttcggtcccctccgaaacgatattaatttggctgaaatttttgaatttttcaattttttcatgaatttgggtaatatttgttcaaattcaactaaattttgttcaaaatttcagaaattttggaccgaaatttcgggatttcggagacccccgatcaaaagccctaaaccgatatagtgaaccctgcggaacagcattagcaaaaatattagcttagaatcgttgctcttggatggcacttctgatgcacgatgaaaagcaaacatgaaaacaatcaattgctttgctcttttatccatttttccttcagtaagttaagctcataattttgaaaagcagccattaatatgatgctccattactccgtcatatagaacagttccgttattccaatgaaagaactgatgctgttgcttgccactcttcaagaataacgtgtctttttctggtgacattagtgaacatcactaaaacgagtaagcttcactaaggttttgcttccagcttttgagaagatgctcatgattagagagatgaaagattcaagtatgaaccctttttagacctgtaaatagttttacaggtcatgaagccaagaactttgagtttttcataatgtttttgactcttgaagaattagagtgcagtgcatttactgaagtagcaattgtggttctttatgattcatccatatctggtaaagaacaattgtttttttccttgaagatctgatgctgtcatggctacaattgtaacctcatatatgaacttttctgatgaaaaagcagtctatgtatatattttttaacatgtggtcattctgatgcggctagttagctctattctctctaaattaagttggttctattgagttgacgttactaattttcttctgaatcttctaaagcactattaacaaacttttctgttataggtacatgtcccctccttcaatctgagtgctgcccctcctccaattgttcagttcgacctcaccacaatcctgtgagttatttgtcatctactggcagcgcatttcttagcaaacacatggtgaccaaccctctcaggttcttttgttctggtaccaaaatagatgggatgtctgattctgcgtggggctactgaattcacctgtccagaacttttgcctgagatggaacatggcctcgtttgctccaatattgtgtggaggaataagttaatgtggccatgtttctcctgttaatttgggaataagtcctttggttgatattaactgcaaagacaacatgacaacccacagaataaagcttg

SEQ ID NO: 41459 - DNA, 1388 bp, Oryza sativa
tgaatatggcgatgaccaaatttgcgttgtttgagagtgagggaaggagcggggctcgtggatcaggtgggtacgtgggagctacagcggtcgtcgacttcggctagtggtaggaaatgagcctgacaggtgggcctcggtcctacctatcattgagaggaggaaaggcaagccaagcatgcccggcgtgggaggtgggaggaaaggctgaatcgggtgtgggtgagatgggctgacaggttggtgaccccaaaaggagggggcgtgctgagttaggagttgggctagcaaataagactgggccatggggaaagagaaacaaagagagatgttgagcgacctgcgactgcgagagagaggggaagaaggaggagcgggtgggccagactactattggtcacgtgcgatgaggagtgggtcggaaatgatggcccacctggaaatgaggacttttaattggtttttcaatttaaatattctctgaaatggactttgtgctattaaaatttgatgttgatctctgaaaattctgagaaaattatattaattattttagggcatggataatacgagaaaaatattcccaatcatgatttattaaaggaaatgttattttctgaattaacttcacttgtaaatttctttttattttaatataaattctagaaataaattattaaatgatttttaaatccctgaaggaaaatcaggcatgacttactcctacctcggagttaggcctctaacagtcaaaaattctatcgcaggtctataaaactaactagatcggatactttgatcccaacataggaaactccgattttaaatggcaagccagactgagaaccaagttcctcccacgaatactcaaatggattagacagtccgatagaggtcggatagtgtgatgttgctaagataaaaatataagaactttttactccagagtttgattttgatgatcttggattccatgtaaaggttggttatagggctatcaaatccatcataaacaattgtccaaagataaatcattttgagaacttaagcaaacacatttgtattcatcttaccagtacaacattcctatactcaatccagattttaattaaaaacaccgagaccggtaaaggatttgaaaaaggatgcttagtttcattatacctttgccttgtgcttcttcttgtggacttagctggacaacgcataccactctgtttagtcacattcatttattatgatgtttggtcacattcatttcttccagccacttgatgcctttcaacttatgacgatatcaatcactgttgatgtggatcaacacatgattcccatgtttcagctacttcatcttgagacatacgtgactgttgatggtcattatcgat

SEQ ID NO: 41460 - DNA, 9763 bp, Oryza sativa
atatcagttaactagaatgtatgtatactatgtatattagaagtataggaatagattctctttctcttttctttccacctagcttagattatttattatgaggataagtagaaaagcttggtgtcactctacccttggattatcataacccctgcttagaatatgattatcacaagtaatatataaattattagttgagttctctctacatgatctttccacgtgataaaataaatacgatacccttggaatactctcgggtgaaatgctataatggtatattcgtgtgcttgcggatgaactctgtaaccataatataccagaagtatttctgcgccattgctgggaattatatttctagtaacgtcgttaagaaataccaacagtgacttgatctcacttgagcatcaacattattttcatttcttggtatctatttctttcattcaactcaataaaactgttagtcccaatgatctggtagtcaacctccacttgttgaccaaccgatcgcatataaaatgatatgaataaattgatgaaaatcaacaacaccacaaatgtcatatactcacacatatacacaaatgtaaagatctcaattaaataaaattgattaacttggatcacacacatgcataataaaatataagatatacttcccccaaaatatatgcatacaaaatatttcgagtgaaataggtgtatgcataatttttgatgaatccatgggagtttatcctatacaagaaaagaaagcatgtgtaaagagagtatagcttgatttcgatgtgtttcatccttattgagattaaagtcaaccatcaatggatacatttctatcccaactcatatgacatccgagaacaacctatttgccaactcatggaaaaaagtaagtcacagtaacctggtttgtcataaatcaccagaacaacatttacacattattgaccatagatcttttgatcatttccgttttggtgttggatgacaatccaatataaaatatgatcatttcctttttggtgatggatgacaatccaatataaaatatttagagttcctcaccctatttgggaaccattagagagataatttagaacacgaggaatttaacacgtacctctcatcatttttatttttcatattaattgagactatgcaaaataaatgtttatatataaaagataatagtatcatataattggatttggcattagtcaccaaaactaatccaattgcacttgaacttacatcgtcgtcgtctgagttaccacgcccgagccgccacggtggtcgagcaactgggggaggcgcttcaccagcactggtatggacttggtggtgatgatgaaggagactcaccagcgctggatccctgtggcggtgtggtcgacgtcgtcgtcaccctccccttcatcatcgccgccgagtcctccacttgctgaggctcaccaaagctgcctgctactgccagatcttgcggtcccgaggcctaccaccgtcaactctgatggtaccgaggctagcccaccaccgtcgttaggatctttcgctggtagatccaccatcctgagctacggggagctgcagtcgttgccggtcatcaccattgcctttacttgcttcctttcaatgtggagagagagagagagagagagagagttcatgaggtagtagtacggtaggcctgtttcaaaataggaagaggagaggaaggagaggcccgccaacacgatgactggctgctgtcgttcgggaggagagtgctggggggagggggggtggtgtcggtgacggagatggggatggagggaggggaaaaggagaagtgaggcaagggaggggctggccaggtttttcttttatttaagttggggttagctagaccggcctaaaagtcatctagaactactcctaatgtgtggaaccattacggataggagatacatctgtaacggctcctacaggagctattacagatgaggtgcaaccatttctaatggctcataatggaaagccattacaatcatgaggggctcgtttgtaacggctcctcaacttaaactgttacaaagttggtagatgacatatgtaacaactccatataactggagtcgttatagatcagtgctaatccctaatggcttgaatgtcactcgttatagacacgtgatatgtagcggcgcacttaagcccatcatagataatagatgtgaggatatgtggtagtgacaattaccgagtgtttttcactatttaattaccatgtgtttcgggcacaagggagagattcccttcttagtgtctgtagttttgatagagatcacgattactgtgtaaaataccatatcatagatggattttacgaaccatagtaattttacattccctgtggaggtaccataagctaccaaaaatttagggtaaaatttggtacctcctagtacctagataccaaaaggtaccaaattacaatagaaaaagtggtacctcctcaagtactataaaattgctcgcaagaatatatatactactctctccgtcctaaaatatatgcatttttagcataatgacaagtcaaacatttttaactttgactattaatagaaaaaaaataaaaaaagatcaaccatgtaaaattgatgttactagatttcttattaaacaaaatatcgtaatatgcaactcttcttatttgaaatattttacttttatagatattgttggtcaaaatagtatctcgaagatcgtgttagtcataaatgcttatattttagaacggatggagtaattcttttgatttatagatgtgagattttgacggaaatagcaaatccaccttttccagagatgatatattgtactaaacacatgcgtacgtggctagctgttattattatatattcataatatatgccagatatgtgcaagcacactttatggagctcgcgtggtatgttcctgtacaatgagatccaaggtcgaactaaagcaggtatgcaatttctagggctaattaagcaagcaaagcatatgatgaaaagatgatcaatatatcgtgtggcggatatatgcttaccatcgatgccattaccctgtagacaagctacttgaagtagaatgtttgccaggggccaattaggcacatatatgcgcacgatgtcactttggcctttcccgcttttggcatctggttcactgccccccggtgggtggctgcctataaatgcggggtgtaccatatacatgcaaccatgcagaaacgaagcggtcgcacgttcttgtgactgcacaacacaccaacacctcgatccctgtcaattctctctagcagcgcgcacggccaaaattcatgggcacgaacggcgcccagggctcaaaaggtgcgtcgtcgaccaccactaacccgacaaacgatgacaagaagaagaagccggctcaggcgcccggcgccgatgccgatgccgatggcggtggcaagaagaacaacagcgactacgtcgacaagacgctgtcgacgacggccaacctggtgaagctcctccccacgggcaccacgctggcgttccaggcgctggcgccgtccttcaccaaccacggcaggtgcctggccatcaaccgctacatctccggcggcctcatcgccttctgctgcgcgatctgcgcgctgctttccttcaccgacagcatcatcgacaggaagggccggccgtactacgggctagccttccccgccgacgaagacaccggcaagggcggcttcgtccccttcaactacgagaagccgcgccgtcccagcaacggcgccgccaccgccgccgccgacgacgacgatagctgggaagtttacttcgtggatttcgacccagaggacactggtggagaaaccctttgtagtcccggttcgtaaccccctttagtcccggtttccaaaccgggagtaccaatccgggactaaagatcgctatctttagtcccgggtgaaataactgggactaaagatcgagctgaccttttttttttttgcatggatattggtactcccggttaaaccatgcatatatatgtttcaatacatatatatgcatacatatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtttaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgttgatcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttttggatattggtcgagcattgcgacgtttactttccgagggtcgatgaatccagtatcgaaaaccctccgccgtcgggccctttgaatctccattctacaacgataaaagggagtatattattttctatagtctacttatatacaatgacctaattagttaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggcccctgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccatcgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttcttgtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggatgtccatcttcttccacttccgttatgatgtgccgaccctcaagcttgttcgctacacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcaaagtaacatatatatatatatatatatatatatatatatatatatatatatatatatatatattgcatttcacgttaacgttcgtcctcgttcgttcgctcgttcacgttcgttccctcgttctcgcttgtcttcgttcgatcgttctcgttctcgctctcgttcgttcgatcgttctcgttctcgttcacattctcgcggcaacgtacgttgacgtgttcgttctcgctctcgttcgttcgatcgttctcgttctcgttcgttaacggcggtgtggcggcatcggggcggcggttggcgcggcggcgtggcggcggcgtggcgacggcggcggcggcgtggcgttgcggggccgtggcggcggcagcgtggcgtggcggcggcggcattgcgcgcgcggcggcgaaggcggcggcggcgtggcgacggcggcggcggcgtggcgttggcatccggcggcggcgttgcgcggcggcgaaggcggcggcgtggcgcgtcgtcgtcgtggcgcgtcatcgtcgtggcgcggcgtctcgtggcgggcggcgcgacggagagagatcgagatcggagagatcgagatgcatgaagggagatctggcggcggcggctctcaccccagagatgcggcggcagcggaggaggcggcgaggacgacgagctcgagacgacggcgagatacggcggcgtcggcgcggggatttgccctaggcagtggcggcgaaggagagaggccgagagagatcgatcggccgaaaacgtctaagtgttggtgaagaagacgagggcgcaccgagaatatatatacccccggatctttactcccggttgttgagaacaaccgggactaaagatatctttagt

SEQ ID NO: 41461 - DNA, 4937 bp, Oryza sativa
agattaatgacaattacttcgaaaaattatttttgtctgtaataaatgaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattacatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatgttaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttcaaaattgtaagtatcacatataactagcatatacatgatttaaacttgttgaaacctctaataatcgtgcgtaattaacatatgccatacatcaattgatttatatggataatcaatacatccaaaatagtttaatcgtgtacacaataattacggcacgtactttctcctcactattgttccctccttgtgagcgctgcgtgagtaaggggtgtcttcatttgataggaagatgctagggtcaatcgtcaccgtgaaagggggttgcccatccaactgatcgtaatcctcgtcagtcttgtcctcaactctgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatgcgaccgtaatatgtggcagttgttccatcgtgtcccatggcatcgacacgaacagcgctgttttggttcgtgctcttcatgtcttgggctctcggtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtagaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcgtctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatctggatcgatgaccttctgcgaaattgcgttcatgaatgcacatagctttgttattgttgcccggacattgtctggaaggataccccttattacaactagtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctttatatgctggcttccaggcccctttccgaacactactttaagatctttaaccatagcaaacactgttttcccgctgcgatgtttaggtttcgtacggtggtcggccttatgttcgaagtgcttgcctttcttccgtaccgggtggtttgctgcaagaaatcgacgatgccccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccacgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccatttttgcctttcattgcaacaactccagagtggtatccaactttttgtgcccctgctcgcaacctgggtacaatgaagttctgtggtcctccaacatcttgtccaatttatgcgcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcatcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggatcgcctgtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatatatatataggggtgggactttagtcccggttggtagcaccaaccggggctaaagatcaccgggatctttagccccggttggtgctaccaaccgggactaaagtcccacccctatatatatatatgtcttcttcctcctccagctgcccgagcaagcttcaaaatttcttcaaaaaagaggggaggtcatgccaaaatttctattgaatttattttggtgattacatacaaatcagaggtgcctaaaaggtttgcaacttcatcctccaatgttttttttttgtcatactacatttgcacctatgttttgcacacttt

SEQ ID NO: 41462 - DNA, 16185 bp, Oryza sativa
ggcgacgaggaagacgaccgccgatggcggcgccggcacggacccccctccccccacggccgccgccgccgtttcctccgcaccacacggtcgccaccgctccctccctccacaggccggcgtcgccgctcctccctccgcgagccagcgccacgcggatcccctccctccctccacaagccaccgccgccgccgcaacacctcgcggtcgccgccgccagcactcagagagagagagagatggaatacggggagagacgtagatatggatagggtttggtcgagggtattttggtcattacaaaaattaattgtatttctttcttttttaaaaaatgaaaacttaacagtgttaaaaaacagggccaaacggagtgttcgttttaaaaatgtagggtcaaataagcaaactagaaaaagtagggtcatattggtagttacacttcaaaacagggtcaaataagcaattgtcccatactaaataccatattaacacagccttaacttttgtattcattcaaacggttgtatctatctattgatacattaataaatatattcgtcaaatgaattttttttcagtcgtatagagtatcatgaatatacttctgaaatgattgtaacaaaagttttgatggatagacttaagaggtgattcattacctaatgcatatgtaaaaagccaaactgcctttctaataaataatgtatcatggaggcctgttctcgaataaacacgatcactattacccaacgcccaaaaaatgttaaactctcaacaaaaccgtccaagaagagctgcaatgttttacaagctgatctagaaatcatcccaacacatcgaaaaactgtaatttgtacaagcagattgaggagtgagcaatcgagtaaacgagctaaccatgggcaatgagatcgacacctccgtcttggccttcttggcctcgaggctccagatgcactactcgaaaggtaggccatcacctcatcgtgaggcggcggagatggcatggacgccgggagatccaagctggccagcggcgggggatcccccccatctacgtgcgcctcctcctagtcctgcctcccctgcattgcgtgcactcggacaccgcagcgctgttgagttatgatccaaattcatttgcacttaataaagaccagcttctgccgaagtaaagcggaggcccgtcgccggaggcttgggccacccattgggttctgcggtacggattgtaatacctgttagggtttcacctcatatatatacctcttgtaagccgctgtgcggtgttgtaccctcaccccgatacagtgaagatattttgctggctggcgctagtggtttttttctttcctactttgagaggcttttttcacgttaaatcttgtgtcttctacgattaatctactattctttgtcgtttgtttgcccatcgttttctaacgagcgctgcctctgacttgccactgccgtgttgagcccagtgctgccaagcgccggccaccgcctacatgtgccttcctttccacggacaggctcggcggctcccacgacctgaatggaaggaaggagagggaatttgggatgaagaaggaagaatagagagagagtggaggaagtatgacaggtgggtctttcttttctttgatgcttgggatgccatgtccgattagattggacttaaataggactcaatgtggacttattccaagcagtagcggtagtagtgcaggccttgggccttggcccatgcagcagcaaatagcctagctaggtactcccaatagagcagcaagagctagcaaacagatcggcagcagcagctaaagtttagtcctatttggagagaatgtcaccaacttagaaaactagaaaagagatggatgctgaggatttaacactggttcgaacgatgacgaaaatacggtgttacattgtgggtgtgatctagcaattttaggaaccggtaaaccttagattccacaaataaagaaaaagtcgactcgaaacatgggatgaatcgaccaatgctttgagcaaccccatcaccccaaaacccatcggcatccaagaaaaaaaaatcgcaaaaaataagcatcagctctaatcgagccaatgctttgagcaccccatcaccccaagatccagcagcatccacaaaatcaacatccaagaacaagatcatagaatcaggatcaagaagaaaattgatattcacacatgaaccacaaaaatccatgaacgataaaatccaagaacatggagaggaggacgtcgtagggaaggccaccgtagccaccgcccgccacccaccgtgggtgaagtcgagcttgtggaagccaacggcccatggcgagatggaggccaagggagggaggtaaggcgaagggcatggatgttgaagaggacgtcgagcgagccctgagctcgtggcggctgcatctggccacccctgagtcaccttgtgtggagattatgggtaccgcatacccacacggcatggttatccgactagttatagaggatagcttatatctatggaatatgtaatagatcatgacttgggtattacgtttccttttatattatggagcggcctaaagtcctcatttgataatattgtaaagtagatttaggaaaccgataccgtattggttaaggtttctatcttgtaatcctgcccccatcctatataaggtgggcaggaggccctctagggggcatgagcacatatgatcgtcagatctatactacacccggtggattcaaatccccaaacaggagtagggtattacctctcattgagagggcttgaacctgtctaaatcctttgtctccgcatccatccacttttaggtcccgtgtgctacccccttttattattgccgaattcatgtttcgacaccttgtgagggaagggcaccaccgattgcttggggctcatcaccatggagcaaccggagctcaatgttgatgggccaaccaccccccgcctccccgagctcatgacaacaagatttagccacctccgaagcacgtggatgtcggatctgattgcccctgagccagccgcctgcatggaattatgtttgtcccattttagtttttttttttttgctgaggtcgagtacatggaggttggaggccatggtgttggtggaggcgtttgcttgtggtggttgtgctgtccctattctacaaggatgtttgatcgaattcgggctccagggttataagcagacgacgaagacagtttgtttcaacagatatggagcgaccttgctcaacaagaagcggcgcggctaagggatggatgggtgtggaggggaggcggcaatttggggagggggaggtggggatggggaagagctgacaccaacaccctcgtcactgatgcgctcgctaacggtgtgcaactacgtgttgctacaggcggtggtggttgaggaccggagcccgatgacaaggagctggtgcaatccaagcacccatcacacttgcacccgcaccacctccatgttactgccattggcctgtacacctactcatcctcacactttcctttgccatctacttggtgttgttcctactccatctctctccctaatcggttgatttaggggcgtcagtcagactctggtgagatgttcggcaagcttgcgagatggggattccactagccaggatctagcagcctcaaatcaaatttcttgtcacctcttccttaacgtccttcatcgatccaacaagacaactctttcacgaccatctgagtaccgttgccactatggttatctggattttggattcatctttctatttgtttcttaatagctgcaaccatacatgatttgccatttgggtagagcatggaccacttgtgcaactctagttgacaggattgcattctaagctctttagattcaatggtgaactccgctgaaatcctttgccgagtctgataacgcttatatacaccaaaatctatggctcagcaagaaacctctgctttgagccgtttccgtggagatagccaaaagagattgccagcctgtcaagtggtacacacgttgaatgcggtccaaggatgtcaagtagtatgcatgttgaatgagatccaaggacgtagttgtcgtggcaatgccgtagctccaaatcgacctgctactctactattgtttggtttcattaggaatagattgcttccttagttcagtaaactgagccctccataaagttgcatggttcaatactttcaactaataagtacgacgatgtgttgtgtgtgtgttgggggggggggagggggggtgttaatgtaacctgccccctcaatctgtcatgtgtaataaaaatgttactccctacattctaaaatataggctcaatcacttttaacacaaagaccaattcaaaatttaccttgatgcatataagcaatgtgatcggagggggaaggggttaatggtgtaggatttaaagtgccagtaatatatgcatgcatgcacgtattatattatgagacacgataaaaagtatccgtgacttatatttttgagatggaatgagtatgagttctgaaaataattttaaaaaaataatacagtggcccagccaaatttcccttgacacgcacctaaattaggcgcacccagttatcacaccaaatctgtcagttgagagttaggacctctctggcaagtagacgtggcctaagtgactaaaaggcaatgtatttcttattaattgtctctcatgttcatgtacatgaagggtttagggaaagatagttaaatcatggagggttttttttggttaatgtgcatatacgtagggatatctgaaatttactaaaagaaaatatttcacgtgtacgatatacattatcgttaacttcaatgatcatcatcgagctgcttttcacgagtttgcactttgcatgacaaggcaccacatgttttgtcacagtcgtcacatgtctcatctctgcaaccaacttctctttagctcgaaaataaatcaatctcgtacgaaatatgacacatcattatttaaataaatcaatctcatatgagatgtgagacacatgctaatagacatatctaaattaatagtattaagatgtatcacatacaatatgagtttaatatattttgaaacgcaggagtacccataaatatgtatgcgtacaaacatggagcagcagtctctcgtgctgccaagtgacaagtgcaacaataatcgttcacatagggaaaacaaaaaagaaaggtagaagccccactctccttgtacgtacgacagcatgatcggcggcgccgccaggccaccgacaccgccggcggtcgtcgacaagacgatgtgcgccgcgtgcgacatcctgaagctcctaccgacaggcaccgtgctggccttccacgagctggcgccgtccttcaccaaccacggcggcgcgtgcggcgcggccagccggtacaccaccgcggcgctcatcgccgcctgcaccgcgtcctgcgtgctgctctccttcaccgacagcctcgtcagccatgtcgacggccgccgcctctactacggcgtggccaccctccggggattccgcccgttcaacttcgaggggacgcgcgaggagatggaggagaggttcggcgacctcccggggatgaaggtcagggcgctggacttcgtgcacgcgcacgtctcggcggtcgtgttcgtcgtcgtcgcgctcggcaacgccgacgtgcagggctgcctcttccccgacgccggcactggcttcacggagatgttcaggaacctgccaatgggattagggttgctggccagcatggtgttcatgatcttccctactaccaggaagagcatcggctacacggacatgatgccgcacaaggaagactacgggaaaggaggtaataatattcctggccagaccacgccgtcggtgtgatgaagtaaacataacatgatactccatttatactttataggaaggtataaatgactgtacagtgtaaatccgtagtggtgtgtagaagttggtatatatattggacatatatccaagcatggaactgtagaatgtactcatgtggggctttaagccctctttctttatatctaaactagcatatatgtggtgtaaaaaaatcatcggaaattacatatatctcgcgcgttgcagcggaatttgtaggtaattgtcaaggaaaacatatttggataagttacctacataagattagacagagtaatgaaaattgtggattttatttattaccatgcttgattgttcgtacatacatacatacatacatactatggactggagcaaacctcaacatacatacatacatacatacatacatacatacatacatacatacatacatatacacggtgcagtgcacgtacggcaaacgacagcggcgcacaggagacgatgcgccgtgcacgagacattggtgctgtgccgagtccttcacgtcacggcgttgcctcacataggcattgtgcgcggcatggcgcacgactgcacgagagaagcagggcagcagatcggcggctagcgttaggggcgaaagggattaagtcggagcgagtggcggctcggctcgatggcttttgccagtccagttcggtcggtttaggccaaagcaaagccgcctggagaaggggaggaagacgggtttgcctcatggccgagctgggtcggcttggtaggcttgatgggctaggccaggggaaatggaaaaagagaagaaaagagctgagcgactcaagttagactttttagaaaaaaaacaagaggattagggtttgggtctagatgagttgggctaggcccgcaagggacaacattagactttagcttacaagtttgaaaaattgattatcaaaatactttagtttacaaaggttttaaaaaaatacttattagtttcttttatttgtaaataaggattaatcctttaaaaggattttttaaaaaatatttgattttatttgtaaaagaattcattaaagggatattaattaataaaagggttttcaggaaagtaattagtatttgcctttaggtgaaaatattttcttgatattaattcataatcatggttgtttaataaatattattttaactccacaattgaatttagaatttgcatttaatttcttatttaatttattttggcagcatgaggtaattttgaaaatccaataaataccagcataagggaattttcaaaaaaaaatatttgtccaaattttggtttccacattttaaattcgaaattttcgggatgtttcatgctaatatctagtacaactctaaatcctaaactataaccgactacgtatatgtatctgacacaaatctaacagaaacattgctcatattcttgttcacataccaagcccttgtatttcccattagctttatgtgttgggcgtgcgctctccttgtcatgtttaacagagcagcttgaaactatttttttttcaggtagtggatatcaatccggcctatacatccctcaaggatgtaaattactagctcaatatcctttgtattataaccctttagcttgtcaatgaattgccgtttcgattgggggtagttcatactcgttagagaccaaactgtgggtttgttgttcatccggaacttttgctgaactgttgcaggcaatgaggatgccctgctccaatgccttcaacagcgcttcatcgctagttctatgtgttgaacacgtaataataaattttcatattgcaattcacgataaatgtatcttactccatctgaagagttccacgagctgcagattcagatagtggaattgttcttgataagatccctgcaaccagcatatatgcatttcaaaatggtcctgtctatgcagcataggtcaccaagtgtcccttagctcttcactcgctcaaaggacactagctctagccacgtagctgatatatgaaaagagaacagggtaaaagtcgtaatatacacaaactaaaataggacatatatatatatattcccttttctagtgtttgactatttttagatgctttgctgtacaaataactttttaggtcaattcttatagcgcattcttttccagaaatttggtgtaattcgcatttgtcattggctccgatgaacagcaactcaacaagctattgaacagttgacgttcaaccttacaatgataattatttcattgatgcgatatggaatgagaagtatacgatggcatgtaagaatctggtaaaaagaatataacagcaatatatgttattcttgttgagagattgatactactagagaggggccatgatatcacaagaggcttaaactgtacaagcatggcatcttttctaaacatgcagaagttatttttttaatcttaaagagaatataacttaaatggaaggtacgagagaaaaatatgtttttcttgctaatttaccagctgccagaccagtttttatgaatgaaagacataccaacaaaataaaattttgttttactttgttttgctttggaacttttaacagtctcttcggctgatcactgttgctgtcataatttcaaatgcaaattcttgaaaagttgttgtcatttttgctacagtacaagctcagctatctgttgctcttgttttctcttcactagctgaatgccgtgctttgctacggatgataaaaaagtatattagaatattgtctaaaataaattaacatgtgttttctcttaattgtgttaacaattcctttgctatagggaactctgaccctaatttgattttatatgtgggcatcatttagatttgtttgtttttctaataataagaagttcaagagcaaatttataaaattgacaatggaaatagatagggtgacagattcactaccagcaccattaatttcttttaaaggagtatagatgttctatgtgctcgtcttaacaaaccttactttttttacatgattacatcatttaatttgaattgaaattatgagtgcagtttaaagtgaatcaataaattaaattaacttcccaaaaagtaaattaataaatattattaactgaactttgaacatgcattgttcaaagttaccttcatctctatatatgaacatccattctacaaagtttgtcatcacttcatcttgagtatgccactaattgaagaatgttgtttctaaccgacgatctatagatgcttacatgctttgtaggagcgatttgaccaaagttaggaatacttttccattaaagattcccagaatttctctgggatacaatcgatctgccaattgcagcagccagccccccctcttgcctgtaagtatcacacccatgtgtagcattgttcctttcttttcactagcaagttacaagctgccacatagcagatctcttgatacccactttgcctggaatccctaccctctttcagatgctccttatccatacaaaatgctgactttctggccagtactgaaagaacaagagagaaagaaaaactcatattacaataggcgacttcggaacgcggcatcgcatacctctaacctctccatatctgatgaggtgtgaggaccttgctttttgtgagattctaattctagacatacgggataagagttcctgttgagaggccattgctgttcatgagagcctctgaatggaatcaaagcttctctcaacgttgacttggctgacgatgatatgattccttggggatgaccacaacacatacatttggtggctctggcctaatgtcagtgttgctgatcaattggtaatgttgtaaaccaagagggtgatgttgtctgaatttgaataaattgattttcagttgaacggtgaatccgggatgacaggagacaatatttgctgaatttccaagcacaggtatagattatccagagtgctgaatttccacagttcagtttcttaataaaacactttgcatacttccattggatactggacagcaaaagcaactatacaataggacaaagaaaaaaaaattcagaatgaattgatctgtacttagatcttagtaggaaagaaaaaacaactcatattctgatgttggcgttgatttgcattcctcatacctgtgacctgtgcattttacatcatcaagtttgttattctcacgcaaaggtctaagccgtacaatcttacgcagacattatccataccacacctaatggctgaaaggcaaaattctctttctcctcaaaatttttctccctaagcatggtacttcctagttcctatgccttgagaccttgaccctggtaattttgttgggatttgagagattatatatcagcaagcgctgctctcttgagtaataaagaaataatttgcattagttagtcagtccatgctatttataacagaacatttttcatatcattctcgttcttattcataaaggtgaaaaactagtaaaagcagatttatcagcaaattctagcaagttgctttgttctgattccttcacagttatttgatattttccttggattttctacagaattccatagtattttatatctaagactacaggcttgttcagattggtaccattttaaaccataccattatttagtaaaattgacaatcatgttgttgcatttagtttcttaccaaatattggtaatgtctatgaaattttggcaatattgtattaagactatcctatcaaaatttggcaacgttgcaatttaccaaaattttgacaataccaaattttggaaagattcattttggcattaatctgaacaccaccaccagcgtctctctctctctctctctctctcttctgacttagctttgtcaaatatgatagaatggaactactaaaagtaagaggagggtcaaggccttatcaacacctcccaaggaccatctcggcatcagtttgctgcatcaccattgtcatccatatattccatattccacactaaatccatcgatccgtggaccgtggtgtcgcgaggagcaagcttgcttggccatacattatccgaaccttcgtcttttccccgatcgaattgccgcaaaatctcatgtcgtgcacgcacattttccatggctatataagcaggcaggaggctcctcacctatgcacagctcaaagcaaagcaaagcacaacacaatcaaagcctcatacaagaagctagctagctagtactcaagctaaatacctagctagcagtagcaggcgaccagctgcatttttccagaggaaaaatctctcagtttagcttaattaattagctcttgggagaagaaggcaagaagaaaatggacagggtgaacaggctggcggcgcagcgggcggtggtgatcttcagcatgagctcgtgctgcatgtgccacaccgtgacgcgcctcttctgcgagctcggggtgaacccgacggtggtggagctggacgaggacccgagggggaaggagatggagaaggcgctggcgaggctcctcggccgcagccccgccgtgccggcggtgttcatcggcgggaggctcgtcggctccaccgacaaggtcatgtcgctgcacctcagcggcaaccttgtcccgctgcttcgcaatgcgggtgccctctgggtgtagcaccaacgacgcaactatacctaccagcgactggttcttgatttggactgataccgtggcgcagaataattttatacgggtactttggtttgtatcaggcaggtcaggtatatctaagggaaaataaatagtacgtgcaggccttttttgcactgcaatactagtaaatctatagagagtggggaattaagtgtgtcatgtcagccgcctgtaaggctcttttgagatgtaataatgacacatatccgtttaatggagtatacctcttttgtcgatcgttggtcttttcgtctgtgtgattttttaaaaagctatctaatccagggttttcactttcggtttgcatcgaaatttagggttttcactttcggtttgcatcgaaattctgaagttttggtgcaactgaaatttccaaaaattttgggaaattttcaactttttgtccgaaattatttgaaaattttaccaatttttgactgaatttgaatacattttgatcaaattcacaaaagtttgaaaaaaaattagggtgcaaattttgcttgccggaaggggggggggggcaaaattactaaaatttcaaaaaacttaaaccgaaattgaaatccctgatctactctagcacaaacacatatatgcttaattaggaaaaccatctccaaactggtaggacgattggttaattagggacttggggtatacctcttgggatgtggatcaagaacctataacacagcgtcttcaaactcgcattagttcactctacacgctgagtggacccacattcacataatcacatagcaactcgcttatattttcgtttttgtttcgtgtaaaatggttaatctagtgatattgtgtttggagtgaattggatatttaagcagtctcaaacctatgaagactctccatataggactattatcactaaatgaacacttggaccttacaggtctaaaccgaaataagaacactcatgagctgaaacagactaaacgggttggagtattatagaacaatatattttttggacagtggtttgggacaagaggagattgaaataggctaggtgtgttgcagcatggaggctagagagctcgagcaatggttgcacgagaagaaacgcactcagaaatctagggccacgtttgttagctgggctagatgattggcccattaacaataactcgaaagttttcatctgctaccgtcacaaccatccatcgcacaatcgtcccttcccaccacatcaccagtacatcgctgcaccaggtaacaccatggatgatatcctataccaagtagcgacccgtcgattcctgagactcccttccccctgtcaaaattcagcggcactattctgaaggccgtaaacacggaataattttgaacaagcaaaaaaaaaggcgaggaatgtgatctcctggtcaaaaacgattatctcctggtcaaaaaagattatccaagtctaccaagcttgtgaacgtaagttaaaatccgtcccacgtaattggtactttattttatgccgattgacatcttgcttcgtgtttgtagagaatataccagcaattccaagctaagtctgaaaccctagaaagacttatcttgatactttggagtcggccaggaaagaatttaggccccttttaaaacaaaggaaaaacataggaattccaaaggacttataccatgtggaaaataatcctatgagaccctttgaaataaaggattgatttctaccaattccattgacattcctatggaatggactattgtaggaaattttagaggaaaattagcatgaggtcttacctcatgttttcttcttcccgggtcttgaattcttatgtttttcatgtgtaactatgaaatggtagttttgaaactttcttgtgttttcaaatctcataggaatccaatgaacatgacattctattcctacattttttctattcccatgttttgacaatcctgtatttcaaatgggcccttaaagaagttaaagaagccgccaaagctagagagcatcagctgaggaatgagatcggccagcttcaggatataaacttggaataccgtggattagtcaaaggtaagcaagcaatctcaaaaacttccagcttcaggatataaacttggaataccatggattagtcaaaggtaagcaagcaatctcaaaaacttctagcaaaccctgtctcctgaagttaaataggtccaaaagacaaaacggttatctactaaaaaccaaagggagtagtatttagactgctttgagtcaggcttgggctaacaaaacactacctaataggtaagccgttggcgaagtcacaaggccctctacttttcattataaaaccgataaaccagaaaaagatggattgttttgcgaaagaatctttggacccataaaaagcagaatttgtgcttgtggaaattctcgagcaagcggagctgaaaacgaagacgaaagattttgccaaaaatgcggagtagaatttattgattctcggatacgaagatatcaaatgggatacatcaaactcgcatgtcccgtgactcatgtgagtcattttttgactcaaagcagtctaaatactactccctttggtttttagtagataaccgttttttcttttggaccaagaaaaaggacttcattaaatcacatgggacaaattacagtcgttttcaatcaaccaagaaacagaattggactcaaacccagttcagaagcctgagtaatcgtcccttctagctttgtttgctaattcatggctaatcaaattttgttcccgctggatcttcgtaatggaagtcgtcctttctcctgatcaaagccatcttgcttctctgactagaaacgccagggttgagcagtcctcctccttatcagtgagtagatgcacaactgagatgtagtctgtttcaattgcaaccggcagcagtgtccattgcagtgctaaccgaaggccctccacacaggcggcaagtttagtctctaacgctgaagagcagtttgcaagtgacttgcacatcgtaaagagggtttcaccattgtagtcccgaagaattgcaccgatcccagcactaccatcggactcaaggaaggagccattgatgttcagttttgcccatcctgagggatgtcgtttccagcattctttttgttagtgatatgctctagaggcaatcatagagattattgtatcacatactatgtttacatatttttccgactttgttccttgaagtagataacttattattggttaatgaatatgtgattctttcatgagactctttatgttgtttgttactatttttaaaggatcctgatcaaataacatatgtggaacaaataagtttaaatgatcagcacatgtattaattgatgattatatctcatggatcatggtacagagatatcaaattaataatgtgaatacatgttggggaacatgttgttggatagacccaacatgagacactgtaagagccatatgtgttgtatcatcagtgatctcatttagtgttggtgttgaatcctaattagacctgagattatcatgattcccaacatgtgtagtagcttacttagggactgctaaacgctactccgtaattgagtagttataaaagtagtttacgggtatgctgtgaaacatgcagtaggatatgaataatcaagatgagatttgcccctcctatggagagatatctctgggcccctcgatgttatagattatggaagtgcatggccatgccaaaggtgattgaggagtcaatcacaggttatataatctatcacaggttcgagcgaatgattgagctattaaaggatggcacatatctagccttgagcttaatcgatatcgtgaggcgaaggggttcaaacaagtatacactagaggttcagccgatatgatctttatgtatgtccggtgggtcaatacgttctgctagggaccgctgttgacacgtggaccgaaaaggagttttcgggttatagctgagtgtacatgaacctacagggtcacacgcttaatgggccgaaataaggggattggatggagatccaatataagcttaattcggatagggatccgaataggagtcctacaggccttggaggcccgagttatggatcctatatattcgtgaggggtgtaatcggcggaggtattgcatcacgtgagaaaccctagccgtcactcccctccccgggcaaaaccttagccgcgcgcgggtgctagcacatctgcgcgtgtcgttccgtccctgtacgtgtggataccggtagaggcgccactgctttgcggtgctgatgggcgtgggagtacggcgaggagaacgcacgaggaggataatgacgagctggtgcgatcgactacttcctctgtatcgacgcgcgctactttgcgagagttccttcgacttcttagcgccttcttccgctacacagcgcgtcgagtggtaacgatctatgatctaatacttgcatggttcctagtttacgtgatagaa

SEQ ID NO: 41463 - DNA, 3687 bp, Oryza sativa
ttgctattaaccgttcatcttttgtttctaagcatgtgtttggtttgggaatgagtttgattcatccttcttttttggatgggatagtcctagttttcaaaagatggcacacatgttagggagataaaaaaatagattggatttgtccatcaattttcaagagaccaccctagatgaggagaatatttccttttagagatcatccacctcacatattcccaaaccaaacactagaaaatgggtccgacccaacacgaccaattccatcccttaactaaacgcttgctaagggaagcatgagtggaaccttgagaaccccgctgtattgctcgggtcatgttgcatcacatatttcacattaaatagcactgtagctctgcttgcattcaggaaaaagacatgcatttattatagggccttatttgtgaaataagggatctaataacactttattgggggtcacggcttaatcaacattttatgccaaaaaaaaaagtaccgcaaacttgcaaaattacaagcacaaatagtacttaacaaagtagctcaacttgtacaataaaccacgatgtggggcgaagcaatgcaccattatcattagtgcttccagcatatctacgacatcatacacaataaatattacagcagagatggccatcttactgctttgtgacttgagagtagggcacggttggatcgctaactcatagtatccctccatttatctagattctagacaacatattgaaaatcaacaaaactatatgatatgcagaaaagtaacaaataaggcatcacctagtataagattacaacatttaggagaaccttgcgaagtcccagcagcaaatctttgtcctggcggactctgctgagtttttgacagaccaaccattgcctgaaaactcaaagcagccagtggtgttgtaccacaagacgacttttatcattttcccattcgtaaatgcagcaccgcagggcacagaagtcaggctccggcaagtatccgtccaccagcagaaaacccatcaagccaagtatctgtacacatttgggttgtctttatccctctccaagtaatcccttgtgataagatcctcaattcgcttctttattgccttgaagtcaggctgcaacggaaaagagaaaaaaacttgtgatggtgaagacatcaaaggagtttcgagcaaacaagtgctttacacatttcccggatgtcagattcattatatttaataattatagtatatttcagaataaggaaacaccaacaagacggtggtccaagtctaactgaacaaaacggtgctagcccatcaaggcaatcaacaaactctacatcaacaaagtacaattaatgagttgtaccaagaatttcgtaggaacaccatgaccttaaaagaacataatggattgagcccagcacttacataaatggagtgtgtttaaaatgctttcactaacaagtgcaagaactttcttgaagaaataactcgtaccttaaacatgcgtccaagctgctccacacattccatcacaagttgctgatgacccaatactttgcgactcttcataatacgcacaattgatgcatcaattgcgtatctgcgatccttatcaacatcttcaactactttcttcttctcatcaactggaggaagaggtatctaaaaacagcacaaacacaaagataatacattgaaccagagaaatcagaaaagtacaagcataattgattatgcaacatcagaagttcacgctttcatattataccactgaatatgggttcactttattgccgtcagaagatctcactgctgattttctttaccactctatacatattccttagtactccctccatccaaaattataaggcctatatttttttacatggtcttcaatgacatactttgaccattaatttataccatgttatgtttccaacaaatatgaatctagtgatataacatgcataatatgtagcatatatatgattagtatgattattagtaaaaaaaaattaccaagtttgattttccttaaaaagaggacgtcctataatttgggacggagggagtttttttttttcatttttctttaactttatccagaactgaggacgcaaaacccatcatccttagcatgcacccatattggctagcggccgcttactggcacctgccaatgatgcctttgccagcactgccacattctacatcttacattgccatagtttccattctcttttgttggtgtgcagcttgcttgtgtacaatttaatggctgagcatatggagactaattcaagcctgtgttggcttcttggttgggtagccaaccttgctgtctgatcggatgaggccacatgatcaaagataacaacaggtggtctcagcatcattgaattggttaaaagatgcaacggtgtgaccttggtaataaaatgaacccaaaaatttgaggggtataaaactaaaaatacaaacttccgaagctacataaccaatgttgccagaagtaaattatcaaacctataaaacaaataaattgaagatacctttaatcttcgcagcttgtcagtaaactttgagttgaactcgaagacatcatttggtgaaatagatctattatttggttctttgctaagaatcttgtattttgcacaagatagagaatggagcaatcgaacaacatcatcatctgagagatttaactgtgtcacaatctcagaatagctgagtctatcaactccattaaacagcagcagcaatgcagcctaccaacaaaagtgaaaggcatttcagaagtcataatacaagagggaagtggataatgtgatttcgaactacctgataagttgtaacaatgagctcaatagttttggcctcaaatttagcattaatattacaggttcccagtgaataaatccaggtaagtttcctgtgttttgttcttgtttggtaaaactccttgaaaacctctacacatttcacctaaaaataaaaaaataaaacaatcactgtgtgtagagcagaatgccaaccacaaattttatgcaaaataaggcaaactccggccttttaaaagcctcaaggcaaacttaccatttctgcaggtagatttatatcaaaagatttgtaacttggccaaaatcctgttgtgaggacagtaacagctaaggctattccaggattcaactctgagtgtgtgcttatgaactcttcaaatttagcctggtgatctcttgccacagtgagatcagtaaccatgccctccattttggaagtgaactgccctccacattgttgctttagcttggtaaggatgcttctctcatgttcatcattagcactcttgtcaaaaagcaatctccttgcaagcttctttctgcaaatttagccccagaggttaacaactgcatgaatccatgcgcaagaatttaaagacaaaaagaataagcatgcaagataataacagcttacctatagaactcagcaaacaagtccttgtcactaatgtaggcaagtaaccttacaacctggtaatcacccattcaagattaggacttactaatgacactaatagatcaaacataacaaattgatggttgtaccttctcaaggtatcttcaattgcttcatcactaagcttttcactaccgcctttctttaagatattgtcaca

SEQ ID NO: 41464 - DNA, 16408 bp, Oryza sativa
ctaattgattaaatatcctaaccaattgataccaccccaagtacacaataagatgaatgtactaagacaacattaatacaaacaaaagttaatatatagactgtgcaccttcttattactagcagcatcttcggcttgcttcactaaggcagtgccctcattagtaacatgctacacagaagcaacattccattacatcatcaaaatagatttaagaaataaaccactctcttctgaaaaacaaaatacctgcttaaatatttgagaaacaggttctaaaccacgagttattctggaaaagagcctgtacattctagagagatcatcaacctggagtaaaacagaagatgctatgttagcagacttcatttgttcctgataaactgttgagagacgtggagcttctccaagaaaccttgtcatcacgaagcaatgcatggcatccagaatgctccttctccaggagctgacttgcgtattgagttagcaactcatgttgcactttctgtgaaaatcatgtcataccggagaaagtgaattatacataatgctctatcaggaaaaaaatatattctgatttctgaacatacaattataaattgtatatggacatgtggtgtgtatgcacttagcaaacgtagattaaatatcaaaaagtatgctctaaaatgtggactgtggagtagaagcaacagcagacaattcactaacctccaacaacttctgttcactactggagtgcaaataatgagcaactcgctctttctcccttttcagacactcctctgcctatgaaacaaacaaccattagaaaaaatatatattatgcttacctacagatagggatgttcatgaaacattcttgagaatacctttaacatgtaatctggacaagagtcctcaagaatccaggtctgggcttttatagagtaatagtctgcagtatctttgagcaagaaatcttcaaaatcattttcgtagtagtccatgctagtcaagccaatctcaacaaatatatccagaacattctttaacagggccctatcaatttgttcaccctcacgttcttgatctatctgttcgagaaagtatgtctatcaccagccatacacaataaaaaaagatagcatcacaagatacaatgactcaccaaggatatcaccgcactttttacttttcctttgatctcttgatatacctgttacaataaataaaactgattaaattctagatatagtcatcaagcaaagaaatgcaagttgtattgcataaaaaacgagaatcatgagtaatcaagcaagtagtgttaccagatcccggaaacagctaagcccaacttcacttagttgtggtagggacctccttgaaataaagtaccgatcaagataatggaagaagcgtgatagccaccgaaccatcactttatggtttgaccaccgttttactagctctctcagcataaactcatcatgtttctctcttaatgaaggtaagacctacaaaatattgaaaccaaataaaggacttatcttccaaaagaagtgaacaatacaaaagaagatctgagataggcaacatgcaaatgatgaagagtaattaaacttcattgaatttgtagtgcatgataattagctagaactactaatgaactatatcataatggaagaggatcctctaactttgagttattgacaagtgggaccgctgagtagagggcgcacatgtcagtgaccacgttagagagaagtaagtcagaggatctcaatcctatcataataggatggaaaaagtctgttttcatctctcaacacttcacacgttttaatttcatccctcaactataaaaccatataaaagctgcccatcaactctcaaaaccaaacaaaacttatcccactgccctatcctatagtgattttgactcagcaggtggggccccactatctatttgggaaatggactggagaatggtgaatcttacacaatcagccatgacactctatgacaaatgggccccactatctatttgggtccaaactatcaccaaacatggtggaggggcaacttttacccggttttcagaattgtgggagtgggacatatttaaccctgttttgcaattgaggtacaaaactaaactgagtcaaaaattgagggacgagaaatagactttctccaaataggaagggaaacaggacagggagcaactaagctcaggacttcatatacagatcctcaatatggcggggaaccagggtcccgaccatagaatcgtatgcattgcaatatctagttatagaaaatgttgtatcaattatatgatcaaccatatatttgagatatacttaacttatcaacaacaaatagcaattagcatatttacatatttaatacaagtcgctgcacactaaatagcaatgaacacatacatcctagaaacatatgcatatctatatgccaggatgatactataaaggtcctgttgatgcaaagggaaaaggaaaccgatatttcaaatggaatggatgtagtatggacagatttcagcagcagcaactgttccagcatcactaaatcaagtaatcgatgcttagcaagcaagttatgacctcgaaaaacttacaccttgaaaaacaaagttaacatattagacaatagacgcggcacaattcagaacattgaaaagcattttttctggtgaattacatgaggacttgaggagcactttgctcagcattaaaatgatccaatgcaaaatgagtgagggagagtgtaatagatatgcatatggtcattatgtaaattctctcagatatgaaagatgtgacattaaaccataaacagttcaaatcacaatatcttcgaagtgtttatgacacatcatgcaatcaacaggtaacaaaatcaaagattagctttgaacaaaaatgaataaactgcattttgcaccaagtaaagcacggtaagcaccgtatttcactttgcatgaggtgtggcacacatttcgcaccagattacatcatcgaactaatatatatcccaagaaatgccataagccctaaatgaaactttgtcaaacatggtcaagattcatcaagtttcataaggcttcactcaaatttcatgaggttttcctccgatttcatgatgcaacctggtgcaaggtacatttactaaagaaattgatccttttgtggataataatttattgggaaagaagtaaaggtcaatacaagggactgagggaggataaagaaacaacagtaatatgcatccaggcatctagcattctacccacagtggttgctcaattgatcctacaatcacaattcatagttgaaaggaacatatgccttgcaaattcagtatttctcaaaacttctcatgtcgatttggcgcccaaacagaaagtgattacacaataaagtgtggttgcacagtacatgctgccatgatgaaaagggacaaaatcatgaaagaacaatcatttcaacataaagggattccaattcagaaaacaaaactcaatatgatgctattttgttgaacctttgaagctttcagtaaagcagggcatgagccttttcggtaaaaatgatgctagtctgctctgggtaacaacaaatccaaatgtgctgaagaaaatcatcccaaattgaataatcaatgctctctaagtaaatcgcgaagtttatataaatgcacaggcagtgaattggagtacttctgtagtgatgatgttagtagcctacttccagtaagatcaaatccaaatgcactgaataaaatcatgctaaattgagcaactcatgctctccaagcaaatcaaaaaaaattgtatagtggacacaggcagtacaaactaaagtacttttagcagacagcatctaagagcacagtgaccaaataataagcaaaacgcagtaagctatattcaaaaaaacatgaagtaatactgcagtacttagtgcggtcctccttagttaagaaagtacaattatctacctatcagaagaagccaacaaaaaatatctcgattgctccaaagtatcgacaatgatcaaaattagagcagcatctttcggcatcgaatctatcttctctatgtaaacagctataaactctcaatgcgtgtgctattagtccattggtacatacgacatgattggcataatttcaacgctatccctaacccatctgcgttagaaaattcaacacaggagcgcattaatcgagctagtcaatgaagggaggaacccaacagccgctcaccatggacgtgatgtactcctcgaaggactcgcggtacttctcgtagagctgctgcgagtagtcgtgcggcggcttctgcgtgcacatgttgtaaatcgtcctggagcacggagacgaaccctaaatcagatcagcgcgcggggaagaaaaaaatcgaataaatcgggagagaaatcgaggagggcgggcacacgcacgtgtagagcatcatgtagtcctcggagctgaactggggttcgggcttcccctcgaggatgttcttcagcttggtgatgcccttctgcatgaactcccacccctgctccagatcgatcgtcttccgctcgtgggtcgccatcgcggccggcgccgccgccgaatcgggggaagggcggcgcgagacccaccccgccgaggatccgccggggagccctagcttggggggggctcttcgctgtcgtgtacgtggggggaggggaacgaggtcggtgggttccctcccgccgcacgcgaggtggacggaggcgaagaggggaggaggaggggggatgacgaaatgggaaaagtggaggggcctttttcttttctttttcctttttttttttgctcccttttcgctgatagggtggggcgcggccgcgcggggtggaagttttgctgttggggcggtcgtgtgatcgtgtctcgtgtgggaaacacgccggggtaaaggaaccaggtcttttatatctgtaataattgattattctgaaattcaataattggtaaattagtggtgctattctatgaaaactggcccatttgtaaattggtaaaaaaattattattctcggaatatctgaaaagtttctttcgcatttacttaaaagttttaatcacctatctactctactcctctctaggcattaattgaccctttcagatataataatgtgagatgttgttataaataaagattttaattgaaataaatacaaggaataagtctacttcaccccccaagtattgaggttggtctacataacccccagaagtacgaaaccgggtattctgcccctctaaagtatcaaaaccagtttaaataacccctagagtggttttatatgtggttttgttgtgcacacgatggcatgtcaatggttctggccttgtaacatgctaagcattttattcacaagtgaaaacaggctgagaatgatgtaaattagtgttaatatatactccattcaacccataatatgaggcgcacaagcatttcaagattcaacttctataatatttgaccaataattagtataatatgaattaaattttatttgttgggaatattatcattggattggcatttgaatttacgttcatatgattataattttgttgctataataaaccttatagtatatgagaaattataagccaatcgtaccaattttgatcattttttatattataggataaagggagtaatatattttaggcttgccgatcaatgagtgaaaagcaatagttagatcaacttaggtttactagactaatctttgtgtcatgcaagccaataccgctgccacataatcatttacatggcaaaactaccaacaaaactactctagggggttatttgaaccggttttcatacttcaaggggtagaatattctgtttcgtactttaggggggttaagcataccaaccccaaggggtgaagcagacttattcctaaatacaatgatgtaatcggatcttaaaaattatactctctttaaaagagcggaataactatatatcattcgacagaaatttggggatgaaatcttacatattttggaccattggatctgtgccaagatttatgcatcgacttcttttcctccaattccagtggactccccttcttccccggcgccagcgacacccgcaacttcagcagggagcatatcggttagggtttggagttaagggagggggaagaaggggtttctcggggcttaagagggaaggatgtggggcggtgggtggtgcacatggacaggcggccaagcgccggaaccgcgggattgacagcgggcggagggccggcgttggcggcgggggaaaacggattgcaaccttgggaaagagatggggggagggagaggaggccaactagggggagccttgcgggcgccgttgaccccttccggctagccagcaaggctaggcggcggggtagcggcgcggcgactgcacaggacgtggaggagcgctcacgctcacgcatgcgtgaaagcggtggtggcggtggatggattgagaagtggaggaaaagtatgtttgttatgttgcaagatttggggaggttttttctgtcaaaagacacctagacagtccctatagtatttgattggaaaaaatagagtgtgcactagttaaggaagaattatgcgtatccactattcagattttgcctacatgaatttgcgtgtgatgttggtaatggaccacagcccacaagcccttttataattcaactcagtgtttttcctttggaataagttcacattaactcccttaacaagtgacagaatctgattcgtatccctcaatcacaattctatatctcgatcccttaactattaaaaccggtgcaatttgactccctcgacggtttcactgatatggcgcacacgtggcaatgttgacctagtctccttcccacgtggtattgacgtggtgtttatatggcattaaaattaaaaaaatatatttggaacccatttatcattcacacaaaaaaaattgtggaacccacaaaaatgtggggcccacatgtcatcctatctctcctgcccttcttcctcctctctctcccttatttctctctctttctctcccctttacttcactcaatctgctggaggcaggcgggggatcgagtgccgccgccggcggcggcgggcggtggacggtagccggcgggtgggcgggtgttggagcagcgacgcaggcaggcgggcgagggccacagcggcggtggcgggcgggagggcgggcgctggagtagcgacgatggcaggctggcgagggccaaacaactctccatggccacccgctgccgcaccgctgcaaccaccggtgtggacctcgacatccgtgctgttcgatgccgccgccgctccaggtccaggggtgcctatcgccgccgttggtcgaccgcctcgcccttccgttccccttggattcacttgccgcggcggcgccatatcaaaggtagaagaggaggcgacgcggctagagaaacaacgcctggacaccatgcttcgctgcctggatcctctccttgccaccaccgagtgaagtaaaggggagagagataagggagagaggaggaggaagaagggcaggagaaagaggatgacatgtgggccctacattttgtgggtcccacaattttttttgcgtgaatgacgaatgggtcccgcatatttttttaatcttattgccacattaatgccacgtcaatgccacgtaggacgaatactaggtcaacaccgccacgtgtgggccacgtcagctaaaacgccctccaaaaccgccaagggagtcaaattgcaccgtttttaatagttgaggtgtcaagatatctggcattatggttgagggatacgaatctgattattcggtcacttgttaagggagtcaaagcgaacttattccttttcctttcctttgttttatacttttgggtaaagtttattttatgtccctcaactatggtggagattcattcgcggccttcagccataaaaccaactacaaaatttcctcttactatcaaaactattgcaaatcgagtcccacgatggtttcatctgatctggcgtccacgtggtatgttaacttggttttcgtcatatgtggatgcttatgtggcagtagaagaaaaactttaaaaacttaatgagatccatatgttagtcagaaaaaaaataatatatacttcacacatgcatgcataaaagcgaatacaataagatgatatagctggctataaaagtttgcacatcagatttgtgcttaagtggagtagagagaagaaaagcgagatatatggtataataattaagttgtgtgagagaaagagatgggccatactttaatagtgttgtatatatctataactaactattgtatgtatggctatttaattagcattagattatgtgttatttttatagctagcagttggctatactattaaccttgaaagaaataacaatctagggtaacattgacaaatgcgacgatgtgtgttaatcttggcactcaaaatggtgcgaaaaaatacatatatatgcacatctagctgaggttaccggattcctatttatatgtgataaaaaaaccttatcttctaactactggtctcctcaaccttgtgccgttgtgcgcataccacgtatatattatctgtaacactcgccgtcaatccaaactatcaatgttgagattgctcttgaactcttcaaacgggcgcatagccagtggtttggtgaatccatctgctatttgatccttggaagaaatatatcctatctcaaataattttctagaaactcttctcgaacaaagtgataatacaagcatgaaacacatgatttgctgatagatacttaactccaatgttatcacaccacatgattcgcgaccttaggtgcatctataccaatttcacataacagagtcggcaaccacataatcttagctgtttcatcagctaacgccttgtattctgctgcagtgcttgacctggacacagttgcttgcttctttgcactccatgacactttagagcctagaaagatagcaaaacctctagttgaacgcctgtcatccaagcatcatgcccaagtccgcatcagaaaaaccattgaccaacaaagaattgacaaaccttgttaactgagaaagaaatacctggtcttgtcaaatttaagtactggagtgctccaacaatacttcagtattgcatcttttggcccaaatagattcatgagttgacaattttatcgcatctaagcaagggagtacttactggtttgcaatcgtgcattcctattcgttgttaaatatcatatgcacacttggcttgaatcaacattatttcatcatttaccttcacctctatactaagaacgtagtgcaagtctccaagtccttcaaggcaaactccttgtaagattctgcaacattaattttttttgaggtgaaagcggcaagagtattgccgaatatattagagagaggagagttttacataacgttcaaaagagcaatattacaggcataaagtgagcgcctcgggctattaagcatataggtaggtataagactaggacgacaagctaaatcagggcagttggaaaacgaaaacgctttcttgtatgtcttcattgatctgttgggcagctcgacttgaattcggttcctgatgtttgaagatttttgcattcctttgcagccatatgtgctaccgtgtcttgattaggatttcgactcggtgtcgtgattctattctactggttccctgtgctaaatccatcatccagtgtgccaaggaggtttggtttattgtcccctgtatgccctgtgttgccgctacaagttccaagttcttctagtgaaatcacattccctgaagaggtgttcagtgtcttcaaaagcgcttctacacagagggcaaatccaatcgcattcccaatgtcggattagaaggttttcagctgttagggctcttttgtgtagcaccagccatccaaaacaatctttgctttggtagtgcctgtgctttccagtttgctctgagaatggggtcttgttggcaagttatgaattggaacttgtaagaacttttgtgctaagtagatacctgtgctggttctcttccagattatagaatcttcattctgtattgatagttgaatgtttgatagaagattgccaagttgcaccagctcgtgtatggcttccccattgtcaatctgtctaagcgaaaacacccagtggttatcgtcaagttcggttgctagattcttgttttttcctgttgccaactgaaagaggtttggggcaatttctttggggcacattccttggagccaattatccttctagaaaagaattttttgcccatttccaatgacaatttgggtgcaggcttggaagagttgcaaatcttttgcattgcatggtaattccatgtcattccatggtctgttacaatcatgccatcttatccataaccatctcacttgaagggctgatgaaaatctttccaagtcaaggattcccaaccctcctagttccctcggcatgcagacgatctgccagtttacaaggcttttttccggctttacattctctgcaacattaatgaagttgcacttgctgtagatctagccactattatattgccaacataaataagcacaaaaattgtgatgtctcctttagtataaaagaataaggatgtatctgctccttgatggtttaaacccaagctcatgaaattttatacttaactaggctcgtggtgcttgtttcaagccatacagagccttgtctaacttacatatataagttttgagttaacaccaagcacttatacaaactcaaaaccacaactctctcgcatacacacacacgaaaatcatggatttggggagaaaccactgagtgtccgtctcgcacaggaacatggtagaacgactcatcttggatgcttcttgactcacccacacatttgcatcgaacccgttagctcgatcggacggctacacaattgctagtagatcggacaaccatggaaggcgtcattgcttaataaagaacgagaacgctctctgttaagatttcacaatttaatatggttataattgtaatctcacatatccttctccttattttctgttgtattccgtctaaggcatagttcatattcttattgcccacattgcaacttatcaggaatggctttggtatgattctgtaaaaaaaaaaaaggcaggccgtggatttcctccaaactcaatcgaagcagacgaacgatccaaactgcctccgcacattccagaaacagaagggccccacacgacccccgtttcctcccctatttatttccgccgtctcccccgcgagatcgattgatcgaatcgaagaaaccccaaaccccaccaaaaccctcgccccacgcctccttcgtccacaagcctcgcgcgcggcggcggtggcggcggcggcggcgtaggcgtgatgaatatgtcgccgcgcattccggtggtggacctcgaggacgggtggcgcgacgtgctcgccggcgtcgccaagctcaagtgcatcctcgatggctccaacgtcgtgcacttcgtccccgacgagtacatgcacctctacacgtacgttccccaatctgctcgctcgtcttctccgcttgggttctctcggattcgcgggggtttttttgttcgttcgttgttggttccaatctgatttgatctgatctggtacggctgatccgtggcaggacggtttacaacatgtgcacgcagaagccgccgaacgactactcgcaggtgctctacgatcgctacaagcaggccctggacgatcacatcgaatccgtcgtacgtgtgctgctcttaatctcccatcctttttgttttgggtgttttttctgcgacccggctgctcgatttcgccgctgcacgtttaggttcttagtgcgatgatgaattattgccgaagggggttttcggtttattctgatttatcagcgattttttgggcgaatttcgcaccaattaggggttgccgctggtccgtacagtttaacatgttgcacttgtaacccgtgatttggaccctcggttgaggacttgaggcattatgtggacgattcttatttcttaactgtctgttattgtttttaaactttttttatcgatccattgttattccgcttttttttttattgttgcttagttgtgcccgtgcgcaggggctgatcagtccctcctgcacccacaagacccatggatatccttaggaacacccccttcaattttttcaccataaattcaattttttcaccataaatgataaactaaaggtccctaaatggctggaggttaaagaaactgtgtaattaagcccccccaaatttttgttcctggatccgcccctgcccgtgcgatgcaaccaaaaaaaccccgatagtgaaaatctcttcatagtgcgtaaatggctgacggaaatcatggaaagtaaaattgaacgtgatcttgtaatggaaacataataggacttgtgtttgtgcagcctttgaaaaagccaagacgtttcaacgtagtagcaattacatagacggctgatggcattttgacgcttatttaatttggttcatttttttttctgctcctgtgttgcaacctgcatgttattggtgtcctcctgtgtatttcctgaatgagttcttggagatggatatgtatgccttatttatgataattgtttgcagtgaagcatgttaattagattgattctgtactttcagtgcgaggcacatttgttgggatcgatgattgcatcttaagaatgatagtatgagatcgttaatgtgcctttttcctaatttatatctttgagcttgaaggtgttgccctccttgaatgagaagcatggcgtgttccttctgagggaaatagtgcagaggtgggagaaacacaagctaatggtaaggtggctgaggaggttctttgactacctcgatcgttactatgttacacggaggtcccttgattcactcaaagatctgggctggagtagcttccgggatttggtgagcctcagttagttttcagagaatctttagacgagtataacttagaagcactacagttgcttattattactccatgatttgacaaatacctttgatgattcttctgttgtgataggttttcgataagctcaaaagtactgtggcaacaattatgattggcatggtgagcttgccctccgcttcttaatctcgtgcgcattctacagagctaacttgatcactactaatttcttttatttaatagattgatgatgagagggaaggcaatctaatagaccgtccactcctgaagaatgcccttgatatctatgttgaaattggggatagtcaactgaattattacagtgatgattttgaacaatcatttctcaacggaacaacagattactattctaagaaggcacaaacatggattcttgagaattcttgccctgaatacatgctcaaggtatttgtggagttctgaaatttacattgctgctaagtttaacgataccctcttactagttatgtgcttaataggctgaggaatgcttacaaaaagagaaagaccgggttgcaaattacttgcattctactacagaaccaaagctatttgcggtttgtctcagttatatgtttgatgtttcttggcagcttttcaatgatgcatgtaaaacatgcaatgactttctgtgcttctgaaattgtacccttcaacctaaatgctttcaggctgcactcttcgagttgatagataggcgtgcagaagaaattctgaacaaggagaactccggatgcaaagtgttgctttgtgatgaaaaggttgcattacactgaaaaaaaaaactctggtttgtgaagttgcaaaatgaggaaatcgctggcaatcaatttactgactattttttgctttctgactgtagaccgaggatctagcaaggatgtttaggctcttctctaggataactgacgggctgcttccagtatcgaaaatatttaaggaggtattgaattgtctcattatgctccacatgctgcactgctgaaatattccaatctccttgaaatgttacttctgtgcagcatgtcattgctgagggtatgtctctgctgaaacatgcaacagatgctgccaacagcagaaaggtgatgattctatgtctttgctctgttccttggcccagtggatttgctctgttccttcatattgtgctttgcaagtttccacatccttgggatgacattcttaatttatatttcatttgtttgtcaaatcagtctcctgtgggtgcataatggcatctaacatcttaattgtgctgactagcctgcaattctataatagcaagagaataagggcatgtttggtatagctccaactcctaaatttaactctagaaattgagtatggagtggagttgtggagctgcctaaacccaactccatctctttagtttattttgtgagagtactcctgcgagctctactctctttctgagtggagctgaaaccgtttggttgagctccagctctaggaaaggtggagctggagttggagctgtgccaaacataccctaattattgctaaatagatacatgcaatagataataatgtgttctaattattcttgaatctgattttcgaatggactatttgttcctagatctcaccctgctgtgaatctttactatgtggtcgatgtagtctgtccaacaaactggttacaataagacccacagaagcacatatggattcgagaaagggatccacgaatattgggtagcccgtagccgttgttaaaccaggtcgagtactttatgaaaagggcggagtatctgaaactgtaaggaagcttattacaactgacagctttacaagtcaattgctattagaaggatttactagttaactggttttcatgctttctactgcaatatttttttcgtgttatttttttcagaagtgaatgcatcgcaaacgttggaattgtattgtgtacaacttgtgctaatcagattacttatattattgtattctgcacgtatacaggatgagaagaagggggtggtggtgggattgccggagcaggtctgaattagacatacatttgcttttaactaaggttgtactactgcttttttagtcttaatgggttaccaccgattttaggattttgtgaggagtgtcatagagctccatgacaaatatatggcatatgtcaccaactgtttccagagcaactcagtatttcacaaggtttgctacttgccaagttaccgaccctaattttgtcttgcagcatttggttgctcaaaccttgtataatgctgattgacctactttatttacttgtctcaggcacttaaggaggcctttgaagttatttgcaacaaagatgttgttggttgcagtagtgctgaactgtttgcggcatactgtgatagtatcttaaaaagaggtggaagtgaaaagctaagtgatgaagctatagatgaaagtcttgagaaggtatatagttattgcaatactgtttgtacaaactagttacgaaatctcttgttcaacagtgtatttaatttgtatcaggttgtcaagcttctaacatatctcagcgacaaggacctctttgtagagtttcataggttcgtggttctctattttcttgatgacaattttattatgttcccaaagtaaataggaaactcacattttggaagcctttgttttttctggaataatctattacaggaagaaacttggaaggagattgctgtttgataagaatacaaatgacgaacatgagagaatcctactctccaagctgaagcaattcttcgggggacagtttacatcaaaaatggaggggatgctcaaagatattacattggcaaaagaacatcagtcaagttttgaggagtacgtaagcaacaatccagagtcaaatcctctgatagacttgaatgtgactgtcttgacaacaggatactggccaacatacaagaactcagatataaatcttccattggagatggtacgtctatggatttcctgtttaatttgcactaaatttttgatgaactatcacagattaactttataaccgtccgattcacagttgtttgagacattctcattttcctatttgagtttgtcttgtaactcatcaatggccacgaaatgcgacctgaatattgcagtgctaagccataatgccatctattgttctggaactccatgttttcaggttaaatgcgtggaggttttcaaggaatattatcggtccgacaagcaacacagaaag

SEQ ID NO: 41465 - DNA, 11746 bp, Oryza sativa
  unsure (1)..(11746): unsure at all n locations
gatattgtgtcacaattaaaactgtgtgatgatgatgccgtgcgtttgcttcattcgctttcttgtgcaaagtataagattctcaacaaagagcctagcaacagagtgatttctccagaggacgagtttgagttcaattccaaattaccgataggatgcgaaggattaaggtgccatttctaactatttacccattcccccctggtttttcgagctaactaaacgtaattttttttttgtgtgcaggtaccacttcctcaaatcgatgagaagaaaaaggttgtcgatgatgtcaacaaggacaggaggttcgcaattgatgcatctcttgtgcgcatcatgaaaagccgcaaagttctgggccatcagcaacttgtagcggaatgcgtggagcagctcagccgcatgtttaaggtacacggcagaacacatacatgtcgattctgctaacctactttttgaacattctgccaatttgtgtaaagctttcagtcatctgtggtgagaagggagagaaaatccatgttttcttaagacttgtgttgtcagatattgacaatggggatttgttctcactcttgtgcagcctgacatcaagatcatcaagaggaggatcgaggatcttatcagcagggagtacttggagcgtgattcggagaatgcccagacctacaaatacttggcttgatgattggtcctgaggcgacttgctgactgtttgtctgtttactcaccctctggattcctagggcagtgccctgatgttgccaccagtagtctctgtttacttacatccacgcatcagggttgtacactcttttcctgctcaagtgaatgattagaggaaaaacagattaggagaagcagctatggctcggctgtgactgtgaaccacatttacatgtttagctttgacgccctttgctctaccttttgagtttctataatttttgttgattactttcttcttgccgatcattgtgttaaatcgcaactcatcatggagaaagaactttattgcagagtcactggcactttacctgcctagtgcctagcattagcatatgtggtttattaagctcgttattattaaatctaaatacatgtcgatgacacgccctgcattaattgttctgcaggcctaataaacgacctagtactgtataaaataaaataaaaaatgttgggggtaataagcagtttatatctaaactagacgtagtagatcatgccgacttcgataaggctgatgtgcgggatgttgagcacgaggccggggcctctgcaattcttgcggaggaaagcgtaggcgacgttgacggcgaacttcttgaacaccgacgagctcttcctcgccttgatgtacgagtggcccatgatgtaggcgacgccggcgtgcttggcctccaccagcgcgctcagctcctccttcaccctggggtccgtgtgctggttcgccacctcgaaccgcacgcgccgccggctcgcgaaccccggcgactccgcctcgtgcatcgtgtgcatcgagtggatgagcgactccggcttggcggccgcggcggcgcgcgccaccacgctctcctcctcgccgggctcccgcatgaggagccccgtcctggcaaggtcgctgggccgcgggaccacggccatgcggccctccacctccacggaggcgacgaccccatcgtcgctgatgctgcagcgctggtcgaagtcggcctccatctgcacgaactcggcgatccgcagcacgaggtcgttctcgaagtcggtgtcctcggcgagcacgtccttgtagccgtgccgaacgacgcagcggtacatgcggaactcccgcgggccgatgcggccgacgaggtggcgctcctcgtcgcggacgtgcggcaccggcacggccttgacgcagatgaagacgagcacctggtggaacgccggcaggttggtgacgaagtgcgagaagatggccggcacgccggtggccagctcggagtagatgatgccgatccccgggacgcgcacgatgcccaggctggggccgagcgcgtggatccacctgagcgacaccttgttctgcacgtcgaactggtgcttccgccgcgtgccgtagtgccacacgtacatgacggcgacgaacaccagcgacagcaccagcggcagccacccgccctggggcaccttcatcagcgccgccgacaggtacaccgcctcgacgacgccgaacgccaccaggaagagcgccgccaccaggcagctgtactgccagacgaagacgatgacgagcgccatgagcagcgtggtgaccagcatcacccccgcgcacgccatcccgtaggcgttgccgatgagggtggtgtcgcggagccccatggtgacggcgatgcacagcagcatcaggatccagttgatctccgggctgtagatctgcccgtggatccgccgcgacgtgtgcacgatcttcacgcgcgggaagcagcccagcgccgtgcactgccgcacgatggagaaggtcgccgatatcaccgcctggctgcccacgatcgccgccagcgtcgcgatcaccagcaccggccagaagatgcccgctgcaaaatgcgacatttcattcggatcgatgtcgtcgtatcacgattcatgtcacctcaccaccagtgattagcagtagattagaggagtactccacttacttggaatggactcgaagaatacgaagtggatgtcgcagtggggtgatttggacaggaaggccgcctgccccatgtactgcagcaccaagcacgggtagatgagccccacgaacgcaacctgtcaacaagtgtacgtacgtacgtgtcaaacaaatgtcaagatatttaacctgctcttaaaatcaatctgcattatattaaacgagacgcagtactgcactatcagtgctctgacagcaagcataaacagacacatatacccttatggatgcagctgtgaagtggccaagatccgcatacatggcttcggtccctgcacatacatacatatatatattattataaaatatgtagttgatgagtcgcagtgcagcgagcaaaataaggtttgtttgcctgtcatggagaggagaattcccccgagggagatccagccgtccttgccggtgtgctggaagaacctgacgaggtagtaaggggagagggcgcgcagcaccctggggttccacaccacgatgttgtagacgccgagcgccccgaggaggaggagccagacgatgaccaccggcgcgaacaggaacgccaccctgtgcgtgccccagtgctgcaccatgaacaggcacaccagcaccgtgcacgacaggatctccacctccccgctcgtcagcgcggtcgagtgcacttgcagcccagagaaggacgacagcactgcccagccagcagccaggacaaaagatcgatcatcgatcacatcagcaacccaaaccacacaccaagtagtagtagtattacggtacgcgcgctcaccggacatgggcggcgtgaggacgccgtcgccgatgacgagggaggcgccgaagaggacggtgacgaggaggaaggtgcgggacttgcggtggttctcgaggaaccgacggagcgcggtgaggatgggggtcttccttggggggccgtcagntcctgngnngtgccccgtgactaacgcctaatgggccctgggggtggccccccaaaaaagagggggggcgccctcgggggggggcgcccctttttctggggggggggccccaaaaaaacggggggggtccccccccttaacttccgtaaccgataaccgggagacccggaaggcctnccctttccttcccttggggggggggggctcccaccaggccacttttcttttctttccccggcaccgtttttttttccgcactttttttggggggggggggggggacctatttggaagngccntgnanacanttggcgtggcgccacccatgcagcgagtagagcgcgaacgtgccgccctcgccgttgtcgtcggcggcgagcacgatgaagacgtacttgaggagcgggatgagggtcagcgtccagaacactagggagaagacgccgaacacgatctcctcgtcctggaaccgccggagcgacccgatgatgaaggtgctcttgtacacgtacagcggcgacgtgctcaggtcgccgtacaccacgccgcagctctggtacgccagcagcagcacatgcctgtagtagctcctccagtgaccctgtacccgtaattaattctactgattatttattattttatcagattattactttcattcttcgtattatggccctgtttagttcccaaaaactttttcctaaaaacatcgcattgaatcttttgacacatacatggagaattaagtatagataaatcaaaaaactaattgcacagttagagggaaatcgcgagacgaatcttttgagtctaattagtccatgattagccataaatgctacagtaacccacatgtgctaatgacggattaattaggctcaaaagattcgtctcgcggtttccaggtgagttatgaaattagttttttttattcgtgtccgaaaaccccttccgacatccggtcaaacgtctgatgtgacacccaaaaattttcttttcgcgaactaaacaggcccaatatatggagaaatacgtgcttatttaatttagggaagattgcaaaaatcaccctaaatatatcatcctaagttcgagatttcttcatgtaaaacgacttgttacaaattccatgtcttaactcaccttgtttcgatatatattcctcccaattaccattgtttgcgcgttttttctcctcgtgtcttacttggtttagtgtattttttgatggacatgacccaaccacatcttttgcacaatgtaagggcatgtttggttcaatactaaacttaaccataccaaatacttggcattactcaaaaactgtcatccatttgttttatatccaaataatttgtcatgccaaattatttggtttttggcatacttcataggtagcaaataaaacacataccaaaacattagcatccctttgtggtaacaaaccaaattcaaagcctagccaaaaacatttggtaacaatccaagcactttgcagaaaaataaataaataaaaaaaatgaggcaatgatcaaatcttgccatgccaaataaattggcaaggccaacaatggccaagaaccaaacatgtcctaagtttttttttttaatctggttcggctgaggagagacaaaatcggtaggaaaaaaaagctgtccattttccttccatcattggtcgcactaaagtgatacacattgcaaaattatttaactagcgtcagtattcttcatggattggtaatactgtatactactgatgccctctgtgctcacactgtctgactcggtcacaagctatttttaggacggtgttagtaactagtggtgtaaaataacaatgagctactcctactgcatgccactcttaatgtaaatgttctccttgcatgatccactcttggaaaaaaaaacaaacaaatcactctgttattgtcaaataattcagtcaagaataacattttagttgggatcgttcttcctgattaggtactagtaatatattcttccataagtatggtcagagataagatgcagggtacattaatcaacaccatttcctactacacctcagtaacataaaggaggaaataaagagaaaaggaaaaaaaagggtcagattccgttgatggaccagcaccgatgttggtttaggtaacagaaatgcaaaaaattgcaaacggtaggggtgcacatcatgtccgtatgcttacacaatatcacaaattcatcacaagaggcaaataaataaattatttggaaaatgcgatttcaatgcacgccagagcaaggggaaatgtatagctcaccgggttcccgtttgcggcacctgcaccggtgacatctgccggcgagagaccgctttcgcagtcggccaccggcattttattttattggaagatgaaaggagagggaggaagatggccgggatggagtcaccaattgcggacatgcgcactctctctcactgcgtgcttcttctccgattcgccgtcccctaaatctgttgttttatttgggttaatgagcactcgtcggtattcttggggttatgtggatgagtttgtattcatcgaggcaaatgtagaggggagagagagagagagggggagagcccccggtttataatgaggtgttaacagttgtggccatggagtcatgcaaagatgaagcattagaggagtagtagcgtatagtactctaattttgtagctgtgccgctttttaagatattttactttccttggaaaagtactggtacgtattaaaatttacactaaaaaatttgacaccacgaaataccaaatatctagaggtaccaaatttatattatcatcttcgggtacatttttaagaacagtaaaattactcatagtccatgctgtttgtactttttattcgggattgttattaatacttaatagtgtcaaagaccgttacaagtaataacaatgtgttgaggcgttgagcgaatccatttagtttttaacttaaaaatagcacttcctccgtttatgtaagtttggccaggctttaattttttctaagttaacaattcttataacaccaaatttcattaaatccaacagtcaatatattttgatggaatatttgttcggtgttgttcttttataaacttagtcttaagaagtttgacttaaaaaaagttaaactatattatagagtgcattatttatttagggaaaagtccgaattacacccctcaactattggatgagtatgaattatccccctaaacctaaaaaccagacatctttaacccacaactatcaatatggatgaaaaaccccctaacttgactcagtgcgaatttggatcatacgtggcggtccagtcagcttaaaaaatggtgggacccacctgccagctcttcctcttcttcctcgttgccactgcttaaaaaaagctatgtcgagggtgaggcggtgacaagcgacacgggaggagccagtgaaggaagctggggggcagggctggcgcatctcgccgcaccagtagaggggggcgactgacatcgacaccgggctcagatatgatgattttgatttgggggagtcggtcgagaatttgagagcaatggcggagaaagtgagccaggggagcacggtaggggaatgatggcgtcctccggggtcgccgtcaccatgaccaccgtgcccatgacggaggagcacatcgatgccttcactcaccaggtccgcctctgcttggtccccctcaaggatgtggctgggccaccgctgacgtcgccctggcaccgaggcggaaggcgatgacgaccaccactggggaggagcgcgtggcggtggcggccgtcgaggaggagtgcaactgggggcggtgggactcgagtggcggaggtggaggagctcgagcgacactagctggaggcgatggccggaaagggaatcggcggcgatgtacaggtcggtgatgttcatagggagctccacgcagcaggccggcatgagctttggcggcgagcacgcacaacagcagccgtgcccccccaccgccgttcttggctccccctccgccactccgagctggctccatcgtccccgcctgttgccgctgcttcgaggtgccttccccgtccctgcccgctaccactgtcctcagctccccttccgccactgagctgcctccctcgatgatgcccgccatcgccatccttgactcctcctcggccggttgctcggtgatagagagagggggagtcgagaagagaaagagaaagagaaagagagaggtgaggggaaagagagagaggatgagactaaaaggtgggacctatcgatttaaagaaaaagaattgctgactggattgccacgtaggacaaaaactgctccgagtttgagttagggggtaattcgtccggtattgatagttaagggtgaaagatatctggttttcgggtttagggggggggtaattcgtactcacccaatagttaggggtgtaattcagacttttcccatttatttatcggctccatgttgacaggctaggtttgatcaaatgatgtcaaatcatttcaacgtaccagaacactgcatataaggggcagatgactcggtatggcgagctgtggcgctcgccataccttgatctgctagtgagacccccccggggcgcgtcctccttcctaggacgccgcgccgcaccggcacgatcgagagagggagagtgagaacatggcgcgatcgagagagagagagagagagagagagagagaatgggcctaattagttggcctggttcatcctttatgtgcgaaggcttgacgagttcaaagtttgtcatgatttagcaagcctagcaaaaaagatggctgaacttgagagacacattgtatttccattggtatattgtctcattgagttagtattgcttttactggtggcgactagatcagttgagagggccttctaggtaatgaagattatcaagacggagctacgcaacaagatgtccgatggttggctcaatgacttgatggtgtgctacatcgattcaaaggacttgattttcaaaaaaaatcaaaaaaagtatttcagaaaaagaaaagtaggcaaatgcaattgcctaaatctcctagacctctaagcaattaaataaatgtttggtataccttcacattttattccaatcattgctctttatgttatcaatcttaagtatatagtatactaattaatctttgcaatttgttttgcagtttctatatgtctatctatcctcactagtctctagttcttatatgtgatgcattgctgacagctggaatcttagaggtattatttacaattttggcaaatggatgatgaatgtgaacctatggctagtgcttgttgccatgtttgagattgcgtcatgatcggataatgttgcgtcatataatatagtgcattaagattgtttttttttctttgtgctagtccatgggccacaccggcgacaccgtcacacctaattttttttcccgtcctccaccactgtgcatatataaagataagcagcattattaatttgaaggtgcctctaggaaaaaaacagaacaacaattttctacggcgagtgcccgagcggaacgccacaccacacaaagataagcatgcgagatttaggcacaatgctattcttagtgccacaatgcagcaccgacacctgccaagcctaaccgtgaatcccttcttaactcccgccatggcgctcctctccaactcgaggaggacacgcacgttgccaccacaggctacgcaaaattctctcccttcctcctccaccacctccactccgacgatcctcctcctgatcctgtgccggccggcgatggcgtaccggttgctggagctcacgctggtctccgcgagcgacctcaagaaggtcactctcttctcgcgcatgcatgtctacgccgtcgcctccatctccgggagcaacgtccccatgcccatgcacggcacccacgccgaccgcaacggcggcagcaaccccgcgtggaacaccgtgctccacttccccgtccccgcccgcttcgacacccgcggcctcgccctccacgtccagctccgcgcccggcgctccttcggcggccaccgcgacgtcggggacgtgttcgtgcccctcgacgacctcctcgccggcgcgcacgacggcggcgagccgaggccggctagctaccaggtgcgccgccccatgtccgcccgcgcgcacggcacgctctacttctgctacaggttcaccgacgtcaagcatcccgccctcgaagccatcgaggccgcgaccgcgaccgcgacgagcagcgccaccaaacaagggcagtacgtgcccatgtacgcgcaggactctgatgagaaggcgacggagaagagcgtgtcgtcgccggtcaccgcctacccgccgccgtcgaacgccgtggtagcgcacccgccggtcgtgccgtacggcgcgccgtacggaggagggtacccaccgcatcagcagcagtacggttacgcgggtcagccgccgtacgcgtacaacgccggcccaccgccgccggcgacgtacagctacgcggcggcacaacagccggcggcgaggaaaggtggacgaatgggcatgggcctcggactcgggctcctcggcggcgcggtcggcgggatgatgctcggggaaatggtcggcgacatggaggctgacgccgcctacgacgccgggttcaacgacgcactggaattttaggtcttttgtcgtgttttcctgtgtacatgggcaatgcacctgtataaatttgtcacgtgcataagaaatttcacgatccaacaatgggaaacgcgatgtcaggccacaagggtaagcagatcctaaatcaacgctatatatatatatatatcatccagtacgtacaaccacacatctctactccttaaaaaattcaaattggtgttggtgatagtgaagccaaagcagatataggatctaacatacaaagcagacatgcgatccaacatacaaaccatcgacacgtttggagcgacaaaaataaaagaagacgtacacgcgatccggaacaaaaaaaaaaatcgtaaaaaacagaaacgccccgcaacctgcgccccctcctccgcgcgcctccatcgccgccccgcaccctcccatcgcctctcctccgcgctgcccctccaccagcaggcggcgcggtccatcgccgccccgcgccctcccctcgcctctcctccgcgccgcccctccaccagcagccatctccacaccgcgccggcgcccctctcctctccacccgcgccgccgccgcccctcgcctccccaccgcgcctctacccctagccggagaggcgccgcccctccacctccaccagaagccgtccccacaccgcgccggcgaccctcgcctccccaccgcgcctccacccctagccggagaggcgccgcccctccacctccaccagaagccgtccccacaccgcgccggctaccctcgtctctccacccgtgccgccctcgacctgcgccgcctcctcgccgccgtcgaacgccgacgcccctcgacgccctcgaccgccgctgcctcctcgccgccctcgaccgccgacgccccgcgccgccaggccgcagccacctccgccggtcacgatcgccgtcatctgaaggtatgtatcccctgacgatatggccgcaacatgttccagtaagaagctcaatccgtggtgtgattttgagccagctgttacgattaacctggctctaggacatctgctgataatatttattttctaaatcatctatgtgatgacgtcgaccattcctgtgcacctgtccaactcctgttttctactccttgatttccatgtatatacagcttgagatggtttgattttcttttttgatcaagctatctgaatcgtcttgttctcgaaacatccctataatgtggtttattttttttaccgtgtattaaaccaaatgttaggtgtaggcaatgagctcaagtgttcatttatcatcagttcatgtttcaagctttgtgaatcccttctttcatcacaaatacattaagtaataatttttgcaatcaag

SEQ ID NO: 41466 - DNA, 2018 bp, Oryza sativa
cttggtatatatttgtaattaaactcatattttggaagttttaaatcatgaaaaatgttataatcaagattccaaaccaagcacaaattggtagttaacatttaacaaagggaaaaggaagaacaaaaatagtagaataattttgacgattgttttccctcaaaatttgctctcaaatctatcctaaaccggattaaattgtatttacaaatgtcataaaccaacttggattggaagttccagtctctaattcgaaaattccaatatgataagaaagtccaaattcctcaattctcaagctctctgtttaattaaaatattttggatgaaaggtcctatttttcatcgggaaagtatcatacatttcgtccttatccaaaactccaagctatctcctccaccacacattcccttccttattttttttcttttcctcttactctctatagtctcaaagacactgcattgccaccattgccgggtgtagtggcagagacagaaattaacaaatcatagagttgggtagggctcaactaatgaagttttttttttcaaaaaattacatggtgaattaagagaatttaagcatgattatgaaggcaagcctacggctcaagcccaagcttccctaggcttgcctctacttctgccgggtgttatgagagaggccaaagctattgttgtcggtggctacacgtattgcagtggtaggcggtgttgatggcagtgttggacttggcaaccgatagggaccggatgcggacactgctggtcctagctaaggttgcctgcctcgtgccactactcatctatgtcattccctagacatcacctcctgctgccgcatcagccacttagtagtttcggcggttggagtatgagaagaagacggtagtggttttattttgttagagttttagcgatgttgcagtctattgtttatcttattgcactttattgtatcaaggtgtttcattttgttttgaatcgatgttgcatctactgattcttcgtgttgtagtcagtatgtttaaaatgttgatttagttgaaacactttcgttcaagtgatgaaacattttttcccgattgataaaatatatgaaacatttttcatcgagtaatgcaacatgtgaaacattttgcaacaatatagtgtaacaccttctggtgttttaatgaatattggacgtctgatttgtagcgctctccagagttcagttctggtatgaaacccagtgttttaaatcgccggctaagacatttagcaattggtcttctcaaatagctaatagcgggctaaatggggctagagcatctaaattatacatgagagcaaatagctagatcctcaaacaactatatccagagatagcggaatggctctatgtcggtgtgttgtggtggaggcaaagtagcttgccaggggtggtttcttggttattttggttgtctcgtttatggtttgatcataggaagttggagcttctctttgggcttgacaatgatgagttgtgtttgagcttcaattatgctgccgcaagtgtatagttagttctttgtgtggttttctttgccagttttacccaattacctgtgcatttatgaggtttttgttcctggtttaccctaaaacatgagtcccatcatcttttaaggtttatcctaaaaatgacgactggattgttttggccattggatatgtttgtgtttcctaatcgcttctgcttcagaaaggagatacaaaaagagagtgagaagcatgggctgggctgcgccttgtcaaacttcaccaccccaagcctctcaaagcctagctacgccatctactgcttcataccattgctagctaccactgttgtcgccacacagtgtagccaccaccaccatgggctgcgctaatgcttacctcttctctgctttcttgtctgctcgctgttgctgtttttgctggccaataacagggaaaggggtaaggaagggagagaagaagaaaaggaaaattaggggattttgtgg

SEQ ID NO: 41467 - DNA, 6083 bp, Oryza sativa
tattctcaatttggttatgtaattcaagtgccataggtaaccatgatggcgccatttggttatttattcagaatccttgagtaagcattggtgatcttgcccatttcttgtggtagtttgttatatgaaagagaaaaataatgtttttaggtcattccttatcagtagttgtcatggttacgaataaggcataccctctattctactagtcatggaatatacggatatggcataccttcgtatgtatgataaagctccgtatgcgataaggacatcgacaagagattatggaaataatcctcatgggcaagtgcatgacagagtactactcggaaaggattctgatatatcatatcgtgcagtgtctggggtctctgagttctacttggagaccaagagaattcacaatataaatacataccccctgagggtccaaggcatcgaatcataacaccaataacccgtcaccatagaagtaatccagaagacttgaagcctgctcgccagtagatcttgtcgagaatctcttgacaaggatcttgcttgtaatcttgtaatcagttgttctctattgtactatgtggtttccatatcaatctcataaaaccggattagagctattaccttacaagggatctgaactagtataatccttgtctctttgtttgcttgacgtcaaatcgtgtagatcctcgtatcaacataccccaatactctcatcatccgttctacaggtatcccccgtcgatagtggagtgccaggtaggggaacttggtgcacaaggttctaccgagatgatttcaagcttccccgacgtctgcatcagcactagcttcggcccaggagatccaacccagacgtcgctagtgtggactcaagttggatccatcgtctttccggtctacgctgcaaaaccaatctcgtatgccctagtgtttgtcgagattgagaatggtgcagcaaagaaaacgagaaacgacatcacttcagccgcacctcccgtctcgacagaaaagagggcgccgactacgacaacactcaggaagaagcctcaagcggccaaatctcgttctttttctgcgaaacaggctctgacggactacaaggtggtacaacacatgaaggctaaactcgaagcttgcaaataacgagatattcaacgcgtctcaccaaccagattcacctggtgtagtccaatcaataagtcaagaaaacatgacctttcaaactgcaaggttttccttgacgccactatacctccacacccccagatccaacaacgacaagttcaatctcaacatgttgcagaggaacaaagcgtggaaggatctccagatcgcttcgtgggatccgtcggcattgacccccacaaacccttagttctacatagcatggaggatcaagaatcttcagcatctaatactacacgtgatgtgaacgttatcgaaggagacgctccaagcaatgcaaacccatgtgatccacctcatcgcgaggctacagatcctgtccgtactcatgcataacatctcaccgcaatcgacttgctattgagagagtcctttcgatccggttctgtaccctgaagcagatcactggttggaagaatacgatctacaatatccaacctcaacagtgcctttacagcaacagctggaccagcaactcagggaccctcttgtcttccggcacaaggagaagaggtgcatgccgatgggaacgtcgatgctaccgaaatcctttgcgagcacccgagtcgagattaggccggaacctttggaacgcctcaccaagacgacaaagtcagcagaccctatcgccccgagatgatcgcgaccttcgcgaccacttgaacgggtgtaggcgggaacgataggagcaggatgacgtctgccatcaccagcgacgttctccacatcgacaacgcaataacaacggtaaccgaggaggctgtgacaataacgccaaagccaccatgatgaaaacagcttgtcaaagagaagaaaaagcaacgccatgattttttgcttctgcaacgagcgcctgatgcagagcattgacattgtttggaggttctcagagctggctatcccatttattggaaatgcagacatgctaataacaagctgcaaagctggacaacagcaagcacactatggtatgttcccacttccgaagccgaaatccggtggcatgccggccatcaccttctgcaccgtcggcctggccagcagcgcctcccaccacgccttcacgtgcgggtacgcgtcgaccacgccggcgtactccgtcgccatgaagtagcgcatgttggagaagtggctgaggtccgcgaggctgatgcggtcgccggcgaggtacctggagcccgacagcctcgcctcgtacaccccgagcaccttctccagcttccggacgctctcgtccacgacgccctggtcgcggtcgcggccctcgaacttgttgatgatgcagtgccacaggatgggcctcacggcggcctcgtgctggtgggcttccacgtccagccacacgtccaccattgccgactcctccaggcttccaccttctccgagtcccaggaactctggtttgtacttgcgaaagatgtacctagcgattgctcgcgattctgacaagaaaaatacaaacgattttagtttcttcttttgggcatagtgtgttatatagtatgtgtatccgtgatcttgaataaagaattactgaatctctactattaattgaacagttattcagagaacaacaagtattagttttgattggaataattcagagaagcaaatagaattcaatcgacgaaaacaagaatacaagtcaagcttgcttacgatagagcgtcaggtcgccatcctccagtactggaatctcaccgaacggctgcataattgatatacagaaaacaactttaataagcaggaattgaaatgttcttagcaggagaaattaagtttggaaacaacaactcgtgggcaaaaagcgcatccaaataaccgagtattcatgacaattcggatcctaacgtctattgccaacatatagtctactattgggcaatcgaagtgcaggtattccatgaatcagcctgcactgtaggtcgctctgaccctttggactaatttgcgtaacatgcgaagaagatatagtgcgagaattatgagaggctcacgtacgtttctggcgaggtgctccggccggcggtggtcgccgccggacctgctcatcggaacgacctcgtactcggcgccggcctcctccagggccaccagcacccgcgccatccatggcgataccacccacccgtacactttcatcggcgccattggtccttcttgcagctgaatttgccctgcactttgttggtacatatatagttgctgctcatcggcccattttgttgctaccctgggcgtctattattgtacaatgttgaccgtagtgtgggggatttggtgatataagcgttgtttcttttgtgatttatatattggctgcggaactgtgggtctgtggctgctattgccttgcgtcattgcttacgcgagggccatttgtttgttctttccacgcaggcacgtgcacctctggttctatggaagtgtgaattcaccattcttgagagctacaggggagctacttttttccaaagaaaaaaaatggtatatctcggcatctttttaaggcctataaattttctctcatcagtggtagttgcaaagtttgaatgttatatttacgtgtttctccttacatttttatacattttaactgaagttgacagaagcctagctaacggtaataacataaaggaagaaaaatagttgtgtgatgcaactcacgtaatctatggcaattcttaggatcaatcgttggtcattggcaaaagatagaatatctgtgagaatgttattgtttcattacatatttgaccgttttgactgatttaattgagtaccaaaatatgaaacaaaattatgaaaaaatatttcatagaaggctatttcatagaatgtgagaaactttgtagaaatttatttgagcataagtgatttgtcatttttaattatatgcatgcaaatacaatgcataaaaaaaaaccaagaataagccacaaataatctgtcagggttatggataccatatacctaatagtagttgactaaatcttggcagaacccaccacataccatgtcttatacggatactgacctctgatatggagggagttccggatagagaaagacaaccataattctgcatggaaacgacaatgactactcggattgtatccatattggtttccctagttctacttagacaagggaacacctatgggtataaatacaagaccccataggaggagaggggacacggagcaatagatcaagatacaacatacaagccaacatacgccaagacaagacaagatgccggatattgacttcagagataagcatggctagtccctacggtgtctacggatactgtcaggagagacatagcgctgtctttgatctcgccggatgtggattcgaggaggaaggctaccctgttgtcgactacgagtcagcacttcagaccgccaagtcgacaacagttagataggctaccttaaatattgtactggtgtgatcatggtgaataagagcaatgaccggcttcggccaacaggagtagggttattacctgacgattcaggggctcgaacctgtataaaattcctcgtccccatctcttttattaaaatctcgcatatatcctagtaccaacgatccccatactatgcaaataccggaatcgcgacatcaaacgtcgacacaatcaaattagcaaaacaagatctgtttgttgatgagtgtgagtggtttccacaacttggctcctacaatgtcacattagttaccaagcaatttggccaaattagcttattcagatgaattacggagttgggaattttttttaggatatacaaagtccatccactaatcttgaagtttttattcgatcctggagcgattttatgagctatgtgttctgtaaatttgtcacatttttatcattttgaaggctaggaagatcattagtttagtttttattataattcaaagtgttgacctagttggctcaactaaagttaattagtggatgtaagtttttgtaatctatactaccaatagtggcggtggcagttagtctgtgtccaccactaccaagtgatttgtgggaaccaacgatggtaagagaagtttcctagttcaaagggtgtatgagttgtgtgcatgcagtaagcacacgggctgaagtggcccatctgaatgtaactttcttttttccgtgtggtttcaggatggatctgctatacgtcataagattttttaggtctaaaattatattttaatacaatatatgttgtataacaaatctatctatctatgatatactaaaaatccattaaatttcctacaaacgctctcaagctgccatgtggcatcctataaacgctctcgagtcaccatgtggtactctaataaaatagataaatttgacaatcgattttcatttaaattggtagactcattattttagatcgttagatttatctttacaggaaaataaaaataaaatccccctccgtgcgcgcctcagggctttcacggacgtacataggaatgatccatcccatctcagtgcctttccttttttttaaccccgtgataattaaaattaaaaactcttttacgtgccttaaaaggccatagataaacaccaaccaactctcatctattctctactaataaatagtccattaaacatcatataaatatttctaaacatttgtatagtaatcttaaattagaaaaaaaatacattcggccatcaatttacattattttaggtcatcatatctatctttttctttaaaaaacatccaaaacctccctccacatcccatgcagtgttaaagcccattaatcatcttttaaatgttttcaaaccaatccgtgacacttctaaattagataaaatcataaaaaaaattcgaacaaagcatccaaccattggg

SEQ ID NO: 41468 - DNA, 1867 bp, Oryza sativa
  unsure (1)..(1867): unsure at all n locations
ttaggaaagtgtatttagtgtcctataaggactttatcttttccttttatctttaggaaagtttctttcttgttcgacaaggacttgtatcaacccatgggtataaatatgtacacccggggtctatgtaatgtaacacacacgttcaatacaatctcggcgcatcaccaccctttttgctttagttttgtttcgacgagttcttgctttcgggttgagctgcatcggtttcgatcttcaacaagaggtaaaacttgttatgacggcttgtgttttcgggattagtgcttccatctttatgatactctaatcttatttatgtaattcgtcgagttatcatatattttatataatctctggcaatattgctatctaacctacaatcggctaacatctatcagtagagggcagtcgattaggttaaatatcaacgctggcttagattatatacgatatccaccactctatgaaacttccaatggcttgattgtctagatattgtccttcttttcacacttatagctgcatcagttgtttgatcttatgagtcgtgattagaatatcaatctctagcctgcttattggttgctgattagggtagtatcagggtttcaaccgatcttacctgatttaactatacttgctttatatgctttattgacatgttaaatctgccctttatgttaagatcttattgcatttaagtatattaggctttcgtttgatatattctgcttactttaatatcttaatatagagttgtatctgagtactagccgatacatgctagatctatctgatcagctatgctataaacatatatagtcttgttgttggtatatatttcaatttaagtgatttatactgtcttggcatggcgactgatctatcccaatcacttgatttaagtatatatcgacataaggattatatattgttaatatctacagccgatcgagtagatttagtcctttattatctaattataactgccgatcgatgtatatatgacatcggctcaaagataaatgatatgtcatcggcacttagccgatcggctatcgtttatggatttaaccacggtttctttgtttctatttcttgttgattgcaggatcaaatcaactggtacgctagcatacccgaaggtgagttttggacctgcactggagttaagcagatctctcaggcctcgtgtttttcatcaacacgcaattggcacgcccggtgggatcacgaattttatatccacaagtctgaagaagaagtcaatgccaagatcatggtcacggtggagaatttaacggaggaacaacaatattggctcggggggcaagcgcatcagtttcaacatggtggagcacatcagtatcggctcatgaaagccgattacaagaagcaaaggaagattggttttggagttatcaagacaagaaattttgaagcatgaattctcgtactccaaaactagggggggatgtgttaatggtgaaatttggtaagctcggagtagtcatcggcttagagtcagcatcggctttgaagtcctgagattagccgatgagagttgccaagtcgtcagttgttggattcttgctatattcggttaaggaaattgatctactaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41469 - DNA, 1940 bp, Oryza sativa
ttttatggtatgctctatcataccatctcactttctgcacacatttgttttcaaacgtgacatgtctaattagttgtcacatttcagctttgcatggtgcataagcttggttatggaaactgggatgaactgaaagctgccttccgcatgtcgcctttgttccgatttgattggtttgtcaagtccagaaccacccaggagttggctaggagatgtgatacccttatccgtctagttgagaaagagaatcaggaatatgatgagcaagaaaggcaggcaaggaaggacaaaaggatggctaaggtacctctgttcatttcaccttccaagatctttatttcattgtttgaggctttatgcactactttgtgtactgttttgtgtagtactttcttcgtttcacaatgtaagtcattttagcatttcccacattcatattgatgttaatgaatctagaatgtgggaaatactagaatgacttgcattgtgaaacggagggagtatttcttaagagttaggacatgctttggtggttgccatgcttttccacaatgttatgcctgaagtgtggcatatacaatttgtggccattaacaattattgaccacaattgtggtaacatttagcaaaacaatgtgacactggtgctaagaaagcatggcacgccacaagattggcaaggacaaaacgctagtctaatacatatagttgaaaaatggccacttcatgtgtggcaacttgtggcaccaagtcatcaccaacctaatttcctgcaaatggatatatggcttttatagggctggtgcaaagggacatttgatattatgccatccttatgatatgagtggcatacattttgtatcaatctatcttgctaatctcctaatgtatcttctgttgcagaacatgacaccgacaaagcgatctgcgttaagggtttcagaaggtgaaactactccatcgaattctttcaagaggcgacgccagtcccttatggatgactatgtgggctcggtaagctaagctatcatctagtatggtgtcgtgaaatgacaagtcatgcacgttttgcaggaattttacatggtactctgtacttaggaatgcagtgctaatcagctgtactaatattttacagggaaggcgtaagcgaggttgatcgggcgttgcctgctgctccctttcaagcttgtcggaagtctgggagagctttgaaatgtgcgcgctatgtgatgtttaaagcctctaggcgcacttaactcatcgctgaggcctaactcagtatgatagtgtagtggtatataatactatatgttttctctgcggggatttcatgaccgctctggctagcctatgcattaggaatcagatgtactatggattatccaactttggtagaggtgaactcatcgaagctacccttttaaatccctatgcttatgttacattggccaaaagtccgctcctaatccgagtattctatcttccgagtatatcgtataaatcgctatcagtatttttcttttctggcccttgaaaatatattaccctctgttttataatataggatattttttaatctagatttatagtggtagaatgtgttttatttggtactatgtttttatgttatggaaaggatgaagtaatggtactatgtttctatattatggaaaggatgaagtaataggtaggcttacatgcatgtgcataagcacacggttatcgcgaaaatcttgcggttaccgtaagatataccgtggttaaaaaactaagaaggccatgtagttaccgcgagatataactgtggttaaaaaaactgagtaccgtgggtatggaaactaagaaggtcatgtagttaccgtgagatataaccgtggttaaaaaaactgagtaggccgtacggttatgtaaacctatgctgtgactggtggatcata

SEQ ID NO: 41470 - DNA, 4080 bp, Oryza sativa
ggtcgggttgggcacgagcatagcgaatccatgctcgacccgagacctacgtgcccgcgcccgatgatgaggatgttaggtctcgatcttctgataggtattgataaacagtcgatttgggcggagtcacgacaaaactcgatccggcttctgaacaaacacgctattgagccctgcaatcacagcaccacgtctcctctggttatcaaccgtgccgaaacctagttgacctcgccgagaaggttaatccgtgcatgcgaatcgaagaactcaagtaagaacaagatagattgcaacacaattgcatatgaatgattaagcacttaaatttggggtttcacaaaccgatctagcggtcaaactgttcttggcagattaatctaagcaaaaccccactctaaacgatatggctactgaataaatatgattaaggacgtcctagagttgccctagggcgcacacccccttaggctaagcccacgatacaattaaaaggcccaaaatccaaatcagattcggactggatgaaatatgtggcttgttttgcatattcccggaagctcggtaggaattttgacatgggaccaaaaccatctgaaattaaattagacttcataagctttccaacaagtactaatgggccccgaaattccttctagatcagcggctaggtccgtttgaagttggtgctgtcaggaggtccgaatccgaatccaaaacgtgtagaacttcatctcttgtcttctatggaccaaaagtgacgtggtgaggtagaagtagacttggagaaggtcttggtttggtccccaatcaacttctttgatcatccatgtattcgttacgctcggtctcttttccttcacccaagtaagtacctctgcaaacaaaagcacacgaaactcattgtgtagcaacgtttgttcaaatatataacatgtaaatctaatagaacataaggcagtcatggttatatccgagctagttgtgtcctcatcactcgacccgtgcttttaaaaacagaagtataaatgcaaaagttgcacaacaaagccacatgtacacataatttctctgttcaacatttaaaaacatccacatcatgacatcaacataatcacttaattagggcagccataagttgcacaacaaaaccaacaatatctctgttcaacacttaaaaacataaccagggcagccatctaggctctagcatcaacacaagtcacaactcacctatgtaaggaaggaaaacatgtgcatttaaattctaaactacttacctagcatatcagctctagaccaaccttgcatgcacgtaagtgcttctgccatttttggtgtaagtctactacgatgtggactaatagtccttccactagtactaaaggttgacgttgaagccacggttgtcactagaattgtcatgatatcccttgcaatcttttgcatagttggatacttgatccatgcaaatttccaccaattgataatgtccaattcttgtctaggaggtaggtttggctcttccgtacaaatccaattctgtgtgtacatgggaggatgaaacatttccaactatggccatgtattcatgttcaccataaataggtttgtaaagagcatacaagaactaaagcttatatttaggatccaaaacatctaaccaataatttaaaacttagccttcatctcctctgatatgttttctaccaagggatctttagtagctttccattttctaattgccaaataaatgccacagatttttagaaagaaaagattagatgtgacataatttcttccagatagtagcactgttatatcataaaacatatgtaacctatcacaaagctctctagcaaacttctaatctgatgcagtaggacacatatcttcaaacaaggggcacatctagaaagagtttcaaagacaagttcatactcttctgcaatggaaagaataaggtaagtggaattctatctagttttacaatcaatagccattcttctaacatatggaatgttcatgttagacgcattttttttcaaattttctcatgtcttcttggtgtggctgtccaaaaccctacactagcacaaattcttccgatgccttgctccataacagccatgccatccttaacaatcaagtttaaactatatgttgcacaacgcatatgaagcaaagaaccttccaacataagaaagttaagaggcaactttccttgtattttctccatcaaattatcattggtggagcaattgtcaagtgtgattgttgataacttcctctcaatgtgatattccaacagaacgcatgaagtacctcacttatagcaataccggcatgtggggcaggcacataaatgaacttacaaaagagaaatggactcaataatcagtttgtcactagtaaattactctatacaacaaaataagattcaatacatcattagttagctacctcaaaagaaaactttttagcttccaatcatcatctatgtagtgtgtcgtgacagccatatatcctttcttttgatgatcagttgtccacatatcggttgtgatggcaattcggacatgcgattgttgaaaatacttgatcaatgcaagcctttacacctcatacatacccaaaatatccttcctaatagtattccttgacattaacttgaacaacggttgcaatacatcacagaacttgtgaaatccagcatgatcaacaatggaaagtgggtactcatgaagacatatcatcagtgcaagttttttcctcgcaagattttgatcaaagacatgtgtttccagcataactgaatgatgaggacatcctccactattacctgttggcaaagacgcaaaagtcgggcggcgactgtgtgagcctctgaataatcccaccttgcttagcttgggaggaggaagtcaccttaaaagggagagtcacccttcccttattggactagtcttttagggagattgggcctttccccgagtgggtgggcctaagaactgtgaggtccgggcaaccttaatttgttgggtctcggccaaccccacctgggccggattgttatcatttggtattagagctgggcccttgttaagggggtgttaagggggtgggaatgatgaggacatcctccgctattacccgttggcaaagacgcaaaaatcaggcggcgaccatatgagcctctgaataatcccaccttgattagcttgttaagggggtgttaaggggcggaataatcccaccttgattagcttgttaagggggtgttaaggggcggcgaccatgtgagcctctgaataatcccaccttgattagcttgttaagggggtgggaatgataaggacatcctctgctattacccgttggcaaagacgcaaaagtcaggcggcgaccatgtgagcctctgaataatcccaccttgcttaacttgggaggaggaagccaccttaaaagggagagccacccttcccctattggactagtcttttagggagattaggcatttccctgagtgggtgggcctaagaactgttggggtccgggcaaccttaatttgttgggcctcggccaaccccacctggaccggattgttatcactgaaccacctgttgagttatttgtaaatgtgagggtggattgtttaaggccttgtctagcttgtcgagactgacaacttttgaggtgattcttttaagtgttttcccatttctttgtctcaccagagagcaatttttgacaccaactacatttagctttccacacatttccgacctttacttgtccaaattcttgccaaatagcatattttagttttcttttgttccctactgcaacatcatcatctatctctatcacattagtatctttagagttagtgttgggtgttgtgactggtgctagggaaggagagggtgaaggcgtaggagaggtcacagcaacagcacctccagcaggtgatgagctagttcccggagttgacatttcttcagatctagcataagaaatatgcatacacatactaagaacaccaatatttcagatctggcataagatcgacatgctaca

SEQ ID NO: 41471 - DNA, 5397 bp, Oryza sativa
ccaccgaaagcccgagagagagacagagagaaaaagagagagagagagagagagagagagggggggggggtagcacgatggcgccgcccatggtggtgaggaaggatagggttaagtagtcggctagggtttgagactttgagatgttaatatatatatcgccccatataaatgggctattgggccattaggggggaggttaaactattaaaggcatgatggatatatatgggctaaacgattttcgggtcgggcatggattatctgtaggcaaaatataaaacctatctgcgcccactaagttcgctggtatcggatcaggcgtgcccacagacaaaaaaaggtgcccatggccatgcccatcgagtcggatatccgtggatacccgaacccatgggcattactgccaaccataggagttagatgtgttctgactaaaatgttttgtccgtattgatatgttaacgaccaaatttggtaatatcagtatcggaaaagaagattagatcgaagcggagtcagaggcgaagatcgattcgagaacagagcatgaatcggctggagtccagatcggctacgatcaggatcggctgggtccaagttagactgggtaagccgatgcagccgattccgacagtatgacttggtgtgcgacatcgggttgaattgagatgcttcacggtgattgccacacatggatagagtcctgagaaggcaattgtatctattaattatgatattttatgtaattttcttagagatatgtttagggcaaaagtctgccgtaaagacttatggtatcttaaagtttgttagagataagagtcgtgttcgatatgaacatattttgtaattttcgggtataaatagaccccgaaccccatgtaatcaattaacacacacgttcaatacaattttggcgcatcgccacccttttgctttagttttatttcgacgagttcttgctttcgggttgagctgcatcggtttcaatcttcaataagaggtaaaacttgttatgacggcttgcgttctcgggataagtgcttccatctttatgatactctaatcttgtttatgtaattcgtcgagttatcacatatcttacataatctttggcaatatcgctatttaacctattatcggctaacatatgtcagtagaaggcagccgatttggttaaacatcgatgttgacttagattatgtaggatatccaccactctatgaaacttccagcggcttgattgtctagatattgttcttcttttcatacttaatgttgtatcagttaagtttgatctattaagtcgtgcttagaatatcaatctctagcctgcttttttgttgccgattaaggtagtatcggggtttcagccgatcttacctgatttaaccatatttattctataagcttcattgatatgttaaatctgtactttatgttaagatcttgtcgcatttaagtacattagacttttgtttgatatattctacttgttttaatatcttaatatagagtggtatcggagtattagccgacacatgctagatttatctgatcggctatgttataagcatatataattcaactattaatatatatttcgatctaagtgatttatattgtcttggcatggcgaccgatctatcccaattacttaatttaagtatatatcgatacaaggagtgtgtattgttaatatctacagccgatcgagtagatctagttttttcttatttgtttatgactgtcgatcgatatataaatgacatcggctcaaagataaatgatatgtcatcggcacttagccgatcggctatcgtttataggtttaaccacggtttctttgtctttatttcttgttgattgcaggatcaaatcaactggcatgctagtatacccggaggtgagttttggacctgcactggagttaagcagatctcccaggcctcgtgtttttcgtcaacatgatcatagcaatgttgatatgactagtaaggtaatatgggggtctagccaagaaattgtagtgtggggattagactttgatagtggctctgaatgaatgaaaggtaaccggcaactaacaatttgagaagttgattcagtctgggtggaaagagagggtagcaccgtttaggatgggtgtacgattttttccacataaatcggacgtccgattcgtagttgtctcgaaagaagatttaagatttgaagtagaccaaacacatcgctcaactctcgtctaaccaaacaccggatagttcaacgcacagccggactgtttaacacatgttttaattagacaattctttcacttgatggtttgacacaaaatcaaattatccagctcgtacacattgtattgtcaaaacggacgaaaaaaaactgtccaactcgaagaaacattgctattttgccacgtcaatagcgtggcaaaaggtttcacatgtaagttatcggagtgttctatcttaaattatttgaaacgcaactttttaaaagagattgtattggaattgatgggccaaatgaagagtgagaaaatacagataaggaaaatgaagatgactagtgacttcaatatcaataacaatggtactaatcgcacctcccaaatcatatataaccagcgacattcaaataagcaatatcacgcaacatacggaaccagtccgatgcaccaaaaagacaagacagtaattccactgagatgcatgaaccatccgtttatttacagaagaaagaatactccatatatacacaagggcaaccgaattgtcacgttgagcttaaatacctttggttccggacaccaatttgttcagaagcacctgagatgaacagaaaacactaccacatatacataagctggatgaatttcttcctactgaagcactaccgctttctttccgcacgaaaggaacaaaacagaaggaaataattcatctacagactgaccattctaaaaacttccccttaaactcgatgaaaaacatgtaaaagaaactgtattgagttcctcttatcgtgctcttgttccgcccttgtccttctggagctgctttgaataagctgcagccttcgcatctagggcagtttgcttcttccgcctcgattgccctagagctgctggatcaaccaatggtccagaccatgtttgtgaggaccccttctggatggggactactgtgctgaaggaagcatcctggtgctcatacataggctccatatgacgactggatcccaatgggttacccatagctccatcctgatgaggtggggggaacttctcacttttgctcttggcattggcatgcgttatcatgcgtcgcctctgctgttaatgaaaatttgaaaagttcaacgtacatgtttgtcttgaatggttaaagatagtgaagtgagatcagagagaacacagaacaacgctagtttacttctactgcattatcttctgcaatccctaccaattccatggacgcaaattaatagttctacagtgaagtctacttttatttccacacccacagaaatagtattgtgtaagaattttgtatacaaaggacttttgtaaacatgcttgaaattgaaagaccttgtaataaatgaggattatggagcgcgactgattctgttgatgtcagaggtgctacaattctggcccaaaaatcggaggggaacaaggtttccaaaaaagagtcaaccaggttttctagttctttttatataattttcaaatttaaagcagtataaattagatgcaatttttaaaggctgataaattgaatttaataataggggtttgggagcttagcacattgaaccagctgaactccaaaatccaaaatctgaccagtgggtattgttgtttttgcagaaaaccaactgacattattaggtttatcacatgataccatgttagcacacattaccatcagaaaaataatgattgttttaattggacttatatttcttcccagagaaatacaaatggtttgggatatatcgttagtactaaatatcactcgtagccaacccagttggtgtatgtgtaacaaatctacagtggataaggcagcaaattaaacaggaaatcttcaaatataaatagctggcttacatctaggtttgcttgaagctctgcattagcctctggagctggtcctgccctttgagatcgatcccgcgttcgagtcctttttaccccctctcctttggcctttgcagctgctcgtagcctggaataagaatatacagcaaaggcatatgacaccatgtatgatacagtagaaacaattagacagattagtgaaagacagttcaggctcatttggatgggttgggctttggcccatccaaagtgggccttagaaaagtgaaagaaaatcagctacatattgtatgtgcccgtgaggtagaatggatggacagttggacacatgccaatggatgtagcgaaagaattccaaactttctagctagcattcttagcaaaagaagattactgtccctgaacgtagtcccaaataggggtgggcattcggtctaaccgaaaaattcggttcggtttcttgatttttttgaaaattcggtctttgtaatctcaagaccgatcggtctccaacaaaacccaagaccgagcgaatcggtcttcggttagttcggttcggtctcggttatagaccgaactaaccgtaagagaaaagtttgaacaacaaaagcaaatcaaataatcaataattaggccgcagattgtcacagcaaatcgagcaaaatcacagcatatcacagcaaagaagcaaggctggaggcgacacccggcgatggaggcggcgcccggcgatggaagtggaggcggccggctggaggcagcacccggcgatggaggcggaggcgggcctgctggaggcagcgctcgccatggaggcggaggcgcactggctggaagcggcgtccggccatggagggcgaggtgggccggctggagttggaggcccggcgacggaggcggaggcgcgccgactggaggcggcgcccggccatggaggcagaggcggaggcgggaggcggcgcacggtgaaggagcgaaggagcgaagaggatggagacgggacggcgcagtgctctgatggggaagaaacggcgcacggtgtggtgtttgcctgtagggttttttattagtgggcttattgggccaactagatctattgggccttattcggttatttcggtcaattcggttaattgaggcccatgaccgaattaaccgaacaaatttcggtcttttaatggttgagaccgaattgctgaccgaatttttcggtctcggttttttcggtctcggtcttttcggttcggttcttcggttcggtctaattctgcccaccccta

SEQ ID NO: 41472 - DNA, 5005 bp, Oryza sativa
tcactcccgaacacagccttagtttatagagaaagagatgcaaaaactaaagtggagttcaaatgcacagtgaaccattcattacttagtctaaatggcccaagttgataatcaatgcaaaacaaatgtaaaaggatcataacatgatttatataattatgtgtaagcccaacaaaccttctagcttcctcatctctcatcttagcatccatctccttacttggtggatatgtcggcaagcttgatggatcacatgcataaggctcagttgcaaagaactgcaatactcacagcataaaaccttactacatagtgatagcctaatagctcgtcaaaataaaaaaattaggactgtataccaagggtggagctatattattaaataaataaataagagatttcctacgtactgaacattagggagagtcgtaccaagcgcagcactaaatattgaagcagaaaacataatgtaacccattaaatcatgtggtctagaaaattgcaatggtgctaataagtgggcatagatctccagatatcacatgtgcatgaaatgcagatattaaatcgacaattctaaaacagaaaaccttttggaacctatactggaagtcaaagtagccatttagaccttcataaagatgaggtccttggtacaaaccaaatctaaagatttaaaaacataacagatcttttccatttatagttacagtacattacacatctgaataccagccatttcttggtatttgagtgtgcaaaacgtcattttattggtgttgctccttgcattttatgtcatagcactactcatgtaggatatctacgctcagattattaggagaaaaggaactagattaatcaaaagatgccacattgtcaaaccagcagtttagtatctataaaagcttccgaaagactgaaacaataacaaagatggattgttgtttaaaaagattcttgaacacttttgctcatactgcaggatttttttttcttctgttctcaagagtatagaagtgattccacatagaggtgatatgtatcaaaggaccacataaatcacaggtcaattatgttacttcacactaacattctctgttacaatgctaaggaggaaaagatatggacatacttcactttgcaaggcagatgtagcagtttggcgctcagctggatcaattgcaagcagagtttcaaccaacggcaaggaagatggaggaaaatctttaaatgcttctctgatacaacgcttatagggctgctgaggtttgaatattgtagcatgtggcagcttggactttttccaatactcctctgagggggagccacatagcttgaaaatcttgtgcaactgttctacctgatcagttcatattgcacatattaaaattagaaaatggcaatcaattttatgtaagcaactaaagcatatatagcaacacaagataaaaacaataaattaataaacatcacgagttcaccctagatgcatggattcaaccagatagattagaagaactgaatatttatggtggtttgatcacctgatgaaacaaaatcctactcgttgtgtcacgatcaaaaagatatataagtaagttaacaattgtacgaattccaaataatcctcatcaagcaggtccatattcatgttatcttaaagaaacttcaaatgattaaattcaggtttgactatcccattaatagcatatattgctggcaaacagcacagagttttgctcagattgagtggtttgtggtactataggagttttaatcatagaccatgcctaaatatttagcttagcgatcatttcattttctggacatatttaataagcctatgtgtaccttccagtgaaaatatcatggcaggacaagttatatatagcctatatgtttgaaagttttgaaaggccttataaattggcttttgcattttatgagctataagcagaaccaatcagcttatgaatcactgctaaataaggttcagctaatcactctatattgccagtggcatcgtcgatctgaaatacaggacttctcttttcacagaaccagaacaagatgattatgttttacatttgcagaattccaaatttactaatatatggcgatgcctgaaatgctctcgagaaaaggaaaaccatccaccaattatatataaattggtacattgaccacttattacttacatagcagtatgattttataagatgtaaactgttatacataatgtaaccaccaataaaacagagatactagtcaaagtggcagcttatctgatttccaacaggagtttgccctgcaaatgcacagagcaaaggaaactgacaaacctctatggcaatcatggattgacaactttctttaattttctcctgtatttatttgtaactattgtaaactatatatttatacattaatatatcgcagtaggagcctctcctgctgttttccgtcaaaaaagaagtggcagcttatatttgtcttgtgtttactcccgacaagtatggactttaaccttcatgaaattgggtttggtttcagctgcacctcagtcctctacaacacgtttttcaggttggtggagcaaagttgttaagggtgttcccaaagagccacggaagggattgaattctttgattatttagtaacttgggagattcggaaacactgaaacaattgtgtttccaatggaactaatcctaatgtggtggtggtgttgcaagctgtggctaattagggttggtgtttagtgggagcccatgagctccatcagtttctttgtaagttgcttaccccggcagtgagttagtctcagtgggtttgttggttgggcctcacttatgtgcgaggcttgttgggacgtgttcttggtgggaggtgttccttgacccttcctttgtactcctaaatatttctctcttcttaacgaaatgaagttctcttgtgttttcaagaaaaaaattggaaatggagaaagtgatacttatgtgactaacttagaacatctactacctcagttcacaaacatatgctgttttggatatccatgcagccaaacttccaacatatgtgtacattgaatacatgaaaaatcatacgtgcagatttgcctagaaaactacttccataataaaggatttttttcgtgtttaataaattaattgcaacaaaaattaagtggcagataagtgtttggaggtctgcattgaggtccaaaagaccaaaacaacatgtattaacgacagttgagagtactatactgacgaattttaaataacaggaataatggcacaacatattttaattccaaaagacgtatgcttttcaaggaagcttcaactgaagccatgtggataaccagttaaacactgatggcagtaccctatacaaaaataatagtcatgacatatacaacgaagtcagcatatcattcaaccccttcaataaatgacaacggcgtggccatcaatcactatcaccaaaacattaaaaaaagaacaaacgtagaagattaatcaacctagagatactacaatccattggagcaaacctagtataaaaagtcaacattttcaatacacaacagccaccatggagttttttttatataaatagtacaagttgacttttggtaccaaatgagatttcgatattggattgatagaacaagtatggtccccaggattaccaaaggaatagcatataatgaagagtagaaattgtcctatgactcacctcagtacgcccaggcatgatgggcttcccatgcaagagctctgccagaatgcacccggcactccacaaatccacaccaacaccatagtctgtcgcccccaacaacaattcaggtggccggtaccacaacgtgaccacgcggctcgtcattggtcgtttatgtcgtgggtcaaagaatgttgccaggccaaagtcggcgatcttaagaatcccattgttatccaacaataagtttgatcccttgatatcccgatgcaatacattattattgtggcaatgctcaagccctgacaatagctgctgcacatagcattttatctgcgagaagtacatcatcatcaaatttaacatattcccagcaagtattcgcctataaaacgagatagcacgggatccttaaacacctgcggcagagtaaacttgacgtccgggctcgctgccaggccagcaagggcatgctccatatactcgaacaccaagtacaggctgcatgacatccttgacgtgaccaacccctccagcttgataacattgggatggtcgagtttcctcaggatcaagatctccctggccatgaatttgacgctctcgggctcgagattgtcgaaccggaccttcttcagcgccacgatgcggccggagacggtgtccctcgcgcggtacacgttgctataggtgcccgaccctatctaagagtcaattgccggacagggaaggccaccaccacgaaacggcaaaatcagtactcgtatggtaggtaacaagtggcggatcgaaatttgcggatttccggggggtgctttccgcataataccttgttgagcttctcgaaggtgtcggcgcggcggggcgtccacccgcggagggcctccccggcgacggcgacgagccacggcggccaccccgcggcgagctgctctgcggccgctggcgcggggacgcacccctgcctgggccccggcttgcgtcccagcctccggcgcggccttcccctccccggggactggtccgccgcgggagagtccgtggagggtgccggcatcggggacgacctcttcttcctcctccccttcctcgccgccgccgccggtggcgacgacgacgggcgcccgaagacgcaccccatatcctcccctctactctaccaacccacctactactgcaaccctacaagcagcatctggcggcggcggcggcggcggcgggcagcgggcggcggcggcgaggggggagtgaggcgaggcgaggcgaggga

SEQ ID NO: 41473 - DNA, 1781 bp, Oryza sativa
agaaggaaggaaggagtatttttcatgctcgtatttaccggctaccacatctattttaaaagagagaattcgatctatagcacagaaaaaaaccgatataaaaaacagcacacaaatttctctcttttagtcagaagcacgtgccactaattttttctttgatccgtaccactcctgtcaattgtttaggggcatgaaataattatttttgctcttcttttctaaccaaacatgaaaacttggactattcggctcggctcaatcccgatggatggtgagagtgagtgggtgtaggtgcggtgaccgagcgggtagtggctagcggtggtgacagagaagaaggaggaggaggaggtgcggccgatggaggtcgtgctcctaaaagaaagggcaataacgacggctgcttctaaggcgcaagtcacacacctcggaaaagggtaacaatagtgactacttgcgaggcacggtggggtgatgacattggttgcttgtgggttgttcgatcacgtgcaggggctacgaggtgcaatgacttggttgacaatgctcggggccgccgcatgatagagacttttacggatgaggtgtgcaccaatgaactagccagagccgccatggccgacaaaggcacgtcgtgaacgagtgctagggtttgggggagtgaatgcgagatgtcgaatgggaaagaacgaagaggcgacctagtcatgtatgaggaaaacaaagggtaaattagtcaaaggataaatttatctgctctaatctaatgtcgtttgctcaaaatgcgatggaagtggtacatatcgaagaaaaatcagtggcatgtgcttctagtcaaagggggaaacttatgctatttatgctattttttgtatcaggttgtttctctatagcaaccgttggaagaaagtgcatagtcgtaagcccacgcttaaatgagtggcttatactctcgctcacatcgtttgctcttccgctaataagtcgatgctaaaatttaaattttaaatcgtaattttgaagatggttggagttaatcaaggattacgacatgagcattcactatcatccgggtaaagccaatgtggtggcagatgcataaagcaggaagagctactgcaatgctttatgcaccgagggcatgtgtaaagaattgcaacaggagcttgaacacctcaacttggggcttgtagaatacgggtacgtggctgccctagaggcatgacctacgctcgtggatcaagtcagagccgctcaagtaaatgatcctgaaatagcagagctgaaaaagaacatgagggtcggaaaagcccgggatttccacgaagatgaacacggcacaatctggttgggagaaagattgtgcgtaccggacgacaaggaactaaaggatgtgatactcaccgaggctcatcagactcagtactccattcatccaggcagcaccaaaatgtaccaagacctcaaagaaaagttctggtgggtcaacatgagaagggaaatagctgaattcgtcgcactctgcgatgtttgccaacgagtgaaggcagagcaccaaaggccagcaggtttgctccagcctcttcagattccggaatggaaatgggaggagattggaatggactttataacaggactgccccggacatcatctggccatgattcaatctgggtagtcttggatcgactcactaaagttgctcatttcatcccagtgcataccatgtatacggggaagaaattggcggagttgtacctggcaaggatcatgtgtctgc

SEQ ID NO: 41474 - DNA, 1009 bp, Oryza sativa
gggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagactcaccctagactagtctaatggaattgaatagtataggtggatggttgggcctgttgcaacgtggtatagcgttggacagtggatgattaatattgattaattattacaactgttttactgctttcaacttctgtttataaatgcccgctttatgcaaatgaaccattatagctatcccttgataattccctgcatcatacccctattccggtatgacttgctgagtacagtgggtagtactcaatcttgctctattttccccaaaccccagaatttgagtatgcgtcagatggtggtttctccgaggagtaggcttcgtccgtgccgtcgaggatgcttgtggagtggtgttcccgctgcagtccaagtcaaggcttagctccagctatcctttaagttttccgctgcatttatgtaagacttttataatgtttgtaagacgtggatctgtatgtcaactttgtcgtttgtgtaccccggccggtcctggacggggattttaatgcacattctgcttggaattctattcgggaatttctgggcgtgacaactaatcacctgaataactcaataaactcattagtcccttaaccttattcatcattaatcaccaaaacccactaggggataaatgcaacttcacaactaaccttctcgatcgcttcagtcattgatcacccaagacacaccagatgatgacacatgaacacacaatattttttaacgaggttcagccgaagcctacatccccagggctctgattatgggcgcccatcccagtcaatac

SEQ ID NO: 41475 - DNA, 30338 bp, Oryza sativa
  unsure (1)..(30338): unsure at all n locations
attcctgcagccctttcaggaatgtaattaaagaaaatgttttggtcatttgaattttcaaatatagggtgttatttgtgtttaacattgggcctataattatgtagtacggcccttaaagttgggaaggcccatataggtacttaggttaggtagaaggcagggtcaaccgcaggcgtggctaatgggcgggtgatcgctgacaacaatcacccccatcccccctatacgctcctcctctccacccttcctcctccccttcttctcttcctactacaccataaattttttttaaaaaaaacaaagttggaaaaatttatgtatagaaatgctatatataaaaaatatttgaattcaaattcaaatttgaaatgggtatgtaaacttttgacttacaaactttgggtttataaactaatatttgaattcaaattcaaatttaaacgggtatgtaaacttttgacttataaactttgagtctataaactaatatttgaattcaaattcaaatttgaaatgtgtgtgtaaacttttgacttataaactttgggtctttaaactttaggtgtataaactttagatgtatagaaatactatatataaaaaatatttggattcaaattcaaatttgaatcggatatataaacttttgacttataaactttgggtctctaaactttagatgtgtaaatttggggtgtataaactttaagtacataaatttactaaaataggaaagtaatacggtgccaaaaaaagaaaaccacgtagagggaggggggatcggctgatcgctaggggcgatcgatcgccccttttggtcaaccgcaccctaccctcctagtcaaggaactgcatttgttgtgtactatcaaatccccttgctttgaggcgtgtactatcaaatccccttgctttgaggccttgagacaagctgcccaatcaatcccaagtattatagcagatggcactatcagtgagctctctcataattaacccatccatgccaaccgccaagtccccaccaagcaaatacaggggaaatttcttcttgaatcatatttgtacagtactacaaaggaatgtgttgactactccggcaagcacgcaggtgacggccggctgcaaccaagagctaggtctccatcagctctaattggagattggggtgtcattgtccatatgagcatcaaacaagcctgaacatagggtcatgtgtcgtgctgaactctaatgaaaatcactgtggattttcatgattttattggaacagaaatatggaaaaaattttgaaactaatcgtgtttttgaccgtaattgcaagattaagctgactagtggcggatttgcggaaatatactagcgtcgcggattgaaaaagcgaaagcgcgatatcgcgctatcggcgcgcgaaagcggcggcgctatcgctaattgggagcgagggagcggtattgcatcggtatcacgttcttaaagcgcgagagcgaggcggtgtcgcgattttgtaaagcaagtgtgcgggccgccgggacacgaagcggtctcgcgcttacaaagcgcgatagctcgtgcggtgtcgcggccggaaagcgcgagatcgtggtggactgacgcctgcgggtccccgagcggtgtcgcgcttacaacgcgcgatagcgcgcgcggtgtcatggcctgaaagggcgagagcgttgcggactggcgcctgtgggtcccggagcggtctcgcgccactgctctgcgaaagcgcgtcggtctcgcggtacgcgcgtgcgagagcgccgtcggtatcgccctttcaagccgtgataccgatgccgcgtgattcgctgctgtgcgacagcgacggcttcggtctcgcgctttgaaagggcgagaccgctagcaatatcgctctccccgtgcgcgagagcgattagctaattacacccccaaatggtaatatttcatttgactcatgtcacagttctcatgtcatagttggtaagtatttcttccatcccataaaaaaccaaatcagtactagatttgtttttttgactgagagagtaaaaagtataattttttttttctattccctccgtccccaaaaataccaagataatatttttttcataattttttattatgtgtgcaacatatatatacataaatgaacatgacaaatatgtttatattgaaaataggcaaagattgtgtacgcggctacgagaagaaatataaatatcttggaatatgcaaaatagtgatatcagagaaagaaaacatatattacctatagaaaaacagaaattgaatatgtatgtattaaaaatatataaaggagtagagagatcattcgggagcaatttttacaaagttgacaaagaataggaatttagaatatgtcatattcacagagaaaaccacctttgcatattcacatgttcgatcttgtgagaagaaccgtgtagcgagttaacgaagtactcaagttcttgccacaatatcgggcctaagaatatgcaacaccgagtttatgaatttgcaggagtaggttatatttacaaacggatggtggaacttggaaaaaagagtgggcgtaaggatgtattaaaaaaatcacatttgtatattcatagactcgatcttgggacaggaaccgtgtcgcgagtgaacgaacaacatagagcgagttcaccaactactcagtttctgcctcaagatcaggcctaagaatatgcaacacaaagttggaaccagcaaaacgtttatgaagaagagatgtagttgtgtgctaggtttggttgttatttataggggatggcaagaagctgcgtagtttcaattattggaaagagacgacggtgcgtctgactgtttcagtaatcaattcaatagtgttagactgtttcacccgtgatgacaataattgcaaagcgacaccgtaactttcggcggcgcatgctgcataactgtttgctttattaatcacaaagcgacgaatttacattcggcgcagtgcagcataatcttgaaagtttaattgtgaatgatttgatgctctggcgcatgtcccgtgattggaaagagaggatgccatttcaggtgtgtcggtgacatggggccgggggtatcgtgactagaggcttgggtagccgcgatcactcacgtggcccgaccccctcgggggggtcgggcccaacggtgacatggccacccctccctctgtttccccgaggggtcgggccgctcccgtttcgtccccgagggctggggcgccccgaccccctgagggtttggcgccacgtgtgtgggttaggtgagcacagcggcgctcacctaaccgcgtttattgcgggttggacgagcgccccacgccgcatttaatgtagcgcagcacactcatccggtccgtgatcggtcacagtgtgtgaccggtcacagaccggtcagatcgcgggtagggggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtagacaagaatgactggtttgtgactggtctgacgccggtcacgtcatcagcaaacaaccgtgctcccacgttgcacctgcttccggcggagtggaggttggtatgacccatcccatcggagggtcattcggacagcaaccattgcaaatctccacccattaatgaaggaaggacagggttatcccggtgtcaggcgaaggtacgagccaagttatggtcaaagtaggatgggtccccacccaaaagaagggtaggtagaaatggtgtatgtggtatccccttgagatataaaaggaggaccatgcctaccgagagaggggactgggggggggggaagaaagggagaagaaaagaaggagagctcgaaaaaggaagagcggagctcatagaggagagaaagagggagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttaaaacctcacctagcgtccccggccgaaccggcaaaggggggaccgcgcggtctcccggtgaggagccccacgctccgtcatctggcgcgccaggtaggggacgcgtgtgtttttctaagctctcgtcctctttcgtgtgcgccaagcttttcccgctcagcccaatggcagaacgggcagtggcgcacaacctctctccgagcgctagcggtgacgacggggagcagaacccgcgccgtcgagctcgtactccaccgcccccctctcgccgaagtcttaggcgggaggaggcgctcgagggggtcgaaagatccgcgacatcgccgcccacaagcgatggagaaggacggcgagacggggagcgtcgcctccttgtctacggcgatggcagcacgccccagggcgcgctccaagctgcgggcgcgctcttgcgttacccgcccgtcgtccccgatccagagactccagcctgacgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcggccggtacccgccgttcgtcagccattccctcgtcaacgcctccgacccaagaagatgtgcgtagggggtcggatgcccgcctcagtatcgagcgccggcgcaatggtcgtcgtgctgcccacgcaacggaaggcgcttcctcgtccggagcgccacttcggttcgggcgcgggggctagccccccgtgcccccagttggtggtgtcggctgtcgagcctttgtggcgagccttcggaacgtccgttggcccccaaggttccggcccaccatcaccgaaaaatatgacggaagtgtcaaccccgccgagtttctccaggtctacacgaccgggatcgaggccgccgggggtgacgacagggtcatggcgaacttcttccccatggccctgaagggacaggcgcggggttggctaatgaacttgccgcccgcgtcggtccactcttgggaggatttgtgccagcagttcaccatgaacttccaaggcacatatccgcgcccaggtaaagaagcggacttgcatgcggtacagcgaagggacaatgagtctcttcgctcgtacattcagcggtcctgtcaagtccgcaacaccataccatgcatccccgcacacgcggtgatctacgcgttcagggggggcgtacggcacaaccgcatgctcgaaaagatcgcctccaaggagccccagaccaccgcggagctttttcagctcgcggaccgtgtggctcgcaaggaggaggcctggacctggaactccaccggtttcggtgtggcaacttcggccgcccccggatccgccgctcggtcaggacggcgggacaggaggaggaagaagaggtcggcccattccgacgacgagggacacgtcctcgccgtcaagggcgcttcgcgggccacccgaaaggggaggcctgcgagcgacaaaaagaaggaggccggcgctcccagcagggagcgcccgaccggcaagtggtgcactgtgcacaacacctccctccacgacctcacgaactgccgcgcggtcaaaagtttggctgagcggacgaggaagtgggaggaggagaggaggcaggagcgccgtgagggcaaggccccggcggctccctccagcaaccggcgaagtgaggccaagcagaaggcccccgccgaggacatcgacgatggcgacgatgacctagggttccaggagcctggggccaccatcgccaccgtcgatggaggagcgtgcgctcacgcttctcgtcggagcctcaggcccatgaagcgagagcttctggccgcggcccatacccatgagaagacgcggcgggcgcggtggtcggaggttgccctcaccttcgaccagaccgaccacccgccgtgcgttgcccggggaggacagatcgcgatggtggtttcccccaccgtttgcaacgtgaagttggggcgtgtcctcatagacgggggtgcagccctcaacatcctttcccccacagcctttgacgccatcaaggtcctggggatggtgcttcggccgtcccagccgattatcggtgtgacgccggggcacacttggccgctaggtcatatcgacctcccggtcaccttcggtggatccgccaacttccgcacggagcgggtaaactttgatgtggcggacctcagtctgccctacaacgcagtcttggggaggcccgcgttggtgaagttcatggcggcggtccactatgcctacctccagatgaagatgccgggccccggtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaggagattgccctgggcgacggcccgtccaagaccacacgaatcggtggtcttctggacggcaaataggaagacgcgctcgtctccttcctgcgggcaaacgccgacgtcttcgcctggagaccggcggacatgcccggggtccccagggaggtgattgagcaccatctcgccgtgcggccgggcgcaaggccggtccagcagaaagtgcggcggcaggccccggaacgtcaagccttcatccgcgaggaggtggcgcgacttctggaggccggattcatccgtgtggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccacggggtgcgaccttttgtgttttctagatgcatactctggttatcatcagattcgcatggctagggaggatgaggaaaaaactgcattcattacccctataggaacttattgttatacgacaatgcctttcgggttaaagaatgcaggtcctacttttcagcgtactactcgaatttctttgggtagccaaataggacgtaatgttgaggcctatgttgatgacttggttatgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcctgaggcatcgaggccaaccccgagaagatacgagctatagagcggatgcgcccccccagcaagcttagggatgtgcaatgcgtcaccggctgcatggccgccctaagtcggttcatatcgaggctgggagagaaggcgctacccctatttaagctcctcaaatgctccgggccgtttatctggacggaggaggctgagcgggccttcactcagttgaaggcgtacctcagttctcccccagtcctggtcgccccggagccagatgagccgttgctactctacctggcggcaaccccgcaggtggtcagcgcggcgttggttgtggagcgcgacgaggacaaccctcacctcgcacatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctccgaccccgaggtcgtcggcatagaagccgagtgcgccccgcgcggcctctcggacgaagagcgccctggagatgcggcccctagcgaagaggatcggccccgccgaaaggtgcagcggcccgtctacttcgttagcgaggccctccgggacgctaagacccgataccctcaggcccagaagatgctttacgctgtcctgatggcttcgaggaagttgcgccattattttcaggtgcatcgggtcacggtggttacgtcttaccccctcggccaaatcttgcataaccgagaggatactggacgggtggtgaaatgggcaattgaactctttgagttcgatttgcactttgaaccacgccacgcgatcaagagccaggccctcgccgactttgtggcagagtggaccccggcccctgagcccatctccgtccccgagaccagctcgggcccctcgcagctgcctcacaccgcctactgggtgatgcagttcgacggctccctatctcttcagggcgccggtgcgggggtcacgttgacctcgccaaacggagacgtcctcagatacctggttcgcctcgactttcgggcgaccaataatatggcggagtacgagggactccttgcgggactcagggtggcagctggactggggatccgctgcctcctggtgttaggcgactcccagctggtcgttaaccaggtctgtaaggagtaccggtgctctgacccgcagatggacgcttacgtgcgccaggttcggcgtatggagcgccattttgatgggatagagctttggcatgtgcccaggcgggataacgcggtcgccgacgaactctcaaggctcgcttcctcgcgagcccagaccccaccgggcgcctttgaagaaaggcttgcccagccgtcggcgcgacccgaccccctaggggagacggacgcacctgaacggcccccaaggcccgtcggagtccaggcctcgggacccgaggggagcgttcccggctcccctagattgattgcttggatcactgagatccaggcatacctcacagataagactctacccgaggaccgcgaagggagtgaacgcgtccagcgcatctccaagcgctacgtgctggtggaagggaccctctatcggcgcgcggctaacggagtcctcctaaagtgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcatgaccgtttgctgtctgggggctcgatatcctgggtccatttaggcgggccccgggcggtttcgagtatctgtatgttgctgtcgacaagttcactaagtggcccgaggcttacccggtcatcaagatcgataagcactccgcgcttaaattcatcaggggcatcactgctcggtttggggtgcctaatcgtatcattacggataacggcacccagttcactagtgaactcttcggtgactactgcgaagatatgggcatcaagctctgcttcgcctctcccgcccactccagaagcaatggccaagtggagcgcgccaacgcagaaatcctcaagggccccaaaaccaaaaccttcaacatcctcaagaagcacggcgactcgtggatcgaggagttgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcacgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgttcggctggccacgggcgacggcacagagctgcctaatcagtggaacatcgaacaccttcgtcgcttctacccctagtgggggtcgggtgttaggtctcgggctcgggccaaccccgcgcccccctaggcgtgcagggttggccgggggctaccacatgcatatccttatcttttttctcttccgtatttcaataaaagcattttagatttcctaaggactgtgtctgtgccattgtttcctttcgaagaatcttggcttgaattagcacgctcgtgctcgatcctgccctcggtggcccaggccggctaaaatcgccaaacggggcccagaaccgagccgtgcctcggggcgtggtgaactccgggggggaatcggcaaaggcccacaatcgggtcatccataaccctcggtcaccacattcccggcctggccagtctcgacacgcggatctccccaggcactagccccgacccgcgccatttgaggctgggacctgggcacgagccctcgttcaagccaagacacagaaggaccgtggcacagaccatcctcgtctcatacacacaacaaatgaaattgacacaaaaatttcatctttatttgattgcagattaaattagtttatacaagaagggagcccgaaggcctcagaagaagaaagaaaaagctatttaagattggtgggggcctgggggctcacgccgacgcgcccgggtcgccggcctcgtcgtcgctgtcgtccgcaccaccgtcaccgccctcctcgtcggagtcgagggcgaacgcgagtcgaggggccgtaccctcgaagctgtggacgatgtggtcggcggcgtcccggacctgtgcgcgcgcgccatcctcggttccaggagggaactcgtccagcgccaccgccccccgggcgaggtccctcgaggatgacttgatcgtctcctcgagctcctcggggagccgctggagggtcccggccatctctgagaggcgctgggcgaggcccccctggttggcggcatatttcgcggtccgcccgccccaaaggcccgcctgccgcccggcgcagtctagacgggagacggcgtcccgaagcatgccgggccctacctcgcctgccaagtggagggcctcgacctccccggcggacgagtccagcgcgccctgcagctcggtgatggtgtgttcggcggctgcgaggcgggcggctaggtcgccgtcgcctgcggccgccccgccgctgtgcgctctcgcgtccagctccttcgcccgcgcctcgaattcagcggcccgctggtccagtgcggccctctcggcgcgggcgccttccagattgaggcgcgcctgttcctcccgcagctgcgctgcggcctcggcctcctcgagagctcgctcccgctcagtgagctcgtcctcgcggaggcggagtgcggactcctcttcggcgcaggcagcctcgtgcgccaccagcgttgcctcccggatggcgacggcggcctcgcgacccaccagttccctctccttcgtgtccagggcgcgggcgcgctcctccagcaccgtggcgcgagcctcaagggcctcttcgcgctgccgggacgcgtcgagcttcttctctagctccgccgcccggctcccgtattggaggcagaggtcgtcccgcgccgtgttgaacacggcggtggcaatgagggcagtctcccgctcctcctccacctccctggcgatctccgccaggtccctacgacgggcctcgagctctgaggtgtgccggcggtgtgccttgcggcctgcctccaccatggcctccaccgagcgtcgcccctcttcgacacgcgcccacgccgcgtcgagctccgcccgctctgcctgcaggacctccatctgggcacttaacccgtccaacaccgtggtgttcgcggcggccaaggcctgcagaaggggctccgcgcttagtggggcagcggaaggcgtggggaagagccgcctcggtaaggatgccgcacggctcggcccgccgatcgacgtgccgaactcgggggcgtcccccgaagcgggctcgtcccgaacgtcgcccgaggggtcgggcccgggcggcgcgcccgcggcctcgtcgtgggcggcctcggaagtcgttgtcgcctcgggtggagtcgggtcgggggcttggcaggccgcccggcgtgagtgcgccgcctccgtctcccggacgggctcctcggcccggcggagtctggcctcttcccaagcggcttcctcagcctggcgagcccggacagcctcctgggcagcttcctcggcttcccggaggcggtttgcggcttctcgccgatcagcttcccgcctccgggcctccgcggtcgccgtctcctcggcctcagaccggccggacttggaatggcaggaagggcgcgacgggatctcgctgaggcagacaaaaaacaggtgagtaaaaacttgccttgggagatgggagaatgaatacggccgtagtgggcgcggggacgaacctgcgaggaggtcggctaaacgaccaccttgggggggagatgaggtttccccggcatggttcggtcccccccatcttgcggagccgcttcttttttcgctccccctcgggctgcgacgtcggcgcagcaccctccgggcgcctgctgctggcacgcaccgccccgccccctcggggaggagatggggagggggtatcctcctgtttcctcttcccccgggcgtcggcagggcggctgccccccgggcccccgtgacggggcccagaagcacgaccccctcccggggtagattgttcccccctgcggctcccgccagcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgaagtcttcagggacccagtcccatttgaccccctagtgggtcctcatgtagtcctcggacccggtgtactcccaggcgccccgggcgcgccgctggagcggcgcgatccggcgacgaaggtaatcgccgtacaccatggcccccgtgagcccctaggatcacagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccacggctggaagtagcagccaccgactaccgacggtggcgacaccggctgtacggtgaagaaccaccggaacagccggagagatgggcgcaccccgatgaacatctcgcacaggtgcgcgaagatcgccaacgtcattaccgcgttgggggtaaggtgtgccatctggagatcataaaactccagaacatccatgaagaaagaagagaatggcaggaccagccctgccattgcgaagggaaggaagaatacggaccgccccgggtagtgtggcgccgggcgtccctcacctagcacaaccacctcccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagtgagtatggcaagggtagggcgcaggaaacggagagtcagagcacaagtggcgaaggcaataggaagagtggcgagaggaaggaaacaaatctcttcctcggcgtctttatacccttgccaacgctatgcccggctcctcgcttcccgcgcccactatctcgccccctcgtttctcgcgcccactcctccactaatcccgttcgcccgtttgcggcgcacgagacggatgtgcggccgtggcagtcgagatgggacatatcgtgcgcgcgttaactacgctcgccgaccgatgcaccatcatcacatcactaggcgaaacgaaccggttcgtcccgattcgcgcactactcaagtaatgtagcggtcttgaagaggccactcattattgtcgatcggtttctcccttgccgatgcgcgcgatttgcgaccgttaggtttctgcccgcctgtggggaccggccccacctgtcaccgggcctaaggagtggcatctcgcccgatcgcctccctcgaggggggcggtcgccctggcgtgacgccgggggctactgtcggtgacatggggccgggggtatcgtgactagaggcttgggtagccgcgatcactcacgtggcccgaccccctcgggggggtcgggcccgacggtgacatggccacccctccctctgtctccccgaggggtcgggccgctcccgtttcggccccgagggctgaggcgccccgaccccctgtagtgttggcgccacgtgtgtgggttaggtgagcatagcggccctcacttaaccacatttatagcgggttagacgagcgcgtcacgccgcattcaatgcggcgcagcgcatgcttatccggtttgtgaccagtcgcggcatgtgaccggtcacagaccggtcagatcgcgggttaggtggcaacaggcggcctgtcgcacgcctcgccccgtcccgtcggaatgatgagagcctctaggcactcgtccctagacggagctggcgtgggaactcctggagttagcacgtcggtcccggctagattcataccaggcttcatcgcaaccattacaaggaagtcattttatgaagaagggctgacgtgtggcatgctaaactgacgcgtggtagacaagaatgactggtttgtgactggtctgacgccggtcacgtcatcagcaaacaaccgtgctcccacgttgcacctgcttccggcggagtggaggttggtatgacccatcccatcggagggtcattcggacagcaaccattgcaaatctccacccattaatgaaggaaggacagggttatcccggtgtcaggcgaaggtacgagccaagttatggtcaaagtaggatgggtccccacccaaaagaagggtaggtagaaatggtgtatgtggtatccccttgagatataaaaggaggaccatgcctaccgagagaggggactgggggggggaagaaagggagaagaaaagaaggagagctcgaaaaaggaagagcggagctcatagaggagagaaagagggagagggtctctagagtttgaactctcttgctctccagctctttgtaactccttcatacacagatccaccagaacacaggagtagggtattacgtttctcagcggcccgaacctgtctacatcgcccgtgtcttgcgcatttgctctctcgcgaaacattccacagatcgagggcttagaacctcacctagcgtcccccgccgaaccggcaaaggggggcccgcgcggtctcccggtgaggagccccacgctccgtcaaggtgtgtatcattgcatctctgtgaaaagaaattagtgcgcaatttacgtcatagtagtaaaaagtacaagtaatatgcaattttaaccgcacgggtaacatagaaactgcactattaatttagtttgtgagactattattgttgttagctctcgtacgaaaaattaacagttaaccaaaaatcatatgtgttaactggctacaaaatagggcataaaaatatataatatttatgaaatacgatacatcgtacataacatgcagaataagcaatacaaataaataatgttcattgcagtacaaataacatgaagaataatccaaaatcacatgaaggttcagatagggttgccagtgaactgaaaaacataatgttcagttgtactcgtcatcatcgtcatggtcagtcgtagtcatagatgtgccacctcgtttttttgtagtttttttcctttgtcctacggcatgtcgcgggcctgagagtgacagacggttcggctcatggcgctcacggttagatctacgcgggtcattgtcgtttccttcgccaacctctggttgtatgggctgtgtcacttggggtgcatcatcagtttgtgaagtgcgaagctcattgggtaccgatgacgaccctccaccgaagcaggacatgtcgccgtacgatgtagtgtaaggcctaaaccctgacattagttcagggcgaaatgaccctacagaaaaaatgtagatatcaatgaaattatcaaagctggagcaaacaacaataacaaaaaaaaatccaaacctgttgacggtgcttgcatatatggaatttcattaggatgcgaggaatattgaccaaatagccaatcaccttattgcaacaagtccatataaccctgtactccaccaccaaacgacgtgccttgcacccatataaaatgtcacggagttatttcttaagttgaggtggggatcatgtatggcatgaaagtgccattaatatatgtgtatggagaatgatggctgtgcgtaccaccgtaatccatggattgtccttgccatgggttggtgccatatgtaggtgcatgcagtggaaccggctgagtaggccctgttaatatcaggaagtaaatagtcaataagattcatatagatgaaaaagtaataaattgaaataaaaaaaatatgaaattagatgtaaggggagattgaccgcctaacgacgtaaaccctccttgaccgataaaatctgcagacatttggggtatggtagggataccttggctagtccctgtatgtgcaattagttagcaaaaagtttaattacgagtggacatatgcatgccaatatagtactgaatgtacacgcacctgcaaatggtgcaaatcctccttgccagtgtgaggttggcacatcgggagccatttgacgaatcatttgtggcctagcaggaggcatatgaggcacgggacggaccattcgcgttccctctgtcatcaattggaaaacatcatttagttagtttacatacacaattgggaaaaaaattagcatattgatgagctatcccgtaccagcaaacgacgcactctcaccctgccattgagaggtgatgggcgtagagctatatgggggtacccattccggttgtgctgcgaacgtataaattagtctttaatataaatggcatttattttagcattatgcaataacgtattttaccttgagttgaaccaaagcctcctaggcgttcagaaatttcagtgatttttgggatagtcggaatagtgggtggctcacgaaaggaagttgaccttactcctacacgaccatcactggatcgtcgcgcggatgctgaagggcgggatgaggtggacggccgggaagaggtagagggacgctcacgcattggctcgaacgtccttcttgatgttgccggattatagatgtccgaggaatgacggcacgatgcgaggcgcatgattcgctttccttttcggcggagggagtcgaccgcagccattacttcctgattcgtacccgccattccatctctaagcttctcccataatgttttcgcctcctttactagctcccctgcaatgtcggtctgcatggagcgtaggaaaaattgttagaaagtggaaccccatgtatatggacacacagctgcaacgataaatttaaatgctagtagtaccgtcaagtgagcggggggtgctagctgcatatcatatatttgatcaattgttggtggacctcgctcgtcgggatcctccggtgcaagcagccggatgcgagtctgcgatgtgtaccaggccatgtattgtttgtaagtgttgtggtcgtatgccctggtctcatggacgacatcattcaaggcctgggaccacgcctctatccatggggtcatccttgagtgcatagatcgacaaaacctattgtcagcttgcctattttgcctgcaataaaaagacaacaattatgtgttaggtatatgtgacaatttgtagtgcacagaaattagacaggattgaaataacaacatacctgtgcacatctggtggaaggtaaagtccaacaggaactgggacttattggtacagtcccatctgacgcattaccctttgaacattatacccctcgacaaatatgtcgtacaccagcatttttcgtgtcatccagtacgcttcatcgcggtagcataagatgcttactccatgtggtgcacgcaaaatggcctcttcgttcgtgtacggagtccaccgaacttcgttttccctaaggctttcgaacgcctcggtgaagtactcgtacacattgtgcacctggattcttgcccactgtggctgcacgatcagagattgtagatttagttatgcagtaccattgaaatgacacaaatattcctttaatgcaagcatacgtaccggtccgtagcaccatcgagttccgaaggtaggacgatcatcaactgcgtcagtgtaatcatccttgtgggccacggccacgctcatgtatggacgtccgaacgagaagcgctcgtatgaccacaacatgaccaaaagtggacaccccgtgaaaatcgcctccctttgcccggtcttaatacaagcgtcgcagaaaccacggtatgtggctgcaaggatggctgatccccaggtaaactgtgtagaaggcgatatattaccttcagcaatttggcgagcaagggggattagcctggcgtccacagggttcccgtgcgagccggtgaacatgacccaaccaaacagccaaagtagataagcctcaaggtacaacgtcagttggtactcctggacatcgtcgggcatatatcgcacctaaaaaaaacaatgtgttgtcagatatgtgaatgtgaacagaatatgccttaattaaaaatattcaattacctcaaactgtgacaaccacttcaatgtggggccatgagtttctttttcagagaaaaatattttgtcctcatcatcgtctgtatcaccggtagcgtaccgtgacaaaatacaggcatatcgtgatacaatatcatctctccaatcttccggagggtccggaagtacaattgcctggccggctagtggcagccccgtgagcattgacacatcctgcaaagttatggtcatttcaccgcacggtagatggaatgtatgtgtctctggcctccacctatcaaccagtgccataagtagggacttgtcgatattttggcgtcgtttgctatgtgcccccattagtttttgtttaggttctcttgcgtcgtaatgcatccttgcctgcgtcatctgcacgaaggtaagaagacctgcagctgacaacctatgaggaaatttattagtcacattaggcaatgttatagtacgatatcatgatgttgcaaactttaaccatttatgcacctcgccttccatcgtcgatcaatcccctaccatccggctgtacgcggtatcaggacagctagactagagcaagaattcccatcatatatcttctttgcacgatgccgtgcatcgatctctttgctaagcaacgggtaaggccactcctcttccatatctgcatgtacatcatgaaggataaattagaaatttcatcaagtgcacatacggaagagtacataatgtatgaaattaaggaacaaaatttcctcatagtacaagtacaaactcgagcaatatcattaaaaccgccattacaaaaataggattacatacttggtaacaccttacaataaaatattacaacattatcataataaaataaatattacacgtaataaatgactaacatattaaaaccttattgaaataactgtcatgcaacgttacaaactaataggattacaaacgttacaattgtcatccaacgaacatttcatgaccgaacataaataactggacagtgtaggttataactactgcatgtttccttcctccctatcgtgagcaccttgagagccccttctattcctcctcgcacgttgttgcctaggttccacgggtgaagatgtaccctccttgttattcttgcaatctctagtgcggtgcccgtactgaagacattcctcacatcgcctcacaggccctcccgcttcggatgcatccatatcatttcttaagcgccgtgtttgtcttctacccttaccagccttcaacaaatccaagtctggcacatagatcctgttatcacccccagttttgactaggtgttggagggacctccacccgaggatctcagcactccatgcattcagaactctatcctttaggtagaacgtcgacacgtacgatgttgaatctagcttaattttagcgcatgcagccaggacatggctacatggcttatgaagaagcttcggcttattgcaagagcacgaacatgtgttatcagattcgtgccctagagtaacttcataagtgatgaccccagtagaagatccaaaaccccccttagtgcgacatgtgacttcccaccttcgtctaacgttcccagtggtaatgaccgtgtgaaatctggccttgttagccttctcttggaggtactctgccatctttttacagaaaggtgtttgtgtgttagacatttgttgcaacgccgcggcccgcctcgtcctcatccacatcgttgtcctgtgcataatgccttcaacaatagcagtcagaggcaaaggccttaatttgcgaagaaccgcattgtacgcctctgcaagattagtggtcattatgccatgcctagccccattagtgtcatgcaggagtgcccacttatcattcggcttgcactcaatccaatgggtaaaacattttatattctttgatgaccgacgcttctttccatttgatggaataagatcatccattggttccagggcctgggggacatgtacatccttcgggttgttgttcgtctgctttgaccgggtatgtgtccttgtcgcctcgtcaagttgtttccaaagctcatcgaactttgtggactgatttgtcttgcacaaccgcttgaacatgttcatcagccgccggctgttgaattgtttgaaaaaattggctcccatgtgccgcatgcaccaacggctgtgcatgtcaggccagtagtatgcaccatcaccatcctcctggagctctttgattgccttcaacagaccggcattccggtcatggatgatgcatatcgatgtgcgtttttgcaccactccccactttagatgttgcaagaaccaaaccagctttcgtagttctcgctttcaacaaaagcaagagctactggaattatctggttgttcgcatccgcaccaacggctgttaatatctggcctcggtacttcccagttaggaaagtaccgtcgacacacagcaccggcctcgagcactggaacgcatgaatgcatgctccgaatgcaaagaatgctcattgcatcacaagataatttggaggacgaattgactcccgatcctgcacagcaacataggtcccagggttcctgctctttagaatgttaagcatctacggcagagtgtcatatgcttcctcaaatgtcccatatcttttctccatggccttctgcttcgccctccaagccttgtcgtaactaattatgtattgttcacctttctccaccagttttattatgtgccgcacaggcaggtcatcaccttcaataatttccttgtagtacttgttcgcgacgtatgccgcggtcaggttgcggtgcgactccctagtgttccgaatcagacaggagtgttcgtgcagttttgacacaatccagtaagactcgtactttggcacgtgaccatgaagacggaaggtgcaaccttccgtctcacagacgaccgtgtactcagtcttgttagacttcacaaccctgaactgcctttgcgtcttgaatgaccatgacttcactgcatcttgcagccccgttttatcacagaacattgcacccagattgatttggccattcccgtagaaccatattgaatcatgacaagagttttctgcaatataaccagggtcttcttggttccacgaagcaggcataggtacttcctcaacttgttgttcatcttcgtcatcattctcttcagcagcgaggttttcctcatcttcgattgcatgtcagtccaccctctcaatttctttgactatagcaagtatgtcctcccctttatcggcttcaccagtaggatggtggttgaccacttcatctccttgtatggatagattttgaatgtcaggaccaacatccccaccacgatgggaagctacaacttcatcttcttcatgtgaactagaccccaactcctcacggttgctggattgccccgctgcgctctccgtggggactcttccttgacatgcttgcaccagcatgacatattcatatccccgtctcctacagccagcgagccaatcctgccaggccttactccgtgtcacattttttaactcccatcttatgttgttggccgatcggctccacataaccctcacgttaacactatatatacccgaatctaaagaaaatgtgcacgttagccagtacctaacttcgggcatggtaagggtgtcaggatttggatggtgtagtgtgcattgcctaaagttgctcagatcgacaccactttcattttccagaatttcaccttcaccgaaatacactataaatgccgacattcctgccattgcagacaacacggactagtccgtaaggaagtctaatagaataaacgtgtcctattcgcgaccaaaattagtttacacgcatactgtttttttgataaaaaattctttataaataactacttatttatatttccatattatttataaaaaaaatcatgtacttctaataaaaaatttataaaaaaataattacgtaaacataaattatttacttacgaatacatgacaatgcaattcattatttataattttaccacaactttgacataaaaaatatacacatgacaataaaaataatacatattaattaattaaaaaaacgtaattaaacataactatggcaattaatttatggcaattaatttaagtaacagagtatgtaatactcaaaacaacacaaccataccatatcgtacaaataaatatgatgacgaaataattaccttcggttatcagataacgcctactcccttttaaccagcttgctcgtataacaattgctgcctcaaagtttagttcactgcataatccatatgtttaactaacaaattaattatacatatcaattaattttaatacaacaaatgactacttgcaccgaagaaacattgacggaagctaagttaaaaatcatttttgttagctctttctgttctttatctaggacaatgacactcattgagccgcatcatgttctttgctacggacggtttgtacctacttggatatgacatccgaaacaatactactactgcaaatttggatgagtacatttattatattactactttaactataaattatctaacggacaactttacttaaatacaaaatatttgtaactatctgttagtacaaaactttttgcagcgacataaatttatttaactgcactttaattacaataccaaataaattacaaactgtctattaattacgaactgtcttccattatattaccataccttgttgtcttgccttcttcttttgaaccaatgtgctcttataaaaatcccaatttcgaagttcttcgtaattattgcatttatttgttcgttcgtaacaacctacaatgtaaagcacgtgtttaagcacaccatatatatgcacagctacttaacgaatatttataccttttccatttcttacaaaataaataaatgcatgaaatagtaagtaattgtaacttaaaattactacaaattaattacaactttaatttttgtaccacatttaataattatcaatactattaatatcaatatcaataactacgaatacaactattaatattttagtttttttcatttcttacatataatattgctcgtatatataaaattaaacatcacatgaactactaattaattataacttataattactactacgtacaaattaattctaacttatattatacatttaacctgaatagactctattaactttctacatttctattttcacatacgacctaacaaaatataatgtagttatacctaatacagacattagtttttctctgacataactacaaataaatattaactacgtgaactaacaatttagaaatcctcgtcgtacgaatttatgctaatagaaaactaatcaacttacgtgttttattttccttctctccactgcatgcactgcctcctctcctcttgctcttcctctcctcagttcactcccttctgtctttgctgtgtgaggaccatctcctctcctctcaatttaagcccgtgagggcattggattccaacgctagcggttacaaatggccggcatgatgtgactacaacagtaaatcgataagacaatgcacagagctcttccacctctccctaaagctaacccgtgcaaaaagcaaaaatcaaatagggatgggaaagaaaggcgttggtggagaaaagcggcgacgctctcgcgcatgcggagcgcgataccgaggcggtctcgcgcatgcgtaccgtgataccgcgcctgctgccgcgaccggcgcgcgcaaagcgcgacaccgctttcggtctcgcgccctaaaagcgcgacagcgctgccccacctcgctcctcgctctcgcgcacgcggaaggcgaagccgctttcggtctcgcgccctcaaagcgcgacagcgctgccccacctcgctcctcgctctcgcgctcgcgtatagcgataccgctttcggtctcgcgctcccaaagcgcgacgccgcgggcccactgcccttccccaggatttctctccctcgcgcatgccgcgtcagcactctcgcgcgcgcaaagcgcgataccgcgtgcccacgtcttccctgtcgcgtcataatcggtctcgcggttacatataacgaaaccggcctcggtctcgcgtaaccaaagtgcgagaacgatggctccgcccgaggtagtcgtggggatttctccacgtggcgctctcgcccctggaaaaggcgataccgctatggtctcgcggctcgcttgtgcgagagcgccagcttaacttcgctatcgctttttccgatcgcgatttcgcttcgctctcgcactttcaaagagcgaacatcggtatcgctattccaaaaagcgataccaatggtttatttccacaaatcgttcgctatagagtatatttttgcacaatcaatccataaacagtataatttcaaaaaattttccagaaatatgagttcctgtgttacagtatggctaaatataataggaatatatttattaaccataaggaactcctatggtggaagaagatcagttagtgtggtgaacatgttatatttgctttcactactagaaaaatatttttttcgcaacgttacgattttatttttccaggtggattacaaaatcaccgtttgtaaaaatagctcaagaaatgcaggacctcaagtccaccgcttgcaaaaatccggcacccacgcgctacccacttccttcactcacaggttgtgttcttaccacaggtttcccaactcatctccctcgtttttcgcgcgcatacttttcaaattgctaaacggtgcgttttatgcaaaaagtttctatacgaaagttgcttaaaaaactcatattgatccatttttgaaaaaaaaagctaatacttaattaatcacgcgctaatggactgtttcgttttccgtacgcactattcctaatgggaacaagctggagcgaacacaacctaagtcctcaccccctccacccatccccccacctctcccttcactccctcaccttcatccctcccccttccctccccctttacttcctcacccctcctcttagatccagccagcgacatggaaggtggaggcaatggccacaacaaccgacggcgcggaggcgcgtggcgaccaggaggagacctggcggcatggaagacaacacagtagccggcggcacggaggacagcacagcagccagcaacgctctcctcccctcccttcctccctcccagatccggccggaggaggagagacgacggcggacggaggaggagcaccctagatctagcggtcccgagcaccgccgctgtttgatctaaaggtcttgagtcctgccgccggtcgtcttcccgctccacctcttcttcgagccgcatgccatctctggccagtcagatcgaccagcggagagcccggggtcactagattcagccggtggctcggcctcgccgtcggccgatgcggcagtgttgccctcaacgatgacagcttggtcgtggagggaggcgatgacagtggcgccggagagagggccagagagaagggtagtgattaagggagaagaagagagagcgtgagagaaggcgggggagaagaagtgaggtggggactggagacttcgagagtcatcaatgggcggtggcttttaatatggtagattcttctttacactagcggtcgcttaagaggtccgccggcaaaaatagggttatttttgcaaagtgacttcctatgcaaccgtgagcaagaatggatttttcactgacggtcctaaacccttcaccaacccttcacccctcgttacagtttcgcacgcggagatctcatgtaaccgccatcagaaaaaatagggtacagccatgaaaaaatcatttttctagtagtgaagccagatacctgcaatctgaatctgatttggaccttgagccttgtaattgtgccgtgggctaagctcaatgggtggacgccctagggctaaccctattatgtccgcaatcatatttattcaatggccatcatatattagagtcaggttttgcttagattaatccatgtcatgcattttcgccgctagtcgatttgtgaaacaccaacttcgagtgcttaatcattcatctgtaattttagttgtaatctacgttgttcttgcttgtgtttttttgattcgtatgcagggattagccttctcggcgaggttaaccaggtttcgacacggttgataaccagataaaacggggtgatgcgattgtagggttcagatcgtgttgatcgaaaaccggaccgtgtgtataagttttcgtcaaatcgatagttatctacatctcacggaagatagagggcccgttgccatcagcggctgtggaatccaatgaaaagtgctatcaaacttagagtatgtgtttacaatttggatcttgtatcatctacttgcaatcactattgtgactgtcagtagtcggtagcagctctcaccatcagatgcaaatcgaatggtccaagttttttttgaaagaaccgaatggtccaagttaacatataacactattcattgtaccgtagcaaataaatgtagcgtgggatattgctcatgatgttattgttgtataggagtggatttgaaccgttgatcacaaaaaatggacatctcaaaatgcatgcagtatttaacttgttgtgactgcactttaatccttaccatttgagttctatgggcccttccatatggacggtcaaaaaataggatgctactggtataataggagtacatgcccaattattaccttgtttacttggggaaaaattttgggtttggttatcacatcggatatacggacacatatttgaagtattaaacatagtctaataacaaaactaataacaaaacaaattacagattccgtcagaaaactgtgagacagatttattaagcctaattaatccgttattagtaaatgtttactatagcaccacattatcaaatcatggcgtaattaggcttaaaagattcgtctcgtaatttacacgcaatctgtgtaattgtttttttttctgtctacacttaatactttatacatgtatccaagcattcaatgtgacgggcgtgaacatttttgttttgggactaaacagtgccatatatactactattttttttatcacgcatattggcatctggcaagcccacaggatgatcatttgacttggccgccagttgatcccaagccaaatgtgccttttcagtttcccatacggcaatgtacgagtgcgacgcgctgcctttgcatgccgcaggcagggcgcaccccccaccacgttatcctcatgtcctgttccttccgcttccactcctccgccctacccgcagccgctgcacggctccacctctcccgcggactccggccgccaccgtcacgccgtcgcctgcacaacacattctcacccaccctttccatctccccgccctcccgtcacgccgccatcgccgccgccgccgcttctcccctcggtacgtacgtgcccaatcttgacagagagcgggttagtttagtttagtaatatctggttgcggattgctcttttctgcttctacctcgatttttgccaatccggcaggtctcgatcggcgagggacgtataggatagggaatccatgagggagggggcaagactgcgatggttaattgcttagtttggtcctatccgattgaaactgactgctggttgttcgcttcctcttcgttccgggattgcaggcgcatctcaggaggcatcggcgatggcggtgtccgcgtcggagggcgttggccagtacgatctgctgattgttgggcctggcgtgcttggccggattgtggcggagagatggcagcaggttaattattgctttttgtacccttttttttaagcattggtaccctttaccctgcttttctgctgtttctgaatatcaagaatttcattgtacattgccgacttgatgattaacatggttgaaacacataaagataatcttcagtggtgtagtgaagcaccgactagtaggattatggttatcttttccttgcttaacgatggtttctgaatggaattcctatttttgtttctaatgtgagggatggtatatatgctgaattgctgataatattttctgctttccttttctactagtaaagatgtaaaaatatgtctgatagctttgcatattttacaggagcatccaggttgcaaaatttttggtcatactgcaaccacagatcatcacagtgaattgactcaacttgggatcattccctccttgaaaggaccagctgttcagaaagttccgtacgttattttctgcgctcctccttatcggacagatgattacccaggagatctgaggtaacaaaactgtagtactcaaacgatgattcctcgtacatagcattccgttgcttctgagaaaaaaaaccaaagttcttttagtaattatgcaaatacacagctatgaattatagggcatcacttctgggattttcagaaatttttctttcaaccatctagaatagactaagtgagatcaatgaatgctatgttaatatttactgatagcagtcatatatttgttgagaagtagctgagcggtttgaaagctgacacatacttgtaatttggtcttgtgctaatattggaaccggatgtctgcttctgtagttctgtttggggagtggacacatcagtttcttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaatt

SEQ ID NO: 41476 - DNA, 923 bp, Oryza sativa
ctagtggatcccccaggtattaaaggattttcctgggattaaatattgcttttgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaaacctacccctcttaaacggaatcttgaccccgagattcggaggagctggtgaagaggtgcggatgggcggcctttagctcatcttccctttcccaagttgcttcttcgtctgagtgatggctccactgaaccctgcagaagctggtgaccttattcctagtcctcctttcactggtctcaaggatacgaactggcttctccacgtaggtcagatcctcttggatgtcaatgtgctccgagtcggctcgttcttcgggtaccctcaagcacttctttaactgggacacatggaacacgtcatggataccgatcgtattggatggaagttctagctgataagccacttctcctcttcgttccaagattttgtatggtcccatgaagcgtggtgccaacttgcctttcgtctggaaacggtgtactctccggagcggagtaacacggagatacacgtaatcccctgcttcaaaagtgagttccctttgacggttgtccgcgtagctcttctgtcgagactgggcaattctcaacctctctctgatggttctgactttctcttctgcttccgttaacacctctgttccgaacagttgacgttcgcctgtttgatcccagaagagaggtgtgcgacacttccgtccatacaa

SEQ ID NO: 41477 - DNA, 2835 bp, Oryza sativa
agatggatattcggtagtggcggcatgctgatctgttgtgttgatgtttggtcagtgatgtgctgtggcagcggggccggggatgagactcgatgacgaggcgagggagtcaaaggaagaacatcagcgagggggatatgggtggtgattggtgcagcacatggggaagggcgatgcagcttggcacgtcacacagtcgggttcgacctgtgttgacgcgaaaaacacacactggcctgggagatctgcttagctccagtacagtccaaaggttgataggatgcgggcgtgccagtcaatttgaccctgcaactgacaagatatacaaatagcagatcaatgagccgatcggctgacaagccaatggagtaattccagccgatatcgatagggttttgagctattggcaatatatccaatgtagataatgatataaaggcagttggctgatgatgatgcaatataacaataatataatccagtagaaaaaccaatcggctaacaatatgatatcatagaacaagtactgatccgatggttaaagcatacatcggctagaggtccgatatcataaaatccacgagattagataaatcaatgaaacctctgttgtcatcggctaaatccaacttatatgtatatgcaatccttataagccaatgcaacgtccaaaaaacttatcggctagtatcctgataaaacactagcatgaacctaaccgatttatattatcaacaatctagtaggtcgaacctaaccgatgcagcacaagattgtatatgataatctaatactcgatgagccaatagatctgtctaatgtgatggatagaacaaatctatttacaacagcattgtgattgtagagatatgtcggctaagacagaagatcagacctaaccgagacagttccaactaaaccgatgtgtctctaaacataatgcaattagagatagaattgagatatcaggtaggcaaatatatcaaccaaaccagagcgatccaagagatcgaagcgatgcagccttgaacaacaccaacgtagccaatagattcactagggccggcggaacgtaggacttaccccttcgccggagattgaactgaaccgatgcagccccgcgtcaggtgccaaattccgccggatgataagtaaaaacctcgggaaagagggtggcgatgcgccgagagtagtattgatcgagagatgatttacaatgacctcgggtgtacatatttatacccatgggtagatactagtccttataggacaagaaagaaatttttctaaagataaaaggaaaacataaagtccttataagacactaaacacactttcctaaagataaaaagaaactaacaaactattcctaattaatagataactggcatgccgcatcctccttgaactcggtcacttctggataagcttcatttgataaattaattttcttaaccgaatatagcaggaatccaactattgataatgtgataattctcctaggggcttaccaaattttggcgttaacaacttggtgcgaaagatggtggcacagcgcgatgctggctcgagctcggccgagaggagcggtgcggggtcggccgagagaaacggcgcagtggggcatagcgtggactggcccgttgcgtgcgacactgctggcgcgacgcggagctgcccggtcgcattgcgtggtgcaacatgctccgtgggatcaatgagttggacgaatggcgttgcacaagttcagtagtgtgcagcagccacgattcggggaggtgcatcgtgcggtgtccgcgtgcctacacgataagatctatagccttgtcttttaatccctttcttaatcaccaagcagtccgcatgggcctagggcactcggcccaccccatgcttcacggcccaaggccttgccgtgtgtacctgggtaccatgtaccgcacaacatgaaacaagtgaaatcaaagttgacggagcgtggggctcctcaccgggagaccgcgcgggcccccctttgccggttcggccaggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagaccctctccctactctttttccccagtcccctctacgagctcaggtcttctccagtctttttgtccgtcccctctcttggtaggcatggtcctccttttatatctcaaggggataccacatacaccatttctacctaccattcttttgggtggggacccatcctactttgaccaaaacttggctcgtacctttgcctgacaccgggataaccctgtcctccctcattaatgggcggagatttgcaatggctgttgtccgaatgaccctccgatgggatgggtcataccaacctccactccgccggaagcaggtgcaacgtggaagcacggttgtttgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccccctaacccgcgatctgacc

SEQ ID NO: 41478 - DNA, 3183 bp, Oryza sativa
aataaataaatatctgctacttcatgttccagtaactcaatcaaaagcaaaagattagcaattaaatgggattggaattgtatactgtaaaaacaaacagtgggttctttcacagcacattgcttatttgcttgtagcatgatgaagattcgcactcaaataggataaacaccattttttgactgacgaacctttgatagcacattattcagttgaagcattatttaatgattgaaacccaacgtgatgtccatcatgataagttcataatctccattcctaacaacttgaagaatatcagagttgccagtaaaattaactaaattatttgttggaagctatcatataagagcccacgaaagcatgacatgttggcaataaaaagcatatcatgtgagcttgagaaagggagattgggagcccgatttgttgtttctgtcgtttgcacgctctagagtgcgaaggtgggaaaatagtgaggcctccagatatagggatggtggaaaaacagtgaggcgactgattcatgcaacaccgcgcgctcgctcatggcgcgaccagggaaggaccctcacgctcttgtattcatgcaacaacggtgtgactaaggaagctccatgagccctagcctctacatcacagtgccacagaacggcgagatggacaacaccaaaacagggacatcgctgattttgggtccggcgcgcggcggctgatgttgctgtcaccgtgatgcggtgccgagcggggaccgcggcggcaacagggagggaagcgggccgacttttcagtcatcgatgtaggttcaatggaagggatccttggtctactgctatcgtgaagctggcgcttccgcgcttcctccttcagggacaacaatggtagacacagttgtgggagaggggatagtgagggtgatatggtggtcgtcgatggcgagacggtaggagaagggatagctagggattggagcatgaggccatcgcaaggccgcagccgtggctcagagtggaggtgcatgttagggatatagtgggcgcggcgtgattgggggaagcgatttgctgaggatttagctcgcgtggaggaatttgcggtggcagggatcccatgtgtgggctgccattcctttgatttcacggtaggattgctatgcaaaacttctccttttttattagtatagatatagattaaaaaaaaactaatggtacagatgaaggaaaatccttgtgtccactactgcaaaccctcaaatgatcatcctcctttcaaactgaatacatttcttttcctataaaaatcatataaccatacaaaaataaatatataccatgcattgctttaatctaatgttggagacaagtaatcttgcgtcccgtggcaatgtgtggggcattttctagttctataaatacttatacttatagcttgtatcacgtgatcaaacaggttttcttttacatcatggtaaactcccttatagaaataaactgaaaaacgatttgcatcagaaaaattgcatggattccacggggaggcttctcagaagcacaagtttgtatgtatgtgacatatacatactgccagtcatatgacagtgtcataaaatgaaacttctggtgttggtaagggcctgtttgataggtgccacagtttgcggcgcctcaagtttgacgcgccacaggtagttagcatattgtttgtttgcttaccacatattagcttgccataagaagttatgtgctcatgaactactttgccacatgttttttggtctaagttgtggctctcaaatcgttcaccaaacttgtggcttggcaagttggagtagtcatccaaacaagtcctaagtacacctgattcagccatatgtttgatatagttgactttaaccattctctgataaaaaattttggaacaaataaaaatttaagtacctttagtgatagaataagttattacaaaataagtaatattatatattttttattgataagataaatgattgcattaaatattttttatgaccggagggagtagtaaactacggtagtaataataattagataaagtgaacaaaataaggagttcatttaatttcgtttgcttatcttaagctgaatttactagggccaaatcccaaatgcttgtcttcttctttgtcatggtcgtcgtccttctcctgcggccgcggcgcgaggggaggagaggaagcccagccgtgcaggcgccggccgtcgcggacgatgtcgctgtcgtggtagtcgtcgcggaagttctcgatgtcgtcgcacatgtcggagatggacgaccaaatcagctccttcttccactgctccgtccgcgggaagccgcagtggcgctcgccgtactcgtcgcagtactccaggtccaagaacaggtcgtgcgtctgccgcttcggcaagccggcggcctccttggcgcggttgtactcctcgacggcgcgcagcatctcccccggcgacggcagcgtcctccgcccggacagcacctgcgccacccacctcgcctgcacctcggcgaaccgcggcaggatcaccttgaccgggatgcccacgaaggagagcgacggcgcgagcgccggtgggaacacgtgctcgtacagcggcccgacgcggttgtcgtcgacggtgaccttcccctccgtagatgacggcgtcggcgacgacgaacgagccgtcgtcgaacaccacccggccgtcctcgcacaggtgttcgaccagtggttgcaggtgaaggttgtcgtacctggcgagcatcttggacatcgacggcgtcatggcctccttcgtcgacttggagctcaggtgcacctccttggcgacgcggaggagctccagggcgacttccttaccgctcaagttgcaaccaacgatgacgacgacctcgccggcgaaggagtccgggacgcggtacgagtggctatgcagctgcctcctcctccacttatccatgccgtcgatgcttggaagccttggctgggagtattgcccggtggccacgacgacggcgtcgaacacctcctccgtctccgcatcgccgttgtgcttgctcctcaccgtccaccgcaacgagccgtcgcgccgtggcggcgccatgcgacgcgcacgaccgtcgtgtcgagcctgacggcgtccataaggccgaacacgtcgcagaact

SEQ ID NO: 41479 - DNA, 5615 bp, Oryza sativa
acgggaagtcggagaagccgcagacctccctcgggctgttgagacggagcgaggagtaaatgctgctgtgcacgccggccatgccgagcgggtcgcggccgtcggtcgccgcgtcgtacagccactgcccgccgacgtcggcgctctgctcgagcaccgtcacgtcgaggccctctcgccgcagctcgcgcgccgccgccagccccgccatcccggcgccgacgacgcacaccttcttggagctccaacccgatgatgatgatgatgacatcttgtccaaatcttgctccctgattgcattcaacgcggcgacagctctccaaatttaatcggttgccaaatctttttcccaccaagcaacaaaaatatctcaatctccttgatgctagagatgccatttggtgcctcttggactacttcaatacctgtttatcatttttattaagataaacacaaaacagctacaagaacgaaaggaattgacaactttacatcaagaatcaggctcccatcggatggcctattcagccaaaaaaaaagccaaattttaaattttcaaacttaattttgatattaattttgagatattttcaacgtaatttctttttcagcattgacttttaagtcaccaagaacacatctataaaaattttatatacaaatttatttttattccctaataagccccgttttgacttattagagaaaaagccaaacgatggggccgtcatcatcattggtgaacagttgagaagactatatacatgtaaaaaacaaggtataatggaaatctcaaatcatcccttagggtgtgttcgcccatccatgttcccaaccgaaatatgcgcggataacggaacggtcaattagcgcgtgattaattaagtattagctattttttcaaaaatagattaatttgattttttaagcaactttcgtatagaaatttttttgcaaaaaaacgcaccgtttagcaatttgaaaaacttgtgcacggaaaacgagggagatcggttgggaaaatagggtgccaaacacccataagagatatccctttttcatgtcacttaaaaagtcattaaaaaatttagtaggatagattaatatatgatatgtcacttcacaaatatacatattaaaattaaacttatacaagtaaaaccaaaaataacaaatttgactatgaatagaaagcgtaattcacagtcaaatttgttatttttgtttcaaattgtataagtcgaattttaactcgcatgtttacaaaaagatatatcatatattaatctatcttaataaattttttaataactttctgaacgccatacataaaatgagaggatgtcccctcaaaggacaaaaatccatttccagggtataataagaaatcttatacgatagaactattccttttacaaaacatgaaccaagggaactctaggagttatcagagtgaatcggcaacttttgtcctatcaacaaaaaaaaaaggaatttcgatcgtttaccaaaagaaaaaacaataccaataccaaaagaaaaacggggctaccaataccaaaggctggcccagcatgacttcgaacgtgtctatacaggatggtcccacagctaccaaccgtgggctcgggccgttcgtcggtcgcaccagaatgcaaaacctggtcgaacccaaccgccttcgtccggtccggacggatccgaacccaaagtcggcgggcgggatgcctcaaacccatccccgcctcgttggcgggaacggagccccgcccacttccctcttgctaaatacgcttcgtacgcgtggtcttcggtaggccaccggaactgtgaccctgacgctgggacccactgaggaaaggctcgccatggaccacgttcacgggagaatccctcgcgctcgtgctcccgagaatttcatttcgtgctgcattttttcacatgcatccctgacacgtcagtatttcgttccatagcctccgatcggctatgaaggcacttccacttttgccgctggtagtatttctttttgagacagacatatcttttgctgctgtcctcgaggattttgtagccaagcccgaaaacttttgggaaaattagtatcaataatgtgcttttttgcttaattaaaatttataatattttctctacgagttcacatagttatttttcagttaggactcaatagaagcaacgaggcttaattatgttgaattccactagagattacttttatttgcagtactagtagaatttagaatgaaataaatagctaatacttcagaaagtcacgtagtttgcattatgtcctggcaaaaaaaaaaatcaaaattttagaacgaatgtaagattaatatgcaatactgcaatagaaaaggggcaaaatgcaaactgccaaaaaattgcggatacaaggccactcgtataaattagctgcgctctcctcccttttcccccaaatcgctcggtccttcgaacccccaccgcctccgtcgacacattccgcgctcgaatcgaatctacgaaaccctagcccgccaccgccgccccaatggcgaagccggtgaagtacgacgaggaggaggaggaggtctcgtcctccggcgaggaggaggaggagcagtcggacggcgccgggtccggatctggcgaggaggaggatgaggaggaggaggaggcgcccgcggcggcggccggcgaggcggctggtggggaagaggaggaggtggatgaggaggagatcgaagccgtcaccaccggtgccggcgccgacgaggaagaggaggaaagcggtgcggccgccgccgcccccggggagggcgatgaggagtcgcagtccactgaggacgacgaggccgtcgtgggggaggacgacgacgcagatgaggtgagctgagggggctagggtttgggtggtcgaaccgggattcgggtggtgcccattagatttataatattttggtaatatattgagctgcttctgtaaattgtacgagtttggggggccatttcctatgcctgcattttttttctagctttgcctctattttgttgtcagtgaattaaggttgtgttaacagtgggagtttccttgcattatgtgctgcaatgtagctgtcatttaagtgtcattctgtgtatttctacgcaaaattattaggagcaataagtagggtttagtttctgaattgtcgagtcctgcctaacttttcccattacaggctgaaggaggtgcagtagtagggaaacgtgagaaagccaggctcaaggaaatgcagaaattgaagaagcagaaaatacaagaaatattggatacacagaatgctgcagttgatgctgacatggtttgctcctataagaatccgtcaatacaaatgcctttcagcacatgatatggcatatcatgtgcacataatttatttcaacctgctttgaatacctttgtgtatgttgccttttgccctgattaatatttttttaacagaacaataaagggaaaggacgattgaagtacctactgcagcaaactgaaatatttgcacattttgccaaagggaaccaatcaaaagagaagaaaccgcgtggaaggtaaaactggttttgtttgtgtagatagtactttactttgtgtgttcaaccatcctggaaattgcatagatctttgctgttgtttgtcgtgctgctggaactgggatataatttagaatgtgtactttgatgctggaatatgttaaaataattccatactgaaggactggtgtttcaaacgtacatggtaaacatttctgtttgatatgtttgtagatatcagtaattgttggtctcttcatctggttggtattacgaaattgtgaattaatgattttaagaatgcaacataatgtttattttaactatattattattacttcaatttgtgggattaaggaaattctgaatacatttgtttagccatacaattaaccttgcatagttatagttcttatgggcatttgggacacatcacctgctatttatgtgcagggtcataatatgtaattgattttaggaatcttgtgcctcttttttgatgttccatgatttgattgtctaacattggtaaactgtaggggacgccatgcctcaaagatgacagaagaggaggaagatgaagaataccttaaagaagaggaagatgcccttgctggttcagggggaacacgcttgctttcacagccttcatgtgagctcctttcccttcacaattatttgtaactgtatcataagagtatgctgccaccattctgttaatataagttgaataataaattgttaaaatgtaatatattttttgctctgcaggtataaaggggaagatgcgagactaccaactagctgggcttaattggctcatacggttgtacgagaatggtatcaatggtatattggctgatgaaatggtatgttagttgtgtactcctaagccaaagtcaataaaatgtccccaatatattattgaatgatactgtgcttatacttataaaatcatcattcagggtcttgggaaaactcttcaaactatttcgctgctgggctatctgcatgaattcaggggaataactggtccgcacatggttgttgcaccaaagtctactcttggcaactggataaaggaaattcaacggttttgccctattctacgtgctgtgaaattcttagggaatccagaagagagggttagtttacttagcctccgctctccaaccattcttatgaacaacttctgatgttgtactgaacattttgcattctgtttggtcagaaccatataagggagaacctattgcagccaggaaaatttgatgtgtgtgtcactagttttgaaatggcaatcaaagaaaaaactacactgaagcgtttcagctggcgttacattattattgatgaagcacatcgcataaaaaatgagaattctcttctgtccaagacaatgaggatttataatactaattatcgtctccttatcacaggcacaccactccaggtaggtctcccctggctgtgctctttttttggactgtagccatggtcaaagtaattatgttggtttacatcctcaagcatttttttgcttttattctgataattcgttgatgctatgattgatgtttgcagaataatctccatgagctttggtctctcctcaacttcttgttgcctgaaatatttagctctgctgaaacatttgatgaatggtttcaaatttctggtgaaaatgatcagcaggaggttgttcaacagcttcataaggtgagtaatataactcccatgctcaatggctcattatgctaataatttgggacaacctgcatagttcattcatgtaaattcttctatgaaggttcttcgcccatttcttcttcgaaggcttaaatctgatgttgaaaagggattaccccccaaaaaggaaactatccttaaggttggaatgtctcagatgcaaaagcagtactatcgtgccctgcttcagaaagatttggaggttattaatgctggtggtgaacgcaaaagattgcttaacatagccatgcagttgcgcaagtgctgcaaccatccatatttattccaaggag

SEQ ID NO: 41480 - DNA, 3687 bp, Oryza sativa
gctccttcccgtagtcgcgctcttctgcgtggtccccttctccttctccaccaccactttccgcggctgctctgccttcttcctcagctggctcggcgtcttcaagctgctcctactcgccgcgggccgagggcccctcaaccccacgcatcccctccaccacttcgtcttctcggcctccctccccgtcaagctccggcacctcgcatccgccaagccggccaaaggtgtagatccagctccggccaacgagagcgcggcgggcaagatcctcgtctccggcgccgtcatccccctcatcatctacacgtaccagttcaagaacgccatgagccggtaccagctcctcatcctctacaccgggcacatctacttctccctgcagctcctcctggccgtcgtccacgggctgatccatggcgtgctcgggatggagatggagccgcaggtggaccggccgtacctggcgtcgtcgctgcgggacttctggggcaggcggtggaacctcatggtgccggccatcctccggccttcggtgtaccgcccggtgagggcgcgtctcggcgacgcggctggcgtcctcgcggcgttcctcgtctccgggctcatgcacgaggcgatgttcttctacatcatgtggcgtcccccgagcggcgaggtgaccgtgttcttcctcctgcacggcgtgtgcacggccgcggaagcgtggtgggcgcggcacgcggggtggtggcgcccgccgcgcgcggccgccgtgccgctgactctggcgttcgtggccgggacggggttctggctcttcttcccggccatgatcaaggctggcctggacgagatggtgctgcacgagtgccagggcatggtggccgtcatggagcagtccggccggtggctcgccggcgccaccaatctcaccttcgcgacacgctgaccagaggaaatgaaagaatgggacgtgagccacaccattactacgatctgacgaaacctgttgcatcgcgacgattctgacaggatgctgccgtttgtgattttttccgatttgggaaattaaatactcgagccgttcacatggccagcttggacagcactgggtgtttgcatcgtctgggggtctgggctgtgatgccagctagaattatgctagatcgatcgtgttaacaggggttaaagaagcattgattcggttggaaaatatctttaccattttttattgtacgttttcagctttgctatttatcaatccatttgattttttttcttattatcagccacctacactattagccctagttttgaacaacaaaaacctactatgttttcttgtatcaatccctgaattaaaagttggtatacacatttatagctagtagaaaatttcaaaatgaatttaggctaaaatagtttaatatctttacaaggaccaatagggtcttatcctatcagataagtagtagcggaaaccaaaatagtaataggcccaagcgacatgcccacaggcagttcattaggggcaggacctatttctcgatgagccctctgatcatctgctgagtatggcatattgttggcagagtctccctcttctactactgttatgtttaaaaagggagaaaatagctatgtgagtacatagagtacttgcaagctaccactgcaacatgattaatgcacattggatttaagaaagggcttgattcttttgctcaaaaccagctttcataaatattttaacaaacatttgacctagccattctaacaagaaaacaacggtaagttttcttgtttaaccattcactgagggttgcgtccacattcctaagtcttacttgattcggtttatccccaggcacatttatctatatttctgccattggaccctacactaaccctggctagtcccaccattcatccattcccattcacgccctaagtcaataaaaagtatataagtctagttaagaacagtacaaatgacggcgcaaatggctaaggtaccgcaatcttatggtggccataatcctctaggtctatgcccatatgcccatataggaagatacgctcgtacttagatcgtttccttcctatttttctaactcagtccttaactaaccagggtcagcactagcctttgctggaatccaaacaaatcttcttgttgtgattaagttttgtttttccataaacaacttcacatgtgtctcacaagatagtcgctaccatagcgatcttcccaaatcacattatcacatggctaggcatgtgtcaataatttgactacgggctttaatatatccatggttatcaaggtaaaggtaagcaataccaagatagggttaatcaataattaggtacgcaatttaaatatacttcctccgttttacaatgtaagactttctagcattgttcacatacatatagatgttaatgaatctaaacacatacatatgtctagattcattaacatctaaataaatgtgggcaatgctagaaagtcttacattgtaaaacggaggaagtagcatgcagtttatttgaaaacaaaatatttcgcaacataggtacaacatgtatcaatcctgattattttctatagatgttcacttttctgtagattaaccatcaaagtttgtgttctaagtgaatgtactttattttccttagcttatatctagtggccaaatctcaggttgattgtttgttgctttcataattaacaattcaatgttttatccttttgaatgatattttccatgcttatggaaggcttaatgaactgaagtttgtgttggcagtgatctccatcagatgtcctgtctcttcagcaggtcgtccacgatgcaatcagcacatgaggcaacagttccctccaacccacctgctgaaggcttggtttgcctaatttgattgctacatgcgaatgaggattacgccgtgtagattgaggtgcaggtaagctccatttcttgctgtcaattttttcatgccatttttgtgaatgctggcgatgggggatttttgttcatggagcaacaatgtttttattttccttttgtcaggccatatggagatgcagtcgttttcatttacagcaatcctcaaatccaggttaatattatgtggattttatctcttttgtatacattaaatatggcatctacagaaccaggattttacctctttttttcttgcttctgttaatgaagataagaaatatatcccatgtaatcaattggggatcaatgaggtttagtttgttgtactgctaatgaatgccatgtttaatttttgaaacgttacttgttttgttagtacacatgcatggggatgtgaaaagatgactataattgaaatgtatgtgctacgaacaactctccatcatcaccatacgtgatcactgcgaataatatcttttgataaattgatctatgaagtttggtcggttccaaacatatatattatcacaccattgatttaagttgatctatgaagaacatttctttcttgatttatttatgcttcctttcacaaatttttgaccaacatgatatgattagggaggtgataaatgctgaccaactgaaaaaatgtcactgtattctgcattttggctcagcttcatcgttgtcactgcagctcatttttcagtagatagaacatattgtcactacaaactaaggatgccgt

SEQ ID NO: 41481 - DNA, 4869 bp, Oryza sativa
tttggataaatgaaaacatacctgaattccctctgcttataaaaaagagatagcgtggcttggtgccaacgtgcaagagcacacatttagcacgcaaggatggcaacgggatcgtaaacaatcctcggcgatatatatatgtttcttttttttgttactggaaagtatttgttgtatttgtcacactcacaccctttaatttgattttccaaccgaatctatttatgaactgtacagatgaagaatgtagcaaaacaattggaaggattgtgttggtatgcatttcccgtgatccactgcaccggcaccagcgacacgtgagatcctcactgctaccccaacttggaagatttgtgttttgcttcccagggttatgcctcaccagcactggcacctgcactagcatcaggtgagatgctcacagccattgcgcctgcaccagcgctggtgtccatgcatggattttccttgtttgctgtacttgtgtctccattgcttgatgtggcgcttgcagacgagtaatccctccatccctaactatttgacaccgttaatttttttaaatatatttgaccgttcgtcttattcagaaacttttgtgaaatatgtagaattatatgtatgcataaaagtatatttaacaatgaatcaaatgataggaaaataattaataattacattatttttttaataagatgaacagtcaaacatgttttaaaaagtcaatagcgtcaaatatttagggatggagggagtacaatccatgcccaccatgtgtttgtagaaatgccaatcaaataaaatgcattttattctccaaattcctaagctctcttttctcacacactcactccatgacaggtttcttaagacatactaattctcttggtatgcatttcatgtgttggatcagacttggtggcatgaaaccacaattcgaaggcatcattaaaaaaactgagtttatgatttgcggtaccgccacccgttgaacttggactgatcttatctctgtcacatatgtgcaccaaacgaattcagtttatgatcatcctaatgacagtagttggagaaaagagtatggacatgtaaaatttgcccctttgcattgagctatatattttcgcacaaaattttttacacttctgcttcaccttgctatgacctgtaggttgtcagccaactatgcaagttggcggtgccacactactgcaatggacacgcgccatctacaccattaacttattttcctgtcgttctccatttgccctgcggcaaggtactttatttatcggttatagttgtcaattgtaaatttacttgcatatgttgtatatgaagaggtatgcttgccgacattactaacttaagtttctggaggaagttagaagacaacgtgatagggagaggtatgcttccctcactgtatttattcatatcgtgcctagagttcagttcacaggaggtataaataatggaaaaagaaggttgaccgatctgattgaagttgatgcttgattctaaatgggatatgtttactgtgctctccagttcctcacaatttttaagcagcaatatgatagtatgctgtcatttctatttaagtaaaaaaaattgattactacctcgaaccacttgctttctagccttaatatggaccattatatctgcagtatatattagtgttagtttgacacctcaatcatattatggcctatggaacctgatttttggacttattgtgaatgtctcttgtggagatgacatatttcacaatctgtaataggtacagatatgtactgcaaaacttccataaaagcatcttcccaaatcccaacatatctttttctctgcagaacaatttagggcctgttttgatcccctagcaaaatttttcaccctgtaacatcaaatgtttggaaacatgcatggagtattaaatataggcaaagaaaataattacacaaatcacgtgtaaattgcgagacaaatcgtttagaccatggaactttaattttagttgttacctgaaaacttaattggtagtgtttacatcattacagaaatttgggttcaaaaatcttttgtgaattattgtttctttccaatgttacagtaagaataattattccatttgatatatgtcgacgtggcttgcacctacacactaaatagtttatgtacttattttaattattttcctcaaggaaaagtagtaagccactgacagctgtggtcggggtcaactattgacagccacggtggccagcgggcccacacatcagcgacacaaatcctaaacatggtttatttgctattcttaattacttaggacccacatgtcagtgtaatagtcttaatgaattgattaacttaattaccttcattagtcgctaatcaaggaggaccacatgccatacaaaggagagggatagggatttatgtcacgacacctgacatgcctggagatacataacaggaggtcgagccgaacatgcatatgaatgctaatccatcgatgctgcgcaagtctactcgggagagtaggcctaatagtaggtattattcaagtgaatggacccagtcgaaatgggttgggccatgtgtgagggagtgaggtccatggcgcgatgctataagagaccgatagggagttgagacagaatcgaacattgtagaaacatattctgaatactgaattcaaatctctccctgttctatgttgttcttccccaaatcccaaattccttgctacttctaccctcaattctgttcaattcttccttgttgcgacattgcaaatccagtgtcgtgacaaattggtatcagagcagtcaatcctggagaagccgcgctacacttcacggttgcaattgcaagtagtagcaatggagaaacagaatattgacttcggcaaaattctcggagaaattcaggaatcgctggtgtctctcaatagtcaataccaagcaatcggagactcaagcggctgtatcgaagttggatgtagggtgaatgggtggcgacctcaagtggaatccacaatctaggatttgcatgaagaggttggagatcttcgtcagcaactcgacctcatcggcaaatccaagcaggctgcttcgagcgcgtcttccccttgtgtctcattggcgggtgaggaaaggaaggaggctgctccgagcacgtctttccctcgggtcccgttgacgggcgaggaaaggaaggcgccattgctgccgatgccgccactgacaactcatttggccgcggcggagggtgggagcaaatgggcaatcggccaccacgttcaacctaatttccggggaaagacaccgggggccttagcgaccctgggtcaaaccccgggcaagggtacgtatgactcgaatcactttcagttccagaagtttgagcattcggggtttgatggtggggaatttgattctgattttggggagcgacaatacaattatagagtgccgaaattggattttcctaagtttgatggttctaaccctcaggattggcgaatgaaatgcgagcactattttgatgtgaataatacctttccggggctatgggtgaggatttcgatcatttatttcatgggtagagcagcatcatggctaagatcttgtagggcgcatttgagatttccaatgtgggaagatttttgcactgcagtttctgaaaaattcgatagagaccagcatgaggctttgattaggcaaatggatagtataaaacaaactggaatggtgtgggagttttatgagcaattcgatgaattgatgaatcagcttttagtctatgacccctctgctagctcaaagtactgacacactgttttactgaagggttacgtcgagagattcgtaatgctgttcttttacaacgtccaaagaatctcgagactgctttggctgttgctttgttacaggaagaggtgctggagaatcctcaaaactctagcatcaaggacataaagaagtctgaaggaaattcagcttataagtctgctgtgaagggggcatggccattaccactaccaccaggaaaaggaggagttccaattgttggccgttctgaagacaagaggagcactaacagtgttcgtaatccgagaacaatgtctgataaggtggcagcattgaaaacttacaggcgggctcaagggttatgctatgtttgtgctgagaagtggtctccaagtcgtaagtgtgctccatcagtgcaattgaatgttgtgcaacaattgttcagtctaatcttggaagagaacttgcaggaaggaccggaaaattcagatcaattgaattctgaaactggggaactaatggcaatttctctgcaagcagtgtagggatctgaacctgatgggactatgagaattttggggcatgttcaaggtaaagaattgctgattttagtggactcagggagttcggtcagttttgtcagtacgcagttagcttctggattgacaggattgcaaccattggcacaccagttaattgtcagggttgctaatgggagcaagctgaaatgtgaagcagtaattcctaactgtgagtggcatgtacaaggacatgtattccacacaaccttgagagtgttgcctcttcctaattatgacatgatactaggtatggactggttgaaggaacatagtccaatgtcaattgattggtttaagaagattattgctctcagcttacaaggaactcaagtgacaatacaagggtgtagtccgaactggctaagtgtaatatgatttctgcaaatgaaatgaagcaattccattagaggagagcaatggctcatattgttcagttgtgttccataaatgatcaaaatgtatctgacgaa

SEQ ID NO: 41482 - DNA, 1969 bp, Oryza sativa
acagaaggatgaaattgaagctcaagtaactgaaatgttgcaaaatggcatcatccagcatagcaccagtccgtttgcttctccggtgttgttggttaagaaaaaggacaggtcatggtgcttttgcgtggattatcgacacctgaatgcgataacggtgaagaacaaataccctttgccaatcatcgatgaattgttggacgaattggcgggtgctcagtggtttacaaagttggacttgcgtgctgggtatcaccaaatccgtatgaaggttgaggacgagcataagacaactttccgcactcataatggtcactatgaatttcgtgttcttccttttggattaactagcgcactagctacctttcaaggagtgatgaacaacatactgtgctctctcctacgccgttgtgtgctagtgcattggggcccaaacatttgggtttgtccacatacaagaaagagagcttggcaataatgttggcagtggacaattggcgaccctatttacaacatgctgaattttctattcggactgatcgccatagtctggcatttctagatgatcaacgccttaccacaccttggcagcataaggctcttactaaacttcttggcttccagtacaagattgtttataagaagggaatcgacaatggcgcagcggatgctttatctagatatcctgaatctgaggtcttatcaactctgtcagtttgtgttcttatcgcggttacttgaattgttatctgctaactctaaaggttcttctccccgtcaagttttgaactggcgatgggtgcgcaaaggggcgaagtaggtggaacaggtgcaagtctgctggtccagccacgattcgtcggttgttacatgggagaatcttcatgaactccagcaacgttttcccaatgctgaagcttggggacatgcttcatttcaagggggagggaatgtcacgacacctgacatgcctggaggtacagaacaggaagtcgagccaaagatgcatatgaatgctaatccaccgatgctgcgcaagtctactcaggagagtaggcctaatagtaggtattattcaagtgaatggacccagtacaaatgggctgggccatgtgtgagggagtgaggtccatggcacgatgctataagagaccgacagggagttgagacagaatcgaacactgtagaaacatattctgaataccgaattcaaatctctccctgttctatgctgttcttccccaaatcccaaattccttgctacttctaccctcaattctgttcaattcttccttgttgaaacattttaaatctagcgccgtgacaatttatccccgttcttccttgtcacagttctctgcttgggcaaggcagagacgcaaagtgcgtgggcggcacgcacgccgggtgtggcggcgtggtcggcctacggtgccctgcgaggggtcgctggaccactccgctcgtcaagtgtctccatggtggcgttcatgcgggtggagacggcctgacgcaacggttcgaggtggctcgggcggtggtggtggcgcaatgaattcgagagcaagagcgcgcgattgaaaggggagacctgagttcgagataaggggcgaaagaatggattagccagtgaacactcaccttgcggcgaccaggatacagcgtgccatggattggggtcggggccatcatcggggcggggatgggcgtcgttgtgggcatggacgtcgtctccttctcactgtggcatgaggttcatcaagtcatgactgcaacgacgacgtctcctcgtagtcctgaacggcgaggcctcctctttgttccgactgcatggcgatggctcggttgcgggagctagttgcactcccgtagccgaaccgatgggcggggagttggagagggatgggggaggcctcgaggtggccggtgaaaagtggggaggatgaaaggcttgaggtgaagaagggaa

SEQ ID NO: 41483 - DNA, 3139 bp, Oryza sativa
taaaaaccgagtatagcggtacaataacttggctaggtgggtgcgctcatggtgcaaaagttgccacgccattgttccacctcagcgaaagtgccacatgagcatgcattgaccatctcattttacagaaaagtccctaataacttttatattccaattacttcttcagatatgtccgttttcctcctgtatcacaatgatcaaaccagtccatcttctcatccaaataaattctgccaactccaaaaaaaaaaatccaccacgatacagttcaattgtgaattcttcttcctcatgacctgcaatacaaaataattggttgatgtgttataccgcataaggaaaataatacactaagattatttgcagattattcaactaattatatctgctgacaagggtacaacacatctagcaagaatttctcattgccaatgtttctcttatatcatatacagttacaggaaacaccaataattacagtaaaaccaatctagtggctagtaccattagatcacttcattgaattgtaataacaaataacaggatattcaagtgaaaacccaaaaaaatgcagccattgtacagatcaatgaaaccttaacttcgaaatcatccatcaaatgaacgaaaaatagaaatctacaaccatcagcaagtgatttaccataacaagctaggagcagatgctccgaaaactcgtcgattcagaaccatcccaaagcttgcggtgaccacgtcgacagtagcaaattgttggcttgaattggtttggttactggtttagggcttgaactaatctagcacacgaagccctcgccgccgccgcgatgtaacggtttccctcgttgtcgtcgtcactgccgccgccaccgtcgctgcgccgctatcgccagcaccgcagccgcctctcaattaggaacatgtcaagaaagatggaaggagatatgcatacgtttgttctgtttgtcgagttaaaaaggaaatgtgattggaacaaaaaaaaaaagctatttggggttttctataaaatgagataggtctttcatatcaaagctgatgtggcaattttgctaaggtggaatagcaacgttacaattttttttacatggctacttttgcaccatgagcgcacccacctagccaagttattgtaccgctatgcttgattttcaagtttttacacctaatcgcacccacctgccaagttcttgtaccgccaacgcaatttactcaaaaaagattataggccgatagaaattaatagatagcaagtggtgtatacataatttctgttgcacgaaagacgattaaagtgtatggtccgatccaccaaccgtagatcatacatatctttttcacattggacatgctccacgacaggcccaactagagcaacaactctaggttctaggcttacataaacaaaatactagttgatgaatgtccctcccttttaaattgtgctcgcccaacatcaattatcgatgtgtcacacatcagacctagcaatctccctgtcacatcaacccatgtgacctcgaagactggttaaccaggtcttcttctccatcaaaaccttggctttcatacaacttgtgaaaatgttcaacccggctaaccaaccatgggctactcatatcacattgggtctattccaacacaggctcaaccggagtcaccactttaggtcctattcttaaacaacccaaaggactagtcttatgggtgagaattgccttcaccttttaagctaagctcttctatcatcaattatggatgtgagtctaaacccaacaaaaacaatctgctgctattggttgcttaaaaggcatataactattcacatatggatgccatactgccatcccagtcctagacaacgatttcttaacatcataattaaaatagagttttctgtcacaatactattaggacgactatgtcaatttcagtcactaattgacaacattgatggaatgaacatttattcagcaaattgtcgcctgagttacagaggcgaggtggtccagttgtcgtcttacactcccgcgcatgatcaacttatttagcccgtcgtctgagcttcgctcgtagtcactcgcttctcagttctctcacgctggccatcatgcaccacgccgtcgtcaatgttccggtggcggtcgccgctgccatgctctacgccctcctcgttgcctcccacctagctccaggaattggccgcctcctcgccctcaccccggtgcttgcccttctcctcaatatcacgttcgctatcccctgctttacggcgcccgcggcaccgcggccttcttcctcgtctggctgggtgagttcaagctcctcctcctcgcttcgggccgtggcccgctggatccctccatccctcctcttgcgtttgtcttcagcgccgctctcccagttaagctcatccgagtgccctctgatgatgccgtggtcacgaagcttgcgtctatgcctatcatgtctctggccatcaagcttgccgtcatggcggtggccatcttctacctcctccacaaaaagaacgagatccatggttatacggccttcaccatctacgtcgtcctcacgtactgcttcctcgacttcctcatgccgtgtgttgccgcggtgggcgccgcgcttggcatggagctggagccgcagttcgacaggccgtacctctctgcctcgctgctggacttctcgggaaggcggtggaaccttatggcgtcggcgatgctccgcccggcggtgtacgaccgtgttagggcccgcctcggtgcaccgggcggcgtgctctccacgttcctcgtgtctgggctgatgcacgaggtgatcgcgtactacatctccttccgcgcgcccaccgggcaggtcacggcgttcttcgcgcttcacggcgtgtgcatgtgcgccgagaggtggtgcgcgcgcaggtgcaggcggagcccgccacgggtcgtggcaacgctagctgctcatcgtggcactggtggagaaaccatctttggtcggtcggccgaaattcacaatagtcccggatccatttaaaaccgggactaaagatgatctttagtcccggttggtggctacaacgggcatatgtgatctttagtcccggttggtaaca

SEQ ID NO: 41484 - DNA, 11756 bp, Oryza sativa
tgttgttatattacttttggagctatgtttcacacatttttttttgtctccaaaactttgttgtaagttgatgagagagaaaatttgtgtggggaagaagaatatatagaaattttattctcatagtttaaaatatgatggaaattaatcttaaaaaatagacaacaaactaaattgaaaattaagagaagtacaacattaatattagtttagaacttcaaaaattgttaataagaattgcttgtcgaaagagtttttaattattttatcattactgtttgactgtcattattgtacgaaaatttatttatgtacgattttttttcatttgatgtagatggatcggcaatggatgtacgctgaccggcggtccaaagagtttatcgagggcgtgcattatcttttgagagtggccgaagctaacaagcgtaacggttttatttgttgtccatgcaataagtgtaagaaccagaaggagtattctgcatccaggattattcatttccacttgtttgagtcggggttcatgccaagctataattgttggacatcccacggtgaggaaggggttgaaatggaagaagatgaagcggaggacgagaacattcccgactgggctcagtacgctggatttgaaggaaatcaaacgggcgaggtggacagggatgctggcgataacgacactgcagatgatcttggtcagatgttgcaggacgcaaaggaggactgtgaaagtgaaaaggaggcccataaattagagcggatgttagaggaccacagaacatcattgtccccaggttgcgagcgggggcacaaaaagttggataccactctggagttcttgcaatggaaggcaaaaaatggtgttagtgacaaggcatttcgcgatttattgaaactcatcaagaacattcttccggagggaaacaaattgcccgagacaacgtacgaggctaagaagatagtctgccctctaggattggaagttcagaagattcacgcatgtccgaatgattgtatcctatatcacggtgaggagtacgagaacctagaagcatgccctgtttgtaaagcactacgatacaagattagacgagaggatccaggtgaagttgacgggcagccaacaaagaagagaattcctgctaaggtgatgtggtatttccctataataccacggctaaggcgtttgttcaggaacaaggggaatgcttgaatgatgcgttggcacactgaagaacgtcaacaggacgggaagctgagacaccccgccgatggttcgcagtggtgaaacatcgatagaaaatttaaatactttggaaagacgcacgaaacatacggtttggtttaagtacggatggcatgaatccttttggagagatgagcagcagccatagcacttggcccgttacgatgtgtatctacaacctccccccttggctatgcatgaagaggaagtacataatgatgccgattattattcaaggccccaagcaacctggtaacgacatcgatgtgtacctaagaccattggtcgaagctcttaaactgttgtgaaaaaaggaaggtgtccccgagtgggacgaagataagcaggaggagtttaacctacgagcgctgctgttcgtaaccatcaacgattggcctgcatttagcaacctttccgggcagtccaacaaggggtacaaggcttgcactcactgtatggatgaaacagaaagtacgtatcttaagcactacaggaaggttgtgtacatttgtcatcgtcgattccttgttgcaaaccacccggcactttgaacataaggcagaccaccgtacgaagcctaaacatcgcagcgggaaaacagtgtttgctatggttaaagatcttaaagtagtgtttggaaaggggcctggaagccagcctatagagagcgaagatggtcacgcggcgatgtggaaaaagaacactatattttgggagttacccttttaggaattcttggacgtctgccatgcaatcgacgtgatgcacctcactaagaacctttgcgtaaaccttcttggtttcctaggtgtatatggaaagtcgaaagatacactagaagcacgtaatgatctgaagcatatggaacaacgcagcgaccttcacccggaaccaaaggagaaaggaagccattacttgagtccagccagctatactcttagcaaggcagagaaggaaagtatgtttgaatgcttggagagcatagaggtaccgtctggatactccacgaatataaagcgaataataagcacgaaggagaagaagttcacaaacctaaagtctcctgactgtcacgtgttgatgacacaactgctaccagttgtaataaggggtatccttccagacaatgtccgggcaacaataacaaagctatgtgctttcatgaaagcaaatttgcagaaggtcatcgatccggatagattagaagcccttcagaatgatgtggtgcaatgtcttgtcagttttgagttgatatttccaccttcatttttcaatataatgacgcatctgctttgtcaccttgtcaaagagatcggtattctcgggcctgtgtacctacataacatgtttcctttcgagaggtacataggcgttctgaagaaatatgttcgtaaccgtgctcgtccagaggcaagcatcgccaaggggtatggaacagaggaggtcatcgaactctgcgtagaatttattgaagaccttcgcccaatcggggtacctgaatcatgccatgaagggagactacggggaaaggtggttctcggaaggaaagcaagaatgacggtagacaacaatttattccgtaaagcccatttcacggttctgcaacaatcttcattggtggctccttacatcgaggagcacttggctctagttcgcgccagaaacatcggtaagtccgatgcatggattacacggcatcacattgatactttccccgcgtggctacgacaacatctcatgggtaacgagacgattaaccaacaactggccttcctggcgagaggaccatctggctcgatcgcgacattctagggatatgagatcaatgggtacacattctacacgagagccaaagacatgaagagcacgaaccaaaacagcgttgttcgtatcgatgccatgggacacgatggaacaactggcacgtattacggtgccatcgaggacatatgggaagttgactatggtccactcaaggtccctctattcaggtgccaatagattaggttgactggtggaggcgtaacgattgatgacagtgggatgacaacggttgaccttaacaaggttggatactcggacgaaccttttgtccttgccaatcatgtaacgcaagtcttttacgtgaaggacatgtctagcaaaggaaagaagggcaaagggcctgacgagccgaagcgccacatggttttcccaggtgttaacaaccaaaattggtaatgtcagcatcggaaaggaggattagatcgaagtggagtcgaaggcggagatcgattcgagaacagagcaagaatcggctggagtccagatcggctatgatcaggatcggctgggtccgagtcagactaggtgagctgatacagccgattctgacaacacgacttggtgtacaacatcgggttgagtcgatatgtttcaagatgattgccgcacatggatagagtcctgagaagtcaattgtatctattaattaggatgttttatgtaattttcttagagatatatttagggcaaaagtctgccgcaaagacttatggtatcttagagtttgttagagataagagtcgtgtccgatatggacatagtttgtaattttcgggtataaatagacctcgaaactcatgtaaacaattaacacatatgttcaatacaatttggcgcatcgccaccttttaccttttccactttattttatcatccggcgggacttggcacctgacgcggggctgcatctgtgttcgatctccgactaaggggtaagtccaatgttccgccggcccgggcaattgtatcgtctacgtcggtgtcgttcaaggctgcatcagtacattcgacctcttggattgctctggtttagatgatatatttgtctacctatttatcatatgtctctattaatctagtcttagcatatcaatttagctctatcggctgcttctcgctttagggtttctgccggtatcggctaaatcgcgttgctagattagattagcctaggcatctaccaccctgaaaactcagtcaacggcttgattgtctagatattgtgtttcttttcatacttagtgctgcatcagttaagtttgatctactaagtcgtgcttagaaccatattctctagcctgcttcttgattgccaataagggtttcatcggggtttcagccggtgagttatctggacgttgcatcggctcataaggattgcatatacatataagttggatttagccgatgacaacaaaggtttcactgtttaatctaatcttgtagatttcatgacatcggacctccagccgatgtatgctttaaccttcggatcgatgcttatttatcatatcattatttgtcgattggtttatattagattatattgttatttcattacatcgttatcagccgattgccttcatatcattatctacattggacatatagccgattacttaaaccctattgctatcggctggtatcgacatcgactattatcggctatcggctggaactactccatcggcttgtcaaccgatcggctgttttgatctactatttgcatatcttgttagttgcaggatcaaactgattggcacgctcgcatctcatcaagatttggacctgcacaagagctaagcagatctcccaggccagtgtgtgtttttcgcatcaacaccaggcaaaagaaaaatcgttggagtagaggacaagactgacgaggattacaatcagttggatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccataattattgtgtacacgatgtaaactattttggatgtattgaatatccatataaatcaattgttgtatggcatatgttaattatgcatgattattagaatttttaacaattttaaatcatgtgtgtgttagttatatgctagttatatgctagaatttttaaaaatcatgcatatgctaattatatataattattagaatttttaacaagtttagatcattcatgtggtatttatatatgttaattagaatttataacaattttaaatcatgcatatgctaattatatatgattattagaatttttattaattttaaatcatgcatgtggtatttacatatgttaattagaatttttaacaatttaatatcatgcatatgctaattatatatgattattagaatttttaacaagtttaaatctttcatgtgcttattacgtattatccacttaatttactacagacaacaagaatttttcgaagtaattgtcattaatttttcgtctttaaataattttaatgcattatttactattttagaaacacatatgtaatgaaattcaatattcagtgctattatctgtagtcccggttcttaaccctaaccgggtttaaaaagaatttggaaatagcgggaaaatatctttagtcccggttgttctcaccaaccgggactaaagaactaggagtatatatattcccgatgcgcaccctcgtattctccaccaacacttagaagttttttccccgatctcgatcggcttctccttcgccgccactgcctagggcatccccgcgccgacgccgccgtcgtatctcgccgtcgtctcgcaagcgtcatcgtcgccgcctcctccgccgccgcatctctatggtgagagccgccgccgccttcctctctctctcgacctcgacctctctctctctctccaaaccgccgccacctcgttgccgacgccgctgcctctccccgagggggatcgagcccggggtgttgcggcggctgccccctcccagcttggggttgggccgcccccaaacccacgtggctacccccgaggggggtcgagcccagggtggcgcggcggctgccccctccaagctagagggaggaggccgccctcgcttggggtcgagctgccccgaccccctccacgtatcagcccacgtgtacagggcctaacgcccacctaactgcatttaaagcggtctatgcaaccgtgccatgccgcatttaatgcggcgtgctgtgcatatgaccggtctgtgaccggtggaatgaccgatgggacggcgactgtgtaccccggccctgtcagtgtgtcacgcggcgagcggcgtgcttcgtcccgtcgcatcataatgatgaggggcttcacagcctcttacccgggtcagagctggtccaaccactctgaactaacccgggttcccattttctggtgtgaacgagaacccggaagttctcatccattaaatggcgaatgacaagggcgccttgcatgatttgatgggccccgcgcagtaaccgacgtgcagatagcttctgggctaaggcacaagacatgtaatgaatatagagaatattttcccttctccctaggtagcactcgcagcacatgtggtatccccttagagtataaaagttggaccatgcctagcgaggaagggggatcggactgaggatccctgagccaaagcttgtctaaccctagcttgcataccagggattcagggactttttaagcacagaagaatcatacacacaggagtagggtattacgcttcgtagcggcccgaacctgtataaacctcttttgtttcatcgtcttggaggagcctccaagatcaagatcacacacagtttcgctcaccaaatcctcgaatctcacccgctacccccggccgaactctcaaagggggggcctcacagcctcccgctagagagggtcaccccttgacacgaggggacaagtgcggcggccagcgagccgcgagggaattgtggtcatgcatgctttatggatggaatgatggatcaatatgtgttcttactgaaatttttatgatgctattctaagtattcatgctattttttatggtacatataatatttgttcttgctgaattgatgattgtcttgtatttttggtgcagattggatggagatgctacctaatgtgggtccccggaagggtcggggacaggggcctgatttggccccacatctccagtcaggaccgggggtagggagtgaagtcgggggtcggggcggggccgttccagcccaacctgaccccgttgccaacccgaagtgtgttgccctctagtgtttggaatgacttagagttccagtatgagtagtagtttacccgttggggccggatccccgcctcaacggagcaggggcaaaatcttccccatgggtaatgcggggcagggcccaaacttcatgccggggatagggaagcatctccacctatggggaccctgtggggccctaaaggtctactattagatgaaggtggcctataccaaatcaaacccgcacctagcgtccacattaatgaggatatatcaagagaaatccggaccttatcctcaatgtccatggacccgatccatccgttccattacagccacaaccctcgtacctcaacctgtgctaaaggccccaaacatcggcacatcgggcactcgtgttatattgagcgctgccatgcttcttctctctcacacaccttgctgtgggccatggacgacctttgcctcgaaccatgccaccaaccgccggaacagaatgtcgccgggcatcggcctcaattatgcaccaggccagtagcttctttctctccatcaccacatcatttctggtcccgcacctcgtcttcgtccgctggtttccctccgcatggggcctgctgtggccggagccggggctgggtgaggcagccgggggttggggattgaggccattcttgcccaacctgtcccgtcgtaaactctatatgttctagtgagtacatactgaataatgcctttccaatggcaattggcaaagtagtgatgcgtctggcggtgaactgttcgtttaaatttgtctaattcagctttaagaaagtaccactacaatttggaacgggtctacacggccgggctactagcacattccttttaatgaatcatgactacgatttgttacgagtaattaagctataacacgtccaagtcggctttaaactatgtagtgactatatatccaggagtagaattacatgactcatatttaattaatcaagttgcataagagacgataaccacacccagtctacctgataaggcgaagaaaacacgatgacacgagcactgggcggccattggggcaacttgatgtaaagaagtcgcttgtcagctttcgtcgtcgcgtctctgtctagatttcaccaatatataatatttctcataacctattgtcaacaggaaactttaattacatagtatatagtactgactaaatacaaagtaacaacgtttccagcttgttgtcttctgtcggtacagtctgtacagatctaactagaatttgaccttgattgcacttcaagtttcaacttatttgcaagatttgtgagcacattgaaatatgagcgggtgctgatcgattttgaataccggcttagggaattttttttatcggtatcaccatatatcacacctacagttcgaatccaaaatgttgaattgaaggaaagggatcctctgacttaactgctgtgcagttgagtcactgacatgtgggccatagtaaagtgggacccacatgtttgcatgtgcattttaagttagaggatctgcttcttgaattgaaaagccggtcgatcgatggcctgaatttttaattttgtcgtggctaaagtgtagttttttatttgatctgacgactataaaatattaatacatcgtatatatattataaatgataaaatgtagtcatgcgtactagtacgtgcaactaattaatatataataatacacaatagacagtcataaactgtggtaatagcatagtcaacactaagaaataataatataatgttccacaacaaatgataattcatcctaacctatcacaaacactagggttgcgaactgggtgttcgtttattcattcataaatatgagtgtgcacgtatatatgagcaccgctgtatgtattgtatttcataaaagaaacaaaacgaattattgcacaattatttcaaattttaaaattcatatctgaatagtatgttgttaccaaatgggtattaacatgccaacattaaggtttcgattacccatctgtacctttcttttagattatggagaagtaagttttggtctatgcatcaatatgttggaattaatgaatgggtctcaacccattcgaagatttttttctttgaaaaatcataaaagcctacatcataagatggcatacatggcgagtttagtacaccttgtctattctaggagaaggagacctccctataagaaaggatactctcttagacactgaggcatgtgaggttgacagaaaaaggggaacacacgcacgctcttacacgcctggactggcctggcggcgcgtgtgcacaacatacgcatcaaattatctctatataagtcgagccgccgcctccacacaacacatgcgaaatcaaatttagggtttgccccctctatactatgtcgtcgctcgtagtctacaccatcccgctcgctagcgtgcactggcgatcgggagagcaggtctctataaccttcgcctttgacattctgcactgggaaaaggcggtaataagatttttgagaagcgctgtgtttctgtcatttttgcagcgggcatggctagcaaaggcctaaggctagccaaaaaacaatttttttttgtggattatactcatctgtgacgggccataacttaatgcccgattgagatgatggtcatctgtgacgggctgtagctaatgcccaattgagatgacagtcatctgtgacgggctatagtttaggcccgattgagattagtattatctgtgacgtgctctagtttaggcccgattgaggttagtagtcatctgtgacgggctctatttgtggcccgattgagataggtcatctgtgacgggctatagtttgactggtagtctgggtcaaagctatcggtgacaggctttaattagggcccgattgagataggtttatcagtgacggccgtttgcccaattgagattacttttcacatcagtgacttctagcctgtgatggacgccgtgcccgattgagatggggcttactgcccgtttgagatgagggtatccgttccagtgattgcttgatttccttcacttttttttaccaatatatatagttgattggaactatatatatttttgatttcttatctatacaaataatacaattgcagctaactccaatattcggtgtttaatcgaaatgattggatagactgtcatactcggcttctaattagaataaaggttgttgccagttctatacttctattccattatttcctcaaactaacgagaaaattgaaattcccatgctctaaccagcgaaaatgcacaccatcctcctagttagtccaagtaaagttacacgagcattttcagcaaaataacaagaaactaatgaagtcaactccagcttgcgtaacgtagcatgctaataatgcacgcgaaatttcagactccagttgttaattttggttgtttaattaccaaagcgaccgggcatgaagttgacttggaaagtcggaaacaatgtgtcagctcgttggcacacttatctatatccttctcagataagtacggcatattctgtccttttcatgcctctcgtccgttcttttgtcgtacgtaactcacggtagtcatgtgacatttcttcttaaactccgttgcattgccatcaaagcatgactatttctagtgtcagactttgtcaaccgtgggtgtggtgtgtggtctgctcacggagttaatttctcacttctcgcttgtactcctacaacagatggaaccaaggccacacgaagcaatatatgcattttccagggaacttttactatacctccagtggaggtgataatattaatagtgtggtagaaattggtgccggttctttataggtggcggttcttaccatccctccaaccgtttctgtatccattgagtaaaaaccaacacctatgttttaagttctggtttgaaaggatgttcgtacaggactataggtgttgggttcttcatcaaaaccgacacctacaataccatctataaagctgacaccgatgactttagtgtcgaccaattgatgccgacaccaaaagtaacacctacgtgaccttccgaaccggcacctataatacttcatatagtagtgaagtcctggtgcgctctcgtcagccgcccactacgccagattctcacacctgtgacgggcataagtattggtcagtgataagggtcacctttgacgggtcctacgggatcccatcatcggtgagccatccggcggcgacccatcacagttaactaatcacctgtgacgcgccaaaaatggaac

SEQ ID NO: 41485 - DNA, 5387 bp, Oryza sativa
tctcataaccctcccctctcctccgggctcatcgatccatcattgtcctctctctctctgtccctctcaaccctttctctctttatcgatctagttgtgtgtgggtcggaggcggaggcggcaccggtgggtctgcgggctggagggggaggcgacaccagcgggtgtgggggttggagacggagatggcactgacgggtgcgcgggccggaggcggaggctgcacgggcaggtacgggggccggatgcggaggcgcgcggcaccggcgggtgctggggccggatgcggaggcggcaccagcgggtgcggaggcggcaccggcgtcggcgccagttggaggcgaaggcagaggaggtgggagattggggtcggtgatgaaggccgcctctttaggtcccaactccgtccgcccctccgcctctagatccggcctaccggaggtcggtggtcaccggatcggaccgcccctgactaatgaaccctgagcttcactcgagacactcaaggcggttattggcccgatatttcggtgagttgtagataactacgatttgggagaaacgttgacgacccgattacaaccgtactagacattgttgtgttgcgccttagagatcgatacacctctccatgggttgttgatcttgccggtgcagatcatccttattcctgcaagcaaatcgaagaaacaagcaagaataagataaaagcaacctgaattacatataccaataataagttggggttctgtaacgagcaaaccagcgatctaaccgatcacgggattacacggcaaagtagcaaagctaaactttaatctaaacaaaacccaagaaatcctgaaggggtaccaagctatttatggagatgggaggaccctaggtcgtcctccacctggttggggcacaccccacatgggacccacttgggctagggtcctagacgaagttataagcccatatgcccattaaaggtgatgcagcactttgtttcctcaattgcggctcaatgagatggaatttcacaatgagtttgatccattggaaagaagactccgagagctttccatcaagtactacggaccgaaaacggatgtcgtatgcagattcagtggccctttgaagtcagcagtgtagcaagtggccgaatcagattccatcacttgggcatcttgatcttgatgtgagcaatggttgtatcaatggtagccttggtcacatcatcctccccttcttcagggaaaaccgtctcggtttttccatatggtgctcttcgcatagtccatttaaaacaacatgtttcttccaatgaaaacaagacactcgagataatatgattagcaataatatgtatctctagcttgtatattttatccacattgatgggaggttctaaatctgaacagatgtgaaaaactctatggaccaaatatattcctctatcatcagattcgccaaatatatgaaaaatagcactagttggatatgtcaaattagacttagcaaataatttctccttcaaattatcgagctcacaaaaatcatcaaactaaacatagcccaaagtatttaaagaagatgtcaattttcgttcctcaacttcagtagcaatgtgaacaacatgcttagaatcagcacataacgaaatattataaatagcatgttcattcactagttgtggcatggatataaatgaaacattatcacacaactcttctttatcacaaggaacagcaagtaattcaagttgtgacaaaggcatctcaacaattggttctactaatggttgctcttctctagcatgaaaagtggacatgttcaattcattaacggcacactcaccttgattaattgcagcaccattaatattacctgtggttctctcttcggatgatgtaggtgcatcagtcttctcttcttccttcgtgagcgatggagatggcatctcgatcatatttctcttctcctcacggtgaatgttctgagctccctacagaatgtcagtaataggaggcacaagcatagcttgtttctcccttgggttctttaacatattgctctcaacactgcaagcaagtatgaacaagtggcctatatgattatatgtcatgttaataagcccagcttgaatatcggaattaagccctctaaaaaaatctagtcattgtgttctcattgctttcttttaaaccactataagagatacaaattttaaagttatgaaagtactcccgcacggttttgtcaccttattttagatgttctaatttctcaaggagagtacgtttataatatgaaaacacaattttttttcctcatcattgttttgcattcatcccttcaagcttatggccaacagtataccaccaaaaagacgtagaaccggtacacttattactagcagccttaaccatttcagcattagagaaatcatactcatcaaattgtttgtctactgctagctcctaattaacataagcggcggaatcatacttacaatcactggcaaattagatcctacccttgcaagatcattatcatgtacctcatatacaatgcgtaaagaagtcgctatatctcgttgatggtgaagaagtcaatgttgagcatgaccatcttgtttctgcttgctcaatcctaccatggttagtagcaaacaagaaacatacaaatgaatatgcacgctcctatcaactactaggtagtggcagctgaaatatcacacactcaagcttttcaccaagctcttacaagttcttaccaaagcaagcggaatggtgacgtacacggacctcaaccaagcacctcaatggagtttggatgtatcgataccttggcaaacacttgctgtacggctgcaatcaaatccgtggagctttgggtaggcttaaatatgtagcaaaggaatagcaaatgctcaaatcagagaatgcaaagttgaataatcgttcaaagtcatgtaccgtgctggtcctaggctagaacgtactagagacgcgaccctagacacaaacgataccacaagatagcacaagaaacaacttaagcacactctaatatatgacaatctcaaggatacaactaatgttctctttttttctttctttctttttcttctttctttttttcttttctttttcttcttttttctttttcttttttttgtgcgactttttgtttctttcagcacctttgtgccttttctcactttttttatttttttagaaaaaaacgactcaaggatcttaaagcaagattacagggactcaaatgtaaatataaaaattacagggactcaaatgcaaaaatgcaaaccctaaaactcaaattatacaaaaatggaatgtggaatttatgcccgttccgttttttcaaattgatctcgaaaccgacaccaaacaaaaattcaccaagctatctagcaaatcacgttacccattgaaactgagacgagatgagagggagggagtacgactctcctagtcacggtggtggtgggtgcggggtggaaccatacgctaggtgggatggttcggcctttagatggaaacggggatggtccggcctttagatggaaaccgaataggtgttaatcaggaaaccgataccaataaaaaaggctttccccttcctccttcctcacgtatggaaaccgaatctaatctacaaaaaatctctcaaccttccttcttggtagcgcacacattcacggcaaaaaaaacacacgcagtatttgcaaacactagatgcaactcaactccaaaactaaccgacagaaacttctgaaaactacaaaaatagaaccgtggcaacgagccgattccgttttcgtaggtcacaacagagacttgggggcagcgacaactgtggtacaaaacgtgaccagaactcaaaactctaaacgaactagacgctaagaccagcaacacgatgtgacaatgcaacacaaaattcaacaaagcaaaaactgaaaacaaacaatgcaatggcacaatatggctaggtaaatgatacaaattttttttgtccagctattttttggttatgggtagaaaaaaaaaactcaccgagcaacgaaagctctgataccacctaatgaaccctgagctccactcgagacactcaagacggttgttggctcgatctttcggtgagttgtagataactatgatttgggagaaacgttgacgacccaactacaactgtactagacgttgttgtgttgcgccttagcgatcgatacacctctccgtgggttgttgaccttaccagtgcatatcaaccttattcctgcaagcaaatcgaagaaacaagcaagtacaagataaaagcaatctgaattgcagataggaattcaatatcataagttggggttccgtaacgagcaaaccggcgatctaaccgatcacgggattacatggcaaagtagtaaagctaaactttaatctaaacaaaacccaagaaaccctcaaggggtaacaagctatttatggagatgggaggtccctaggttgtcctccacctagttggggcgcaccccacatgggctccacttgggccggggtcccagatcaagttacaagcccataggcccattacaggtgacgcaacatcttgtttcttcaattgccgctcactgagatggaatttcgcaagaccgaaaacggatgtcgtacgcagattcggcggccgtttgaagtcatcagtttagcaagtggccgaattagattccagcacttgggcatcttgatcttgatgtgtagcgcccgttccgtcgtggcgcctagcgggaaaactatctcttaaaaaccctagttgcgaaatctgtttctttgcttattgtctagtgtccatgccatctcagatctcaaatctccgatctatcgtcgagttcaatcccgaatccaaatccttcccaaatcaaatccctccgcaaaagtctattttgcctccctcgggttcgatgggctgaatccctctcggcccatcgcccctgcgtgcgcggctctctctctctctctccccgctctgccgtgagccgcgccgagccctccctcccgctctcgctgccattcccgccgatgccgcccaaatcgccgcgccgcccgcgcgcgcgcgcgccgtgggggccgactggctagtcgccgccgccgtcagcgcctgccaagcctgccccgcgtctgccgcccgtgtcgccgctccactccaaaccggtccaccgtcatcgccgtcgtcatcgacccggccccgccaccgccgcgcgctagcttacaagggacggaggctgagccccgcccccccctctgccgcatcgctccctctgcctcctccttttcgccaaagtggcaaggaggcaagcctcctttctctccccctttttccctttt

SEQ ID NO: 41486 - DNA, 35012 bp, Oryza sativa
  unsure (1)..(35012): unsure at all n locations
tgccgtcccctctgtctcgccgatcgccgaccgccgccgtcacgtgtgccaaaggagtcggtgcgcgttaggacgcggaaggggactccggacgcaccctctccttcctcttccccggcccgaggccggagagatcgctcccgtgccgtcgacccatcgtcactgcgccccgtccgcacggtagtgcatctccccgttctccctcctcaatccatctcttccccttagttttcgatagtagcatgtgtagcctccccgtagctagccggcgccgccccgactgctgccgtcgctcaccgtgtgctcgccgccgtcgccgcccgagctcggaagcgcctctcgtcgccggcctccctcgatgcgattcctcctaatccggcgcaaggggtgggttcccgtagctgcgtagacgctctcgccgccgggaatcggcccctcgtgacctcattgccgtttcccccttctcccgccgccggttgccgccgccgcaatccgccgccgtcgagcatcccccggcgaatccgagccattggctcgtctcccctcgtcctgtgcaacatcccggtgtgctcgccttcgcctgtatcgccatggttcgctccccgctcgccgccgtcgtccgccgtccgttccggccggcgtcgtcgtctacctcccgccggcccgcgtggcagccacgtaggcgccacgtcggcgccacctcggccgcgaccgggtcaagtagaccccggtccgccgcttccctccgccccctcgcgcgcgcggtccaccgcgagccgtgaggcagcgcgtgggcccgccgcaccgcgtcctccgcgaaccgcacgcatgcgccgcgcctccctccccaaaccctagcacgccccgcgtgcacctcgctcacggtgagccgagtcgccgacaagcgggttccacccgggaccacgcgggatgcacccggcccaccggctctctctctcccctccccgcccgcgcgcgcgccttgggccgccttcttgggtcggccggcccattaagctcggccgagccgcccctttctctcgggccgcgccctagccgcccgaggaaagtctaatttccctccctccttcttttcttttcttttctttttcaaaaaggatttaaataaatcctttttcctttagacaaaaaatccaataatcttagaaattcaatatcttcccaaccgtaagtctgtttgactccgttcaacttccaaaattcctcaaatctcgagatctatctaatggcacgcttagaggtcaataatagggctttattttcgccgtttgctgagttgtcctgtttcgcgtgtagtttcggagctcgaagacccgcagtgcgaggatttcgaggatcaagctgaagatctcgagcgaggcaagccacctttgaacatcttgagcctatatttgaacttaattatgttgcttgaaaaatattatgcattgataggatcgcacttaatctgcttatcccgtctgcaaggcagattggcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagacttggaaaacccgacacctgggttggtgcttgcgaactaaatgaatttccaaaatcgcggaccggggaacgtaccgggtgtacggtttcccactcttgcacttaaggaccgtttccttggaatttcatccgaacacatgacaagtacgaccacatgggtggaatgggacacccctggctgagtaactagcttatcgggggagccatgatgctaagagacatgtggattcaccggggtggtgtcagggaggacccctgggcttcctggcacagtatggtctgggacctaatctggtgttggtctgggacccctctcgttggcatatggtgaacctatgtcggctttcgaaatgccttgtcatgaaagccttaaggtctctagtcgtggccgttctgcacgggctggatgatccgggttagtaatgtcgtgtgggtaaagtataccccctctgcagagcttattaaaactattcgaacagtcgtgcccacggtcatgggcggatgtgaggtgattcctagcgtagttttgtttgactactgccttgtgaaatttgctgttgtggaatgggtttgatgtttggaaaatctgcggctgatgggattagccaggcccgggtggccgtttgaaagctgttggccgggtgccaatcttgatcaattcaaaagactgatacattgcacatactccgaccggacgagacgcactgtctcatccgtgtcgtttgagaagcactcacttagttatttcagaaaagagttcaaataaaatcaattgcaaaaacaacagcctttctttgaagcctgcattaaacacttatttcccatggcttgctgagtactcccgtactcacccttgctctatataaataatccccccccagttgctgaagaagatgaagcggatcccgctgacgaggagttcttccaggagcaagctggctacgatgagttttagggtttcggcctagttcccaagtcgcgcctgtgatgtttggtccaagtcttggcttccgcttcccttttgtaatgcagttgcgagctcgggatctgtctgcagcccaacatgactgtactcctactctataataaagagacctctgttgctgtgatattttgtcttcctgtgataccagcactgtttcctaggactggtatcgattaacaggttaatttagagcgtcacgggctagttccgctcgggactagttcggggcgtgacaagagatggtatcagagcacaggcttggccctagggcgaaacccgacgtttaggatgaccctaaggatactaagttcaaaactacttgcgaaaagctaaggcttcttttggtttctttattttcaatagtttgttgctaaaatggttagtgatcttttctccctctttcaaaattgtaagatggcagtgaacgccagcttcagttcccacggttttggtgagggtcaccacgtcgctcagcttcgtgacctcgcccgcttccttggcttctcgtgtcccgagtacatggggtactccgtggacgtgttccccctcgctgtgagctctctgtgtacctttaccctcgcggaggtatacacggagctggccttcgcccacaccacttcactgtggctaggcccaccctccagatcgcgtaccaggacctctcctggactgcgcttcgtcgcttggcccacgactacagccaccgtctcgggggctctgccttccggcagctcccacgtcttccttctggctacgcagatgccaggtacccttgtccgtacagcgagtcttagccagtgctgactcgcatggttgagctttcggaggctcaggccactcagcacgacctactccttcaggcttaccgctcccttgcccgccgctacgctactctggaggcccgtctggccgaggagggtgtcacctcagttgacactgtctcttgggactcaggccgcctctgccacgccagccacctgtcctcccacagctcccgcggctctgctcgcactcctagtggcccgcgctcccccagctcgcgtgcgccgtactcaccagtgtactccccctacccacacccagttagcccctcctacacccccggacacaccccagttgcttcctcccgccgtggcgcacgctttatccgcactgtgcggaagcgtgttgttggttcttccaccgtgttccgcttcgactacccagctcccccaccgccagcggcccgtgctgctgccggccctcgacaggttccgccggtcccttcgcgtcagccgatcgacgtttcttcgactgatgagccgactacagcaggcagccaggcaggcgaggagtagaggaggcagtcttcagcagccgtccgtgtgttaggcccttttgttccaccgccaactcttttggagtcgtggcgaggtagtgcgtgcgtgtgttgacgtgggtgttgtttggtagtctggttctcctaggtggtgtgcgtacagtcaagctcggcgtagctctgtgacttgtccacacccgttgtatcaggtgtttttatgatttgagaaaaaaatccagtttatgcctagtgcgtgctatctgagttgttatttactttgctccttgcccttctaagtgcttatctgattcttacctcgccctcttctaggagtttagatgcctagccgcccccgccgtgctgctcatgcaccagcccgcttcagttttgaggaaggtagagttgagccagaagcaaatcatgagtcagctaatgagcagtctcaccacagcatccgttcgcaccatactgcttcccgcaatgcagaagttgagcaaccccaccgcagcaatcgctcgcatcacacagcttcccgtaatgcagaagtggaacaatctcaccgctctcaccgcactgccagtcacaattctggagaagaacgcatcccttccccacctcatgtggaaaacaacatgcagcacttaatgacagttcagacacaaatcttgcaaggattagccgcagccatagccggctttcagcataatgcccatggaaatggccaccctcacatgggcaacaatagatccaagctgacagactttctgaggtctcgtccgccagagttctctcagaccgtcgagcccgtcgaggctgacgattggctgaaagatgttgatagaaaactcaacttagtgcagtgtactcctgttgagaagatgctctacgcctctcaccagctaagaggacatgctgcagattggtgggagaattactgcaatgcacaccctgaacccactaacattgcttgggatgagtttgctacggctttccgtggagctcatgtgcctgaaagcaccattgatacgaagaaagaggaatttaacaggcttaagcaaggcaacaacagtgtcaatgagtacctaagtcagttcaacaagttggctcggtacgcccctaaggaagtggacacagacaagaagaaaatcaggaagttcttgaagggaatcgcagttggaatgagactccagttgcttgctcatgacttccccacttttcaacatatgatcaacaaggcacttctacttgaggatgccagaaaagaggctaccgaagaatacaagaaacgcaagtttaaccatcaggggaattcttcccgaggcgcacctcgccctcgctatggtcaacccatgcaatatcaccaatcggtcactcaggctaaccgccagccaggctacgcccctcgtcctcagatgaaccgtccggcacctcagccacagcagcatgccccaagtggcaatactgcgccaaatagtgttacctctttcaagtcaccactaggactatcagcagttcagtgtttccggtgcaaccagatgggtcactatgccagacagtgccctcagaatcctaccaacaccaactcagggcatgctaatggcagcactgccagaactcctactccagcggcagctcagtctcgtcctagctctcaggcaagtggacaaggttctcgtgcttccaacaactttggtcgaggccgggtgaaccacattcaagctgagaccgctcaggatgctccagacgttgtgatgggtatgttctctgtgaactccgtacccgcaatagttttgtttgattcaggagcttcccattctttcatatcacaagcttttgtgaagaaatggttggaaaacccaaaatttacgtgtaccaatgatagtacattcccctgggaggaatataagggcaacccaaatatgcccggaagttaaccttagaattgaggaagttgacttcctagccaaaccgatagtcctagactcgcaaagcttggacatcatcctagggatggattggttggctaagcacaaaggacagatagattatgccgaaaggtccatcaccttgcaaggacctagaggaaagcaagtctgcttcaccactaacacccctaccgcaagtcggtctatcctaacctatttacaagtcacctccttggagtcggtgcccatagtctgtgaatatcccgacgtatttcccgaagaattaacaagtatgccaccagaccgagagattgagttcgccatagaactggcaccaggcaccgcaccaattgcaaaaagaccctaccaaatggcagctaatgagttagcagaagtcaaaagacaaatcgaagaattggagagtaaaggttatgtgcgacctagctcatccccttggggagccccagtgctcctggttaagaaaaaggatggctctgagagaatggtaatcgactatagagccctgaatgaagtaactataaagaacaagtacgcattgccacggattgacgatttgttcgatcaacttaaaggagcaagagttttctctaaaattgacttgagatcaggttaccaccaattgaaaattagatctgaagatatcccgaagaccgctttctcaacgcgttatggtctatatgagttcacagtgatgtccttcggaatcaccaatgctccagcattcttcatgaacttaatgaacaagatcttcatggaatacctggaccagtttgtcgtggtattcatcgatgacatcctgatatactccaagaatgaggaagaacatgctgaacacctgaggctgataatggggaagctcagggatcatcaactattcgctaaattctcgaaatgcgaattctggttggaccgagtagcatttcttggacacgtgatctccttcaacggtgtcgaagtagatcccagcaaggttggagctgtacttgcttggaacccgcccaagaatgtgtcagagatccacagcttccttggcttagctggatattatcgaagatttattgaaggattctctaagctagccagacctatgaccgagctgttaaagaatgaaaagaaatttcaatggtctacagcctgtgaagacagctttcaagaaatgaagaaaaggttgaccaccgccccagttctcaccttgccagatatccgaaaggatttcgagatcttctgtgatgcatcaagacaaggcgtaggatgtgtcctaatgcaagaacgaaaggttgtggcctatgcatccaggcagctcaggcctcatgaagtcaactatcccacccatgatctcgagttggcagccgtggttcatgctcttaagatctggaggcactatttaatcgggaacagatgtgaagtatacaccgatcacaaaagtcttaagtacatcttcacccagaccgagttaaatatgaggcagagaagatggttggaactaatcaaggattacgatcttggaattcattaccatcccggtaaagctaatgtggtcgctgatgcgctaagtcgcaagacctactacaatgtagctcaaatatggccagaccaagatcgcctgtgcggagaattggagaagttaaggctgaccgtggtacagtcaggtgtccctgccagcttgaccgtgcagcctaccctagagtcgcaaatccgggaagctcagaaagatgatgaagggataaaagaattaataaaaagaatacaggagaagaaggacaccgatttctcaaatagacgatcaaggcacagtttggtgcggtccacacatctgtgtaccggccaagaaggagttaagagatcccatcctaaaggaagctcatgagtccgcctactccattcatccaggaagtacgaagatgtaccaggatatcaaggcatatttctggtgggctggaatgaagcgagatgtcgcagaatacgtggcgttgtgtaacatttgccaaagagtcaaggcagagaatcagaggccagcgggtctgctgcaacccctaccgattcccgagtggaaatgggaagagatcggaatggatttcatcaccggtttgccaagaacccctagcgggtacgactccatctgggtaatcgtggaccgactcacgaaatcagctcatttcgtgccagtgaaaaccacctttgatggaaagaaactagcagaactctacatgacccatgtcgtgtgtagatttggctgtcccaagaagattgtgtcagaccgaggcactcagttcacctcaaggttctggaagcagttgcatgaagctctcggaaccgatctaaattttagtacagcttaccatccgcagaccgatggtcaaacagaaagggtaaaccaaatcctagaagacatgctacgtgcgtgtgccctggatttcgaaggcacttgggcaagctggctacgatgagttttagggtttcggcctagttcccaagtcgcgcctgtgatgtttggtccaagtcttggcttccgcttcccttttgtaatgcagttgtgagctcgggatttgtccgcagcccaacatgactgtactcctactctataataaagagacctctgttgctgtgatattctgtcttcctgtgataccaatactgtttcctaggactggtatcgattaacaggttaattggaacgtcacgggctagttccgctcgggactagttcggggcgtgacatgatttgagcaatggttgtatcaatggtagccttggtcacatcactgacctcgcggcagtcggatcttgtcaccggccttggtctagtcgccgcatccgcccacgcccccgcctccgtgtccaactccgtcggtccaagcaagctccagaatggctctttgaggtcagaggtcaccacctccttcgccgatccatcgctttacccccttccccttcagatccatcgctgccacctctcagtgccgccagatctggcctatttgaggtcagaagctgcggtggggactacaaagtcgttagcaattttgatgaaggtctgatgatccattcggcagtgacatcgttaacaattttgtgaagtccaacgataggggaattgatccattctgtttgtgaatgtgattctgttttgtgcgattgtgaatgtgaatgtcattttgctctttggctagatgaatgtgattgtgatgttttttgtgattctgttttgtgcctaaatgattgtgaatgtgaatgatgagtatttttgtgatttatgaatgtctaatgaaggtctgcgactagctaggctcacatcattatatttcttttgccccatttttcaggtctgtgacgggtttcaattaggacccgttacagataaagatcgccactaacgagtcaaaatatttacccgtcacagatgaatgttacctgtgacggatttaagttgcagaccgtcaaaggtaactcttacctttgacgggtctttactcgtcagagttgactccgagtcgtcagtgaccactaatctctgaccagggccatatccgtcaaaggtgagggtttgcgcccatcacagataatgtgatccagtgtaatggccagccctccctgcacgagccattgctcatggagtcgtcgatgcctctgcatttgatgtggaggcacaccgtcggcttgatcacccgtggacctaccggcccgtgaatacattctacttatattaatttaagatgtgcaaccatactagtataattagtgcggcactttgattgacagaggtaatctgcattagtaatagttttggcactgttttctacgtagtaactaatcgaggaacaccggtagaggaactgcagggaccgacgatagagcatagcatccctcattgttagcactgaaaatggactaggtccggccaatcttcattgacggctagccgctctcttccgtcgtcattgttttgtgcttaatttctcccctaaatctaaggttgccggatctgacctcgatggccatggtgacagtaggcttgggtgggtcgggtatatcgcttattaacggcaacctatggccaaaaggatagaggtgtccttcattttctattttctttccatgaaccactatttgccttaaataaagtactatagatatcaatttatttcaggcgctcatactcttggtccccgcccgcgtcgctcaagggttgggcgacacgggcgtcgcctccctccccagccgacccatcatctcctcccacctctacctcattgccgcccaagcaagccaccagaaaaccgtgcctttcttctcctccctgaaagtcttgagactagagcccgtggcccgatccacgatggggcagccgccgcgacatagggtggaaagccggtggcgtagttttagagagggcaccggtgaccagcggcacgcgcgtaggagcctgagggtggcctccatgcaggcggagaggaggtgtgactagatctggcgtctcctgccagatctggtcggagaactggcgacaatgaccacgatcgacgacatgtgaggccacgggcggtggcacatgagtaatgcacgtccatggccgacggagcacgtccaacgcggcgtgaggccgtggccggcagtgtgaggaggaagtcaacaatggtctacgtgagaaggaggttggtggtggcctcatgaggaggaggccggcgagggtcgagcatggacgccctagcttgcgtgagaaggaccaaagtggcagcgtgggtcgcctgcggtggtggttggcctctagtagtgacctcgacagcttatgacagcaaacatggaagtagttaggcagtagagaggtcttcttctctgttgccggctaagcatcctcttctccatagcgctcctcccctttagtcgtggggagctccggtaaaaggggaggcactggcttttgcaacaagcggtggcggtggcactagttgatccgagcaaccctgcgagccagcttgagctgcggggtggtgacctcggcttgcgcgctaaaggaatgtcgtggtggtccggtgacggtcattgtgcaggatatttgtgtgggcttttgaacaggaattgctagtgaaaaccttgataagccttggcccgacttgacgacgacaccgacgccattaggagccgttctcctccttgtaggtgtcgttatggcactgacccctttttccccaacaccaactgcgtgcaacagtggccattggtggactcctgcaatggtgcagaagctctataggcttagggtgtttcttgctttgcggtgagtgaccatcatttttctttggttgttgttgggtagagttggagctgctttgttgttggggtgtaatgaagcttggcaacgatttttggctagctgtgtgcaggaagtggctccttggtagcttgggccaatgtcctttgtgggttgtcaaacttgtttgtttgttttggcgttagggcatcttcgcagcgaagtcggaactattatgtcgcttgtggaaagcttggtaacgataacacatgtgagcggctgtgtcactactatggcaagcttggtgctaatgtctcacgatgggctccgtcgtggtagcttaggttagattagttggtgtgttgttgtagttgtgtttttcgcttagtttccctaattaactgagaaatgtaagatatggtccctttttaaaaaaaaattgggcaccatcttttttatataactagcaaatatgagcatgcgttgcaccgggtgaatatcaaacaaatatggatggttaagattgcttgtgtacttataacacatgtgcacaaaaatattgaatttggaagcgtacagatcagaaaaatatgcaattaattaaaatacaaatccattgaaatatctggtatttttaagtaggtatgtgtataattaaataaatttaaaagtaaagcaaatgtgagaaataaaataacatggttaaatttaatgttattaaattctccatgattagttacgctctttagaattttattggaattttcagagcttaattgctaattttaataatacaaacatcatttaacaattatttaattggaaaaagaaacaaaatgcttcattttaggtttgattcgaaataaacacattcaacttcttctctttttcttctgcctgatggacctaaaataggctattggtgcatctttctcacccggcccgagatgggtgttgaaggctagacttcttttcggcccttgccggtcggcccacggccttttgcacatgtgcgggcgcacttcccctccccaggccgcaacctgggcttgggccggaaaagtggccttgctctcgatccctcttgggccgatttcggctcgaccgacgccggccgtccgatctctagggtttcgatcaaacagccgggcgtcgagatcggggaaacaaaaccccctccttctcctcagccgccaaaaaccctagcccatttccttctctcccttctctctcttcgccgccctcccctccgcgcccccgatgctcctgtgcccaagtggaggcggcggcgcctctccccccgagcccaagcggcggcggtggcaccctccccccgagtgacggcagcggcggcgccctcccccaagcagcggcggcgggggcggcgcctctctcgccgagcccaagcggcggcggtggtgccctcccccacaagcggtgacggcggctcccccaccactggcggcgcggccacgtcctcccccaccaccggtagcgcggcggcgtcctcccccaccaccggcggcggccggggcagcggcgcctgtggaggcgtcggcggcccgccggcgtcctagcggcggcggcacccctcccctccgccggatccagcggaaggggagctgcggcgcctggtgtccctgtgatggcggcggttgctcgacggcaacctcccctttgatctttttttttggatatatttgtgtgtatagtgcttcctccgattttattttatttgtgtgattgattgaattctgattgggtattttttttaggtgggggtgatggaattcttactgggatttggggggaggcaagggtgacgaaaaaatcaccgcacctatcaggcaacgaatggaaaaatacgaatatttatattagttatagaaatgtcggcaacaacctaaccatcgaaaagaaataaagtactataaacctccctaggcttgtaaagacctaaaaactactaggccacttaggctgagttcggcacttcatgttcacaaacccacctctttcgtttttcgtgcgtacacttttcaaattactaaacggtgcgttttttaaaaaaaaattatatacgaaagttgctttaaaaagtcatattgattcatttttgaaataaattagctaatattaaattaattacgtgctaatagaccattccattttagtgcaggagggtttagttccaatcctgcactacctaacacagccttaattggtttcttccatcctttgtgagagcaagtttaatagtatagcccactgctatctccaaatcatctataaacaacgtaatagtcaattcatacaatagttgcttgctatattattaatatctggtcccacctgtctatacacattacgtcttgaagttcgtgctgcagcgggctacagatcatacacattacatcttggagtccgtactgcaactggctacagatctatagcccgctgcttttctctctttttaaaatggtaaaattggttatataatatcgaaagtatatttatagttggtttgtacatgctttgagcagctcgaactcgatatggatcattgagaccagtcgtcatgttgggacattgtaaatgccctcgcactatactggagaatctagaacggacggtagggccttcctcgcactgacgcacgaaccgacaaaggtgtggttttattctggttatcaggtgttaccaccacgtcaagatgactggacggatgagatggccccgccaccaccgcctgcggcccaagtcgtccgtccgttccgcccgcgttttctcaagtttccccccctcctttccacatttatctcacccagaccagacgtgccgtgcttctcgtctcgcattcaatgcccctaaccccactccgctgcctattgtcaacgcccacgcatcacttatacacgcgcaccatccatctctttcccattgtccccgtccgtatactagaggtacttgttcttttccttcttcgcgaagcagggatgaagctggtgtggtgcccggagatggcgtccaaggcgtacatcgacggcgtcagggcgctggccggccacgacctggccggcgccgcggcggacgtggcggagctcgtgtcggccatggccggcggctggaacgcgcggctcatcgtcgaggcgccggactccgcggctccggcggcagccgccacgagcctcgcgctggccgcagccgcgcggcgcacgggcgggcgctacgccctcgtgctgccggaccgggatgctgcggcggcctcggcggcggaaacggccgaagtcgttgtcggggaggcggacgaggcgatggcggggctacacggcgtggacctcctggtggtcgacgcgcggaggagggacgcggcggcggtgctcagggcagccaggcccggggccagaggtatggtggtggtgcgccacggcgacgggaggcagcgcggcgccaaggacctggcggcgtccatggcggcggggacgcgggtcgtgcgctccgtctacctgccgatcggcaagggcgtcgaggtcctgcacgtcggcgtcggcaaggggcccagcctgcagaaccaccgtgaccgccggagcaccagccggtggatccgccacgtcgaccacgacaccggcgaggagcacgtcttccggcggcagtgatcagtcgtcgtctgttattccgtccaggtgaattaaatcggatgtaccacggggagggtagttaattaggtgtagcgtgtgttgtccagattcgttgaatctgcccgttaataccatgatgatgtataatcatcggatgggtggaaagtgtgacgaatcacgaacaatgtaaatacctcaaacttgtagctcctcatatctcttccttctacctactgtgaaagctttcttttgagttgatctgctagttcattctttaatttcctttttctttttttttttgctgtgcagagtgcctttgataattaactcagaaaaaaatatgttcaatagatattcattatctataggaaaaatatgtagtgaaaactgaaaaccacatatatagcgaaaacatgtaaacaaccgttggatataaaaatagaccattgctcttgttacctagagtaacatttttttagttaattgctcttaaagccacgtattattaccaaagtttcactttgttctaggctattgatgtttttacttttgatcgggatttcttaccttctattacacattggatcattattgtattccttgcctttaatatactttcctgccactcactccttgatttccttagctcaccagcaactaaacgcatacatcaatactctatcctgatcatctagtaccttgattttctttttggctcttttttcccaccaaaatcatgtgagccgagaaaaatcagttgattgtgagctcacaacaaaagttgctgcagcgagcagccctgtggcttgattttgtgatttgagatcaggaacggatccgagtgaaggaatcgtagtcatgtgattatttgggttaatccatgccaacatctcaatggaaaaaatacaagcaccttgattttctttttagctcatttgttataaaatcggcttgaaatcatcatcagaaaccaaacacggaaaaaacgatataagagatccaaacacgatgacgataccgaggcataatatttattaacgaagttcagccgaaacctacatctctaggacactgattatgggtgctcatccccgatccaacatattacaatgtatcaaagttacaatgaccctcggccggatgccgccggcagtcactacctctcacctatgctaagtcgtcatatgtgattacaatatgtacatccctctatttaagagagggcctaggatagagtccgactcttactctattcttataccatataactccaagtcttaaattgtagctaactacgtatacatattcgacacacaaactctatcaaactccaccttggtgaatatgccacgccaatctgaattcattatttacacgaacttctgtgcattcagaattgagtttattccttttttttcccataaacaagagactccgtaatccctgtaacatcttcctcttgactctacctgcaacagtactccaccttctctcttatgataataattgtcttaccaagcgaaattggatccttcctagctgtcaatccatagattctctaaagaccatgttcatctaaattttatgtcttaaatttgccttgatctaaccaaataaccgatgtaatcaccacatagataaaattcaactcaccatatatgaagagaacactttcttccttatcgtcatatggactgagctaacaaatccaacattcacacttctcgtatcccactactacaaaaatgattttcttggacgaacccatcgttagattccaaacggtcaataactgaccgcgtatggaaaaatcgtcctcccattcttgcttgcggatccttaagaggtccgcacgcaaaaataagactatttttacgtgcgaacccttaataggcccgcatgtgaaaatcctctccctagattttgaaaaaaaaacttctctaaaatgatccaattgttttaaaaattgcctccacaacctactaatcagttggacaaaaaggattgttccatgccatgtaagcaatacaaaaatatattcataaacattgaatcattccatacattcatcgcatcattcattcctcgtgatatcatagcatacattcatgccattttttaaaaaaattattgctatacatgccatcaagcaacctgcttatctttaaattagtaaccttcgtgcttgctgtccagaatttttaaacttttgtaaatgtgggttcaactaagattgatcattggccatttgatcattggccatatatagatcccaaatatatataccataatgtatcttgttagaaccaacttctctagttccactttttggtcatctaccaaagccttcgtaaaccacaactgactaaaacctgccacccatctactaaatagaagtcaagtctataatacaacttaagaaagttactaccactcgtcaatcctcaagatatagtcatgacttaagctaacctcacccacaggagattaggtagaaccttttgttagagatataatgtggtatgtttgaaagaggcttaggaaaaataattaaatcagatactattgtgttatcagaaagcatcatgcaagtaaaacttttagtaggtctttcgatcatcagtcaaggttaggattataatccattcataactttaacaaaaattaaacggagttcgacagtaagaaccacactaagaagagtaggattcttaggaagccaacacattgatcaacgtaaccactacaaccctacccaaatctcggggacgagatttatttaaggaggataggttgtaacatacccgaatttcaggatgaagaaattttcgtcaaaattagttgaaaggaaagttcttcaattttgtgaaccaaaaatttccattttaaaacctaggggaagttgacctaactcatgtaactaaataaaatttgagagcaaattaaaactttttcggaccattcgacgcgtacgtcgtgcacgcgcgccgcctgcccggcccggcccggcccggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctagtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcatgagagtatatgcatctttacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataagtccggagtttcttaatttcctgacagacttcaatcgtcttttcacatgtctagaagatttcatattatccttagaactattcactttgacaattatcgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggatatatcaggcctagttgcactagccaggtacatcaacgagccaatgatttgggagtattccagttgattcctagcaattctcttgttcttgcgaagcaacaatctaggatcataaggtgttggagaaggcttactatcaatgtagccaaagcgattcaagatcttctccatataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactccaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatattcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcaccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcagtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaagtatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaataagattcctgtcgatagaagggacatgctgcacgttcttcagctgtacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgctctgcaggtgccttcatccccttgcgctgtggacacttcctagctagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaatggttgtcagccattttgtagtcatgaaactgctccatgatatacagatcattgctagcatcagtagcaccgaatttagtattcagtgcatcccacaactccttagcgtcgatcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataagttttttggattgttgagattatagatatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatagagtagtctacgagcgacggcgcagtacagagtaggaagcaaacccaagattgatttttttgtatgtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgtggagccaatttttcggaccattcgacgcgtacgtcgtgcacgcgcgccgccggcctggcccggcgaggcgagcgagcgcgcgtgtgttttccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtggctaaggcccattcattaattccaacattttatagccccattacaggttcttactactagggtttagattatacaggggaatttacatgattacccttatgaaagggacatttacaagggtacatgatgatataggggctcatgggcccttgatgggccatctggcgatcgccggccctattgcccctaggcttgatgggccggaaaggcttcttcggccctcgcgggggcgaacttgccaaggcgaagtcgtcttccttcggcagatagtcttcgccttgcacccttcgcctgagacgcctctggcctggcaaggcactcgcacgactcttcgcctcacgccattcttgctccatagtcttcgccatgggtttcggcagatttggtcgaagggcctcatgccatccgccaacaagcccctcacgggcaagggtgagattggagcttcggccgagaccgtgcaaaccatgtggtatggtatgcggcgccccctttcgaccgatgctcctgccgaaacctacattattcttgcgaatgaagtttgttatttgtgcggctggtattattttgccgtgcttcttctcctgcgtttggttgcatattcatatatatattatacacatttttttatatattttcttttctcgggccgaaaggaacagtattgggctttcccttcgtgggctttttactgtgccgctcggacggtgggaagttaccgttttgcctacccttgcgacacgtggcgctttattactggtgggtaggcgaacggtcgcccgggtgagctatatattcctaccgaccttttcttttcaccaccacacttgccattttaccgcgtgcgctctcttcctccgtttctttcttccacagcatctctcgacccctcaagcgtttcgcccattctctttcttcgccaccgcaaatgcaccgttcgccatggaccctcgcaagccaaaccctgcttcggcgaaagggccggatcccggccgagtcgatgacgaccacatcgcctttctgggggtctctcttgtggccgacgtcgagctggcgaagctggtccgctctggggcgtcggccgaggggcaggcttccgccccacggaaactccgggtgccgaaacctatcgacaatcggaccgcggtattcaccgcctcccctgacgcagggctatggttcacctgcaacatgttgttgccggagatccttcgcctcttccaggtggaacttccacagctgagcccgtcggcgcttgttcgggtcgctatctttgactgggcgtgccggacttccgggtttgagcctaacgccgagctcttcagcgccatatttttcgccaccgtgaacttgaagacggtgattatcccggctggaacgaagaagacagtgttcgggagcgtgaactttaatgttcgtcccgagcggtccgatctctggccggtgaacgctgccatgtcgaagtgggaccgccattggatggctaggtggttctatcacaccatccccttcgaggctggcactgacttggcgaaagccctccgttgccggcgtggacggcgctatggaggcgcggttcgttctgctgcgaaaggtttgctcccgccttagctgccatgacttggtggaggaattctgtatgcttcgcatctttcccctctcccagtcatggcaagtcacagttgatcaaggcgaagaggttgacggtttgccgaacctggttcttcctgagggtacggacagtaagattgttctcttgctatacactgctgtgctttattatcttgccttgtctgactgttaacatagctacacactttacttttgcagcgttgaccctcgaccaggctgaaaatgaggcccgcaggatgatcggcgacgtgccggtcgtcgagtatagccagttgctaacacgacaagcggctgggcgggcgaaccgggtttacaacggcgaattgcctcctcgggcaaacccccacaaagctgacgacgatgcaggggcttcgcgaaagcgaatgcgcggacaagtgaagcttgcccctaggaagcgaagggttcctgcttcgccggactccgacgccgacgacgaggatgatgccgaagaacgcgacggcgaggaggaaggagaggagaaagaggaggccatggccgataaggccgcgaacgaggcgatcgaagaccgcgtcgacacccccgactacactcctaccccaagtcccggtcacaacgagaccggggtggagtcgaacagctccccccttcgacggaaggatttggaaggggcgaaggccctagttgcattctcctcgggcaaggcggcgaagggaggtccggtgcagaagatctctaaaaagaaaggactcgtcgacatcgcccacgttttcagcgacgacgaatcttctaacgggactccaacttcgcctgctggccgcagtttagacctttcgactgctcccctcactccactcggcgttgctggggcaggcggtaacgtcgccgccggggcttcagcctccgccgaacgaattgtgtcggctgcggcgagggttttcgggagccctctgcgtgagccagctatttcgccgctagtcaaggcgaaggggaagtgtgcggccgccgaagcatctgcctctgagtattcccttgcggcgccccacttcgcccctggtgatttcgagactcgggcggaccttattccctttgtggagggagtgagcaaccttgtcttgcccgccggcaccccgagcttgttcaccgaacttaatgagttcgacgaggggtgttccgccattaaaagcctggcagttcgggtatgccttttcttccttcttcgttttcctcttcgtccccccctttttttttacgtctgacaattaaccttttgttcttttggcccgctcctatctttcatctagattcttgcggcactgttcgacggagcgaaccgtacgggcccgttttgacggttttaagagccatcttcgggccaaggacgacgaaataagccgcaagaacttggaggtggaggccctggccaacaccctcaaggaggcgaaaactgaagtcaaacgccttcagtctgagctagataaggggaaagaggccagggccgaggttgatcgcctcaaggccgaactggagaaggagaaggcccattcggcggtgctgattgactactacaaccttactgagccgaagatggaggctcttcgcctgaaggctagtagggccgaagcgagcgccgcggaggagtcgcagcggttttcacaggagatggcgaagaccaccgaatccgcgagaacggcttgccaaacgctccgcctcacccttaccgacatgggcgcgaaagtgcggggggtccctgccgaggatgcatcagccttcgacttctccgagtggacccagcaggctgacggatcggtttcggactgcgccaccgcgtacggcgattgctgcgcgcgtgtatcggcggccttcaccttaggccttttgcaacagttcggctgcgagcacgtcgccgagttccctacctatgcgaagggggactaggagattagtgcgcagaacatctcgcctgctcttcgcgcgtggcgaaaacagttttggcagaaagatggctggtccgctgccaaagtgcgccttctggagcaactagcgaaggcggaggcggcagatcggggcgaaggagagggcgcggcaggcgaagaggttggaggcgatgcccaggatcacccagaggtgtgaggccctccgccctttccttagatttttgtagttttcctccctcttttgtgtttgcctggagaggcgaatgatgtacattcgtcaggctgtcgccaaaccttaaaaaaggctttttttgtacatttggaatatatgacacaatcttaattactttttgatgatcgaagtctttagcatatttgttatttcgctcatctcgtattatgccatacctcccccttcttacgtctattcttactatgtaagctgtgttttgctttttctgcactgtccatcagggggttcaccgaaagtcgtgcatccggcccccttccgggagctggcgaagtcaaaatgagaaatttgtggcagtgaagggtctgccgaaggtgcgatgtccatttcggcctgtttatcgtgaaatggagataaacggtcgcaactataaggttttcaaggttgccgactggctgcgggtgcaccccgggcgaaccttagaagattacgatcttgttcattctagacgtttgcaggatatggctcgcttttggcgaaaccatcagaagactgaatgtcaggaaacgatctttcagcgtcgttatagtttagtatgtgcttcaccccctactcctcttaaggttgtgtacgatattagtagtgatgacgaacctagttcgcctgatcattccttagggagggatagtgattatggggacgaacatgtaatttacttgtaaggtgaattgtatcgtgttgtgaaacttctattcttcgattatttttttcaaagttaataaagacgtgttttatttccttttcgctattgtttgcatcgtcacattttgtgcttttgttaggtcagaacatgccggcccctttgcatatatgagcgaaataggtgtactgacttttcagcttttcgtcgttcgttttcgatctgtagcgttctgtgccgaaagaaacgcttttgcttttatgctgatcggacgtaacgtcgttcggccatttaatttccgagacaagctgttgcggtttcaacgttcggcgagcgatgcttcggccgattcgtttcgcccccctggcctttttcgctgatcgagcatttgccttgggatttttccacaaattatcaatcacacgaaaaaaataaaaagaaggcggaggacacagagattttatactggttcgggcctccatggtggataatagccctacatccagttttttcttcttttttctctctttcttcttttttttttcttgccgaaaggctttcatagtgctgaagggcttacatagtgccgaagggcttacatgacagtatgtacatttttacaagttggtgatttgggtgccaccctttctagacatagaagcgcttgagagaggcggcattccaggaatggtcgaactcctcgccttcgagtgtcgctaggcgaaaagatcccgtcctggacttgtgtttgatgaggtattgtccttcccactttgattcaagcttgccaaccgctactggttcaccttcttccttaggacgagatgaccaggcatcagctccgtgggtcgaacttttttgttgtaagttgccgaagtgcttgtggcgtacttgtgtatgtgctcgagcgcttcgactcttactccttccaagagttcgagcgatacttcgcgtccctcttcacccccagagaacatcacccttggtgagttagcccctagctttgctggggtcattgcctcatcgccataaagaagcataaacgggctaaacttggttggtcttgtgggggtcgtccgaagggcccagagaaccgatagcaattcctctggccatttgcctttcgctgccccctcgagtcttttctttagtgcttctaggatcttgccatttgtacgttcagccgccccatttgactgcgggtgtgcgaccaacgcgaacctgatttccaggttaagcccttcgcacatttctctgaacttatcagagtcaaactgcttgccgttgtcagtaatgaactcttttggcacttcgaaacggcaaacaatgtttttccatacaaacttctgtactgctgccgaagttattgccccaaggggttcggcttcaatccatcgagagaaatattccacagctacaattgcgaatttatacccgtttcgcgccaccaggaacggcccaatgatgtccagtccccatctggcgaagggccatattggcgcaatgggctgcagatcatactggggcgcggcttggcttcggccatgacgctggcaacttttgcacttattgatttgctcaacacagactttcaacacaatgggccaataaactccttgtctaaatactttggaggccactgttcttgtagcctggtgcgcgccacatagcccctggtgtatctcctttgccatttcttcgccttcggcaaaagagatgcaacgaagtaagggttgaagtaccccggagcggtaaagctaacccgagaccatcttatacttcatggctctgagttgcaaacgcttcgcttctgcttcgtctaccggaagccagccagtttcaaggtgttttacaaatggggttcgccagtcatatgggtcttcgcccagtttctcctggttgattgccatgacttccgagctgtccgtgggcacacttggagcatgtaagacttcgaaaaagatgccaggcgaatgtgggccaccacaagcagcggatttcgccaaggcgtctacttccttgttctggtctctaggcaagtgttcgaccgttatgccggtgaagcatttttccatggaccgaacagcctccagatacctcttcattccctcttcttttgcctcgaaggatttgtcaacatggcctgctaccaacttggagtcagttcgaattagtaggcgccggactcccagtgctttcgcctttcttaggcccaggagaacggcttcttattctgctgcattgttggttgtgtcgatctgcagtcttgctgcgtaccgaatcggcacaccatttggcgaaaataggactgccgcaatgcctgctcccttgtgcgaccacgagccgtcagagcacatcacccagaattgttcggcgggctcggggtcgggggcaagtactggtgtccattcagctacgaagtcggctagcacttgagacttgatagcagagcatgcaacaaaatgtaagtcgaacggggatagctctgccgcccacttgctgagccagccagtgacttccttgcctcggagtatttcgcccaaggggtactgtgatggcactatgactttgtgggcctggaagtagtgcttaagcttgcgtgaagccatcactagggcgtaagcgagcttttccatttcaatgtaccttgtcttcgctccttgcagtgcttcggagacgaagtagaccggtttttgtccgaactctgtttcttggacgagggcagcactgactgccaccggcgaagctgctaagtataatagcagtttgcttcctggggttggccttatcagagctggtgggctttgcaagtattgctttagctcgtcgaatgctacttggcactctggtgtccaattaaactttcctgcgccccggagggtcttgaagaagggcaaacctctttcggctgcctttgagaggaatcgactgagtgccgcattcggccagcaagcttttgtacttcatgtacgcttgatggaggcttcatttgctggatagcatcgattttctcgggattcgcctcgatgcctctttcggaaacaaggaaacccaacaacttgcctgcgcggacgccgaaaacgcacttctccagattcagccttatgcctgctgtgcgcaagctgtcgaatgtctcctgcaggtcgatcgcatggtcgaaagccttgcggctttttacgacaatgtcgtcgacgtaagcttccacattccgccccaactgcttgccaaggaccttgtacaccagcctagcgaaagttgctcctgcgttccttaagccgaaaggcatcctgaggtgacaaaatgtgccgaatggagtgatgaaggatgttttggggacgtcgagcaggttcatgtgaatctagtggtaaccggaatatgcatctaggaaactcatgagcttgcatccagctgttgaatccacgagctggtcgattcgtggcaaggggaagtcgtctttcggacatgctttgttcaggtctatgaaatcgacacacatgcgccatttgccgtttgacttccgcaccagcactggattcaccaaccactccggatggtcaatctcttggataacccccaccctgagcaatttttgtacttcagctttcgccgcttcttggcgatcggcagacatcttacgcaacttctgttttcttggcttaatgtccggcttgaatgctaggtgatgcataatgagatccgccgggacaccccccacctcgtcagggcaccannnnnnnnnnnnnnnnnnnnnnnnaagcacctgtaggatactctcaacttcttcttcgcccatgtcgccccccagtgatacgagctttgtggggtcggcatcatcaatctgcacttttgttatcttgccgtgaggggtgggctttggcgtgtgcttcggccgttcatgcggttcggtctcaacactgttcactgctctgttgattatggctagatcaccttttgaagcggccgaaggctgaagccccttgactactatcacccctgtcgggccgggcatcttgagcttgagataattgtggtgggaaatggcttcaaacttgttcagggttgcacggccgaagatggcgttgtagttgtacgggatgtcgacgacgtcgaatagtatttgctcttcgcgtctgttctccccctagccaaaggctatcagcaaaagtgcttggccaagaacttgaactgcttctccgccgaatccgcggagcgatgctggtgctggggtaagggcttgggtaggcaaccccatcttggcatatgcttcggcgaagataacatcggccgaactccctccgtcgaccaagattcgtcggacttcgaaaccagctatctcagctgagattaccaggggatcttgatgcgggaacataactccttctgcgtcttccggcctaaaagaaattagctggttcagatactgcggcgctccttcacccgccgaagtgatgctgtggaccatacggatctgcatcttcttctgccgtttggacaactggcttggcgggtcagcccttgtaatcacttggattacccttcgctgtacatcttggcgttgttcggctgggggtgtttgctcctgaactgcttcgcggggtgcttcaacagttgttccctgctgcggccttgggtcttgcgcgttgccacgttgcctaatgtttcggcattgctccgtggtgtgcgaagagcgtccgtgaaaggcgcagtagaggtcttttcggaccttcttgcgggctggctgctgatggttgctcgcttgctgggcatcgaactccttgcggagggcttgcacttcttcgaccgccatcacagctttgcccgcacggcctgttctaaactttctccaagttatgggggcttggccttgccttggcggctgtccttggatcgccggctgagactggcgaacgaagaggggaggtggttcggcaacttgaacttgtgcttgagcttgaacagcggcgacggaggctttgtcgtactcagcttgtatagcttgccgtcgcttggaatcctcctcgccccttgcgaacccgtcaatgatgcgaagtaggtgctcgagcgtctgaggctccatgttggcgatttttcttgtgagttcgccctcgagcagaccggccgaagcggcgtttataactgacgcctcggttatgtcttgaacttggcaccgggcttgcgagaagcgacgcatgtactcccttatcgactccccttgcctttggcgaatgccgagtaggtgttgttgcgtcttcggctcctcgtaggtgcctcgaaagttaaggaaaaaaacatcgcgcaattgctcccatgagtaaatgctattggctggtaaattgaaataccaagaacggccgatgccgtctagagcgagatgtattaccttcgctttggtagtttcgtcaccatgagccgcttcgatcgctgactcgtagatggagaggaactccttcgggtcagtttcgcctgaatagcgcgggacgggtgggaacttgaactggggtggaattggacgagtcttgattcccccacttagcggtagccccttttcgcctcccgccctgtttaccgcaccctgctgcgggtacggtgtggcgaagggcgaaatcgcagcttgtgcgcaaggttgggccatagcattcggctgcccggctccaactggaggtacttgctgagccgccatggatgggtcaaaaattggctgtgaccacgtcatggtagcttggattggtgcttggtttgttccgaagcctggagttggagcttgctgctgaacggttggcgcctgagcagcgttgacgaagtcgaactgcggtccttgattccacagcgaaactcccaggcccggctgaatcggtggcaaccaattaggcgcaccttgacttgtattcccctccgggtgggccgatggggttgtacttgaaatgcagtggggttggttgagttgctgaaggaaagcttggagttgcgcctgcagagccgaagccccttccaccattgtttgtggcgcttggccgggtggttgatggtgtacttgggcagcgactgcggccgattgctacccggcgaagtacattggcgcttgtgcgacttgaggtggaaagggctgggtcgtcacttgcggatggacttgaggcgggacataacctgccgaatactgaaggattggagccgacgtgaccttggtccgccttgccgcctcgtatgcttgttgttgttcttgcatttggcgaagcatgtcttggagccgtgccatgttttgtcgcatggcttctatgtcggcttcggcttgtgtttcggggtcagggctgacttgggcctgcacagcggcgagcgcagtcggggccgctgccggctgcgatggagcggcttggggcaccaccagttggcttgtcgaaaggatctccgccctggtctggagtgcccttgccaccgcagccgccttcgccacgtcggccgcgttcggcacttgcacagaggtggcgggggccgaaggcggttgtgatggcgcagatgtggaagcgaatggtcctcctccatcttcggccacgggcaccgaaggctctgctccctcctcggcggccatgtccggtgcggcgttgctttccttccgccttgcaaccttctccttcatgaccttcttcggtggcattccctctcagtggtttcgctcggaggtccccacggtcggcgccagctgttgtcggaatgacaactgcatacgtcgaaagacgtggttactcaacagtggtaggaagaagacgaagtgtattaaattttgagtttcccttcttttttctccccccattacatggccctaggggactattttatagccccattacaggttcttactactagggtttaggttatataggggaatttacatgattacccttatgaaagggacatttacaggggtacatgatgatataggggctcatgggcccctgatgggctgtctggcgatcgccggccctattgcccctaggcttgatgggctggaaaggcttttttggccctcgcggaggcgaacttgccaaggcgaagtcatcttcctttggcagatagtcttcaccttgcaccctttgcctgagacgcctctggcctggcaaggcactcgcacgactcttcgcctcacgccgttcttgct

SEQ ID NO: 41487 - DNA, 21187 bp, Oryza sativa
  unsure (1)..(21187): unsure at all n locations
acattaacattagagagggacatataccacatttgggtccatcatgtgtggactaagaattcttaactactattcttagtatatctcatttagggtcattttttaaagagtaaagtgcacgggtggtccttaaacttgtagaggtgtgtcatctagatccctaaactctcaaaatgcatattcaagtcccagaacttgtcatagtgtgtcatctaagtcccaaatcgccacagccccttcaagttcctacgtggcactgatgtggcatgccacacgaacatgatatgtcatcattttgactgacaaataggactcatttaattttttttctttttttcttatctttttcttctctttcttttttcctttcttctcctttctctgtgacccgagcaaaagaaagggaaaaaataagaatgagaagaaaacaaaaaagaaaagaagaaaaaaaggacacgtcgcgtccatgtggcatgccacattggcgccacgtaggatcctagaggggctgtgttgatttgggacctagatgatacactttgacaagttctgggatctggatcagcattttgagagtttggggacctagatgacacaaccctacaagtttaaggaccgcctgtgcactttactcttttttaaaggcatcatttcatagaccctcttacgcacagagagtgacagatatttaaacaaatttggcccttaggagaaatttgagattatgcctattatcgattaatatcctgacaacagtatcatgaatacctaaggtcgttcatgtcaaggattcctaaacccacatatccaaaaaaaaaaaaaagccgaatgtttttttattggtccaagccaccctacatcatttttttttctaataggaactctccaccatattttgctttgtatatatgtggatgtgtacatgatacaagatatatggaggggaagctctagtctaaatctaagaaactgtctcgtcgggatcctcaaattagaaactagtagctagttgtgtcatgatcggcgacttggtttcttggcaccagttgtcttgtttaggcttgtgttggcttttcgccacttgggttggcttgaactgatctcaataggtttgccttgggtctgcctacaccaaggttcctaggttcccccttgtcctagaaggacatataacttgatttggatattaccttgagcagtactggttggccctaagtaggataatgtctttctttcctagctggaggactctttccatatcagctcaagactatccttatcttggaattgtttccatagaggagttagtcgtggtatttctggaatggtacgtgcatatatggtatcctatatttagtacaccaacaatggcataaaaagagggtttcactagaatgcaatctcttaactgggatcgatctcaacaccgagttggttgggctcgaatcgatcgtgccacactaacccatcagctcctccacattgcatcgccgcgccagcctgggcacccatatgatattttgatggacatatttcaacggctgcagctgtgcgctgcagcttggaccaccagcaaagggcgcggttgacagctcaatgcaagcacgactgaacatgggtttagattgatcctgcttagttcagcatagccccaagggcattttggtccctttactacgtgagaaagggaaaaaaacactaataggaatttgagaatggcattctagtgcgcatcctctatttgagaatggcatttttgcaaagcttaattgaggtctggaattttggcgaaacctgttttcgatgattgaataatttgaaaattttcccttgagggtaatagccctatgtcatgctcagtttgtatatacttgaacatatataatacaatatttggatggggagctcttgtctagacctaatagactatcttgctggggtcaacaatcagggtgttttcgtaaagctctcatggtcattaacgaaataaaattatatattcaaccgaaggacttcaacttctatgcaacacttgtccaacatgaatatcaaagaagacaacttctcttctctaatctgctttcttcttcatctgcttgattgctcggcaagggcgcaaggcataactagagcctaaccagcttggtcccgtggtgagcagcatcattctcatggacggatgccgggagagtgtgaggttgagactgtgctaagctgctgctattgattattgattatcagtaagggagattgaaagtaacagaagcaataactaaccattctaacagttcaccattagtcaccatctaattgtatcctagcaggcgttcctggaagtggcctgacattggcaggtgccaccacatccacggtggtcatgtctagctctgtcttgccgagcggaggaagaatatattgggggattagagagaagagagaggttgcctactttgatattcgtattggtcacatgtagcacaggggggcaaagcccttcagatgaaggaaggacttcagtcatgtataattttctattgtcattaactcaagttcttgtgagttgtttggcttgattggcttgactcacatggccttgtggcctctctatatttctatcattgtgcttccccatatttgttttgtttcataaattaatttgttcacgtcacattatatacagttgtatagcattacattttcccatagtagtgctgtcaaagttacgcgatttccctgtatccaccaatagacttcacagataacaatctaaaacaggttgtcaatactagtaccaccaaaataagcacgaaataaatatattttgataagtggaaataaatccagcaaaatgccaggttgtactttgtttctactatagctcctagtgggaacgcgttcgtccaactctcctatatatcacaacaccatggacatcaaattcgcactaatcctcccccttcatcccgtgtcacaaagccacaaagaagtttagcaggtcctccatggcagcctctctgccactgtcagctgccatcgttggagccgaagagtcggttgacaaggaggtcttggagatggagtacctctttgagaagtttttgatgccaagtgacttgtgcagcaatactgaatggcttgggatcccagaagaacatgttaggaaatttggcatgatgttggaggacagggacggttactccgtcattttctttcaggacggtgtggtgcctgggaagttgtggtgctttaggtactggaaaagcaatggagtccatggcttgaccaagggctggaggtgctttgttagggagaagggcctcaaagccggagacaccatctccttcttccgaggatctgcatgtggccgtctcttcatctgctgcaggttaggcacccatgcaacctttgcgtcatcctccaccttgcatcatggcttttctatgcccccaccacctgcccgcccgctggtgggtcttcaatctggcatgttggcaagagatgtcccatcattaggacaagctaggttgcatgatggaaatcaagatggaggcggtgcaccatcaagacatgttccatcctcaggacgacgtgtggaggcacagctatcacgtgtgtcgtcgcgccgtcaacgccgtactatgaagcactcgataccagagcccacgatagagacgccaccaattcttgagtcgatgttcctcatagccgcaccaccggcagtgaagtgcttacggctttttggcgtcaacatctatgtgttgcctgtgtcctctagtggccagccaaaacaagaatccagcccataataccaggcaccataattatggacaccccattgaagaggatcagagcgtgttggaggcgacaaatgttcctcaattgtatcgtttggttctacatcattcttagatcattgtggtttcaattattgtaattcttagtttgttatgattggttttctattggcaattattgtctttttggcagttattttagcataagaaattattttgtaccatcttcatttattaatttcttttgtttcattcccatcatgtttggggtatttgaatactttaacttccctactatccattttcttaatatataaaaagtaatcctatcattaatcatagtaattaagcaatatcgggccaattactgtattccttttttggcataatattcaacaaaatgtatggttgcttttcatatttctacattattgcaaattggatcaattcatcattgctccttatgatttaatgttgtttgatatttgtgcacacagatacaaagtgtatgactacatggtggtggcttccccaaactagataacaatatataaatctatttgaactccaacttcttgtcccgtggtacccttgcctatcccaccaagcgatgccgcttaactctttctagtaatcacgcactttctaactactacaagaacagaaccatgggtcactaccacaaaacatctaaggtttccattttacaccacctataaacatacttataaacataaaaggaaatcaactgtttataattaggggtacaacctatcgtccaaataaagaatagtcaagcgttttggtcggttccctaagaactatttcatcaatggaaaaatgaagtgtgaggtgattcaatatcaggtgaactgctggtcaagaggagtggaatgacatgtgggatcacaaatatggaatgaggcaacaacgctggatggtatggtgtgttcgccatacaaaaacgatgtctaaactgtattatatgacaaaaaaaaaacttggtctttaagaattatcataccgttgggttcattccattcaatgtcaaatggaaaattactcaatagctcatatggtttaatgccaaaaaaaaattggcaggctgttggtatttcttacgatcacagataaatccgcaagcgcacgaaacaccgttgtagtacttccccttagagtattccaaccgtatcgaacacgaggaacatgtgtgtattatctactgccaagattcgattgaaggacaacaacccaagataaattagctagagaggattcctatgtcttttagttagttacttaagttacttaaaggtaagactctaacaaatattcgggaaccggccctcccctggtctactaggataagtccgggcttgagctctatgatgtacctgaacgtggatgaatacagaggataaacttggctgtcaccacctgccccctacctcactttccgtgggcacacaacaaacgaaggtaatttctaacctagacaccacacctaagttattaattactactctagccttgcacgggaacttccttctttatccagagttctaatactagagcactcaagtgcacactaagcgatgaacccgcaccgataaaaatgtatcacttaaataaactaattaaataacataaagaaactcgaatacttaattaaataatggaagcatccgacaaggtacaagcgatagagcaaaggcgacaatcccgtcatctatcaaattgccaaaatttcagttgtcacgtcatctatcagatgggccatactagtatcagaaatttcctcagaaaactatgacaccacattatccattgtttaccttttattaccacaggattgtccattagttactctctctgttcctttatgttaatcaccaagcaatattcatattcaaacttccaccattcgtcttctttacagaaaaaatctaaatacttaaatagaccaaattaatacgacttaactagccatatagcagccttgtacttaggctgagtttgaaggagtatttgggcggaattttgtcctcatttaccttgagcacactttcaaaaatactaaatggtgtttttcatataaaaattgtctatataaaagtttgtttaagaaattatattaatacattttccaagtttgcatgtcacagctagcatttccattggcacgtctagcatgagaaggagcttaatcggggggaggtgcgcagtaaattcgccacattcaacagaaataggcaaatagctacgccatcaagagaatccgaaattaaacttctatgatcgtctggcatttgtgttctccttatttacgccctgccttaaaataattttcatgcatatcacgtacgctatctacagttgtccggcattaaggttttccacggtagtagtccaaaatcacgcatttttcctggagtcctgaagaggattatttacagttgacaatcgtgcatatgccaatgtgaatgactagtgctgccaaaataagagagaaatgaacatgtcctgataaataagtagtagataataagccagcagtaatctcacgattactagctccagcaaaatgccaggcttgcactccatatttgcactgtagcctccagtgggaatgcatttcattcctaaaccccaattaaaaaaaaaaaaaaaaggtgcttggacctcccctatatatgtgcccgtaccatgggcctcaaacacttgacctgctccttcgatcgtccaatcctacgaaaccacagagagaatctcagagcggagtactccgatccatggcggcttctccgccactgcctacttccatcgatggtggtcaagtgctagatgacatggaggtcgtggagatgaagtacctgtttggcaaggtcctgatgccaagcgacgtgtcctgggacaccgaacagctcgtgatcccggacgagcacgtcgggaaactactggacatggtggtgatgaaccggccggaagggggcttcttcgtcgtcgtcgtcgaggatggcgaggtgactgggaagctgtggcttttcaggtactggaaacgcgacgacgtccactgcctcaccaagggctggggttgctacgccagggagaagggcctcagagccggagacaccgtctccttcttccacagcaccgcgtgcggtcgcttcttcatctgctgcaggtgcacctgcatgagtttcttgtcactacccacaacatcgcatcgcattcacggctcgtctgtactgccgcaaccgcgggctgcccaggaggcgcaccatccattctcaggacacgccacattgtgtctcggcaacaaagctagtgatcacagcgcgccggcaaggcatgccactgcctccttagggtgtgcggcggcgcagcctccgcaggtgccgccgacgccgacgccgcgtcgtcgacggcgcagtatgatggttcacccagaaccaccggagcacacaacggacggcatgcctgtgattctcgagtcgatggcactcgtatccaccccgcccgtggcgaaacgcgtgcgcctttttggagtctacatcgacgttcctccacgcgcccaggcggcgaggcaacacaagatttcaacccatgatgatggcgtgccatccgtggacaggaacgccctcaagaggaggcgagctgctgcggacaattaacgcctcctgatcgaattgtatcgtttagattgcaagttctgcgtcattctcgcggctttgattattgaattcttaatttgttaggactttggctcctgaacaattctttggtgaatattatgttttttggcaacatgtatggcagcagaaatgtttttcatcatcttttatattaaaattttgtttcattcttccatgcaggtcaatggtgttcaaatactttaactttcccaatttccatttccaaatcagtagcttctttttaaaaaaaaaaactaaaacactaatttcttggtcatataagtataatcctttcatgaaacccgataattattacaattagctgcccaattagtgcattccgttcgagatatgaacaaattcaaggttttcttttcacatttctacattattgcaattgaatcgattcatacagacataatgttgttcggtattcgttcatatacacacaaagacgatgttttcctgtatatatgtcatggtatttccattccggatacatggtgatgggtcccccacgtaacagtgaatctagctagtacaactccaagtgataaggcaccatttcattcgacttagctgatctactctcttgttttcagtttcttgtgagcacactcttcgaagtgctaaatgttgtatttgttttaaaaactttcttttgtagaagtttctttctaaaaaaataaaataaaatatttatttaaatttataatacttaattaatcatgtactaaggatatgctttgtttcacgtgtggctgattaggcagcctatataactctgccaaactcgacctaatctacttgtcttgcttgtcccgtgaagagaatctctctagctctttctaattcatatactcctcccgtcctaaaatataataacttttagccattaaaatttttcccaaaatataataatttctccactaacattctctttctaaccaatcacaaccctccaccattcacttttcctaactacctccactactcaaccaatcacaaccctctatcattcatttctacctactttcttgataaccgtgtccacctctaaaaatacttatattatggaacggaggaacgtagtagtatttatgcccttcctaatttgtggtgatgaaggccatgggcataggcggccctaccagatcaaccggccttgtgactcgtgccactggaagacaaccattaaagaggagcagatgggcaaccagccatccatcttgtaggtgcagccaatgtgaacgtgtcccgatagcccagcagcccattaggccccatctacagttctacactctctccaccttatctctagtcttcctagcgttatattgagcgcgaactacggaatgagcggcccttcggctttggcgatgggagcaggagtgggctacacgttgacgatggcatcgcaacgacggcctctccccggtgagctccctccgctctccctccagtgcgaagtctagatcgaggtcagcttcgattccttgcctcctctgccactggcgcaaccccgcccggtcggcctccacccactccccttcgtcttgctttgcccccgccaccaccagctatcgatcctacaactccggcggcgccaccgccgcctcgccacctgcctttgtccgcctcccaccaacggttcatcacctcataggccatccccctaaacccgatgccccacttcccccttcccattgccaccctcctctcacttgatcaagacatggtcccgatctcccggtaggtatcaataagtcgattgaggataactcaacgcgggtgatctaaaggctccgacctgaattattgaacccctcataatcactacaccactgctctgttggttatcaattgtgccgaaacacattagaacccaccaagaaggctatttcctagcgaatcaatagtacaagcaagagggttgcagaagtaatctgaatattacaaatatacgatgaatctcccaagtttgtgttccacaaaccgaactagtggcaaaattggatttcgcaaaataatgtcagcaaaatccgacatgagaacggctattgaataaatatgattaaaaacatcctagggttagccttaagtccaaaaattgtttcgaactagataaggtacgtggattgcgtttacaattctggacaactcggaaggaattttgacatgaggcaaataatgtatgaaagtggactcataagttctataacaaatacacataggctctaagagaacttctggatcagcagatatgtatgtttaaagttgatattgtcagaagacccgaactcacgaacaaaatttatctcttgtctattatagttaaaaaatgatgatgaagcatgagaggagaatagggcaaggcctgatgttggtccccgatccacctcagtgaccatgcgaacattccctgcacatgttccactttgcttcacccatacgagtacttctgcaacacacaactcaatgtgtagcatccttcgttcaaatgcatgtctaccataataaacatgcaccttgagttcattgatgatgtgtaacataaatatggtcatatccgagcagatgatgtattgatcacaaccctatcctcgaatccaaacccgagcgcttatcgtgccaccatcggaatgtatttgcgagaatcccatcacgcacatgttcacaaattaagttttacatcatgtcgtactttactcttgatgcttttctataaataccctgctagagtggaggaaatcgtgatgatgtgaaccaccaacttgtccatccactggcaccgatcaatgatcatctactagtcagtttgaaggatgccaactgatgaaacccgttacaaaagaaaaaaagaaagaccataattttcaaaaaaaaaaaacaaagaaagaccatgctcagccttgggtacctgatctaaaggaaaaattaggcgcccattatccattgttgggcacacgctgctactcgagctgacgcgcacgacaatgatattggttgctttgactacactcagcctagtgcaggcaactaaacaggcatgccccctctttgtttctctatgctacaatttaaaaggacactacttgtgtagttagctagtttctcatcttgtatcttcctcactttaaatggtttttctcccaaaccacctatcctatttacgatctaattataataaatatttgttttgatttaatatttataataagatcaaacacgactatattctgataaaaaatatatgttttaactgttaaaatttgatgcttcatttataagaaacaaatgttttaactagaatttaattatgttgcacatttaagttttttgttacaagaattttttcaatgttgcacatggtattgttttaatgtgtcatttaatgtttacaaatataacagatttgtatttttttaattgtttcagcaaatagattggaatgtatcaatatttacaactccatgtttcacgtatgatataaaaaaatgtttcaattaggaatatattatcacatatatttttttcatcagaaatataatcatgtaaaatcttgttgtaaaggtttagttacaatgaattcaacggtgcaattagattgtatatcgaataaattatttaggagaaaaaattatttaaaatttgataaagaaagttgttttttgttgagagaaaattgatgttgtgtagcacatcatgcatggaaaggttaaggtaacaatgagatgtttttttcttcgatatgttaaaatcgggcagggtactaagacaaattcatccaagaaccacatttggcacttttatcaggttagtatatgcccttcgatttattcgcagaaagaagggcttactggttcaaaccaaaatataagttaaaaggaccaatatccttctttgcttatatgaattgcagtcaagtaccgtagcagagattttctttacagtaaacaccacaatattacagcagcaaaatatggatttccaaattctttgctaggacaattagtttggtgctacaacaaaaactgctccagtagcgcaagctcgggagaacgagtaaatataacttgttatataacatacaaaaactgtataagtaattaaagaagcgcatatgaaccaacaatttaaagtctcaaggcagcaattgcttcaggcctgaagtcaatccgaagccctaacaccctcctaacctctgctggtgtcaaaagccatgtcagatgcccggcattgtcaccccagaaatccagtatctccgatacccgctcaaaattcagaattgttgacatctgggaaagtcttgagaacttgtctcggactggtctctgtgacatttccgagaaatggttgatcagggagcgtacctccttgtcgagctggagcccaccaagctggctgaacctcttctgcatcattatcacttcaagcctcttgacaatgaagtcgatgattaagtgcacaaaggaatcatagttgtttgatgtcatcacgggctggagccatgcaacattagtattaactgtaaggagaagcttctgcacccatggatcattcacctcattttctccatattcggcatcatccagctcataactgacagtggcaacagtgtccagaacaggacgaacacggggtgccacagatgccactaaatgctccagtccagaatgaaggatcttcttgaaggaagcactgatctcacctagctcagataaacaggatttgattttctctcggtcagcaggagcatgaaaagcctgttgaacaacaggaatagtcagtacagctgggttgtcaacacgaaaatactatgctacgaacaaagtgattttatcagataagagtgaaactattagttgtttttggtgtaattaaggtattttgaaagctcattgtaaagttttaatttgccagcaggtttctcccacattcctaattcatttttgacatgcgcatggtctccaatacatacattcgacaattaaactttctcaatgaatgttatcagcattataatatctacaaaattcctctttcaaatataatatggttggatttatcatgtgacatgtctgtgtgttcctcaccttatcatgtctattttgcagtaaaaccatgtgtcactaacttatttcagtcaatcaaatgcactacaattcagggttgtaagcacaaatgaaccaactaggtaacaagtaacatggagtccctaagtccatcgcaaacacagtaataagatgtgtgcatgatttatgttccatacttatttcatagctaagaaatttataacgaagcactcagctagtcagcttccaatcaggtacgcagcatcccagctccacaaccccaacagggcagtcaaattcctccatggaatgaagcagctggaggtagccaagttttactagggagttcagtgcttcaatgaggcagtagcaatgcacttaaaatattgttggtgacgactggccacaagaccacgctgtggcaggccttgtgcaatgggtgtcaaaaatgttagacatcaaaacatgtttgttgctacaaatatgttatccttttgcaatttgttctctaaagtgttgcaattgcaactattccttctcaatgatacaatgttgcccagtagatattagctagactttttacatttgttgaaccaagggggcattttgctgcaattttgttatataaatgttgccgttcaatgatttagaggcacacagtaggatgcctaagactaaatcactcaggggacgatgcgacaggaacaacttccttcagacatttgtcaagtccttctagttccaatgtaggaaaaaagctaagaggaatcaaggtcaaccatgagcatcggatttaatcttctggaaataaaactatgactacatttcctacccatctgcaggcttgccaaaaaaaattactaccattttttccctttatttcatggttgtgcagaaagatgcactttccggtgacagcaggtcatttgttttcaggaagcagcagcatgtatttgacaaatctcttcaaaggcagcaaccattctgctaccctccaagcatgcaatcatcacatccaaatatattcaactagcttagggggtcactggtggaaacctgggagcgttggtttgcaaatgcatctgtatgacaacatgcatgcaacatttgatcgttttgggtcaatggtgagtgggtaagagcacagataaaaaaaaagctcttgaaaaggctccttagagacgtactagttcaaatagctgcatgctaacattgattttttgtggatgagtgagcacaatcactacaaaacattgtgcaggtgtgacagatgcagcaaactgtttcaatttccttagcaaaagttagcctggtaaagtgaacattataatttgacagatattatgtactagacaacaatgttgatcagatacataaaaataggttacaaattcaagtgaaccgtggagggagcgaacaaaatgaactgttattataatgaaaaagaaaaggtgagattgcacaatttgtagcttttatctccatccaacaggagatagatttagcaaatagcagtggaccgttattgaaaacaaattgcaccataattgtaggaagttcctaaagatttatctacaggttacagcatagctaaatatatcctaactaagagactatttattcaaggaagacacatataacccttttacatatgtgatgctgttttggtgccactcataaggtgtgacaacatgatattatcaactactttctagaggcttctttcactaaacaaattacaagaactggacaaaagcaccgatatcttaaattgtaataactgagagactacttgattaatcatgatatcttaaatcccaaatgaatgcaagttatgaagagaagaaaaggttaacactgacctctgaacagagctcctcaatctcatgacggagcttcaggacatactctgagctaacatccatgttgttcagcgcagttgcaatctcctcaccagtcttctgaacaccaacaccaccaagaaagagctttgcacccaagtttggttccctcatcctccattgcagtgcttcctggtactcattgctcagtaggctcgccgccccaccaagcactgcaaaaattgagtttatacttgcagtggatgctgctcttcggcagcaactctgcagtacgaagaacacatcatccaccattgatgttgtgagaccatcaggcactggttcatcaatccggatggctttccttacattctcaaccatgaagaattcttccaggatcacataaaacccagttaaatcctgcaccattttattgaagctaccattccggaaggacttcatcgcttgtggtcccagctcaggtttgacatctcgcaatccacgaatcttattcaccataaattcagtatagtcttcaccaagctgtgtcagtgacagaatctcctcaagatagagctcgacctccctggggtcaggcccttcattgccccctgcagcattggccacagaactcaccacagagaggaggttcttggtatatgagtttatatccgaggcaagacgtgcaagtttcctgtaatcagcatatcggcgcagtatctgtgtgccccgggaatcacactcctcctgcagctcaatgatggcataggcaacaccatcctcacctctgagttcacgaagcacagcatcattctcctcaacggccaggacaatgtccttgaagagacgggtaaggcagccaacaaaatcaggccgctctgaagtaggctgtgttgcagaggttaactcagctaggtgctcgaagtcggcacgagcgcgcagggcgacgaccttcttgaggtaggcgacatagacctgcaatccctcatcagcgagagcgaggagagggaagaggcggacgaggcggagaacggcgggatggttcagcgcgtccacagcatccgccagccttcggcgcgcgagcccctccagcctgcgcttgatgtccagaaggtcgcggcggaggtcgtcatcggtggggaaccgggcgtcgatggcgaggaagtcgtgcgcggcggtggcagcggccgtgagatcatccgccgccagagcacggcgtgcggcgtcgagcgcgcgggacctatcgagcgccgcctcggcgcgcgcgagggcggcctccgccctggagtgcgcggcgtcgaggtggcgcacgcgggaggagagcgcctcggccagcgcggcggtggaggaggaggagtccctgagcgcggcggcgtcggaggcggcgagcgagaggagcggcggggcggagcggagaagggaggcggcggcgcggtcgaggtcggggcggcgggcgaggagcgcgtcgaggcgggcgtcgagggcgcgctggtaggcgacgcactcgtggaggaggcgggtggcggcgccggcgtcggtgagggcgcggagggcgacgacggaggccgggtcgccgaagtcgagggacggggcggtgtcggtggaggcgtcggggggcagcgcggcatcggggcgtggggagcgcgggatgggcaaggggtaggacgccacagccatgccggccagccgcggcgccggggatcgccgagatctcggtgggtaattcgcgggatctgggtgctctcctctcggtgctctctactgtggcctgcctgtgggaggcctaggggggtagtttgccgggctgcgggtgaagggcatttctgcggggaaaattaatttgctttcgaatgtttcattgttaagcaaactgtttttatttaaatctaggttgcgagctattatattccacattgtgagagcatctctagcaggggtactaaacacagcccctaaagaaattttgagaggtaagacaaaaaaatttagatccaacaaagcccctactaaaggccctaaaataggaaggcctccaaattatcccctcaagcccccaggcctacgggccttctccctggcccctattccacgcgcgggagagaaatcccacagccgccgagccgcgcgctctttttttttcgcgcgaaaacttctgctagcgccgccgctaaatcctctcttccgcatgcgcaccgcctggatcagcgccgtcctctccaactggccaactccttcctcgccgcactcctccctggcggatcatctccctggccggcaacctcctccctggcggcctcctgccctaccggccacctccctgcccggcggcctcctccctggcgccctccctctcggctgccagcccgcccgacgccctcctccccggcagaccacctccacgtcctgcgcccttctccccgtccgacaatagtcgaaggtattttttttctttttccaattgatttatggatgcaattagataagacttgttctttggtgagatttagcttgccagggcgataaaatggatgtgtgtatttagaaatctatggttggagcaagtattttaatctgttcacttgttcagagataagcatgcaaaaatttatgttcttttcagatattagtaggggaaattaattggtgagaaagaatctggtggtgatcactttgttgtattttagtgatctaaaaaaaatcgataataccacaactcagtaggcagggggaatgataaattgggtcgagctaatatggttttgggcaaagctccttccctttctattactgaaaaaatgaatagttcttaatgcactctgtaaataaatagttcttccgtgcactgaaatatctagactacttacattgcacctgttctgcaacagtgcatatgcatgactttaagacactgtgccacctgaaatcttgtgatcgtattctagttatatgcaggttcttcgagcaggctgttacaaaaagagaaaaaaaaaagctgctctgggtgctatatggttttctttttaattcaattttgtagagctctaccataatctgttctaaattctaatgattggaaaaattcgctaccattatgcattctaccaacatatattagctagtatctgccatttctcctgagattgattagagaagttgttaatttatctacttattgcagtgactagattgtgatggcaagtgaatgtgattcctttgtgcgcacgatgtccgaagagacccatgttgaggcatattccttgccaatgcaaaatgaagaccttcatacttcaacaaatggtgcaaaaggaagagccaaaagatcaagcaactttaatcgtaaggaggacattcaactatgcatttcatggcaaagcattagctcggatcctattattggcaatgagcaaccagggaaggcatattggcaaaggattgcagagcactaccatgctaaccgtgattttgagtctgataggaatacattctctcttgagcaccgttggggtaacattcagaaggaagtaagcaagtttcagggctgctacgaacaaattgagcgtcgacatccaagtggcataccacatcaagagcttgtaagttaaattttttattcattattattaataacaatcttgtatgtatgtgaactagcacttgaattttgctataggttcttgaagccgaggcattgtactcatccaatgcaccaaagaatagggcatttcagtttaatcattgttggctcaagttgaggaattctccaaagtttcaaactctaaaatcccacaagaggccaaggtctaggaagtcttctaccccaattgagagtgctggtgaagaagatgaagaaggtgatgatgctaggaagagtacaactcctgatttatcacagccaagtgctaaaaagagaccaatgggtaggaaggaagcaaaggagaagttgaagaatggaggagaagatggaccatacaaggaggcgatgaaagatttgcttgacgccaaagagaaagaagctaaagtgaaagaagagagatggaaggaaactaatgatattcaagagcacaagctcttatttgctgagcgtaagttagtgtgggatcaagaacagaagatcatgttttgtgatgtttccaccttggaaccagatgtgagaacatatgtgttggctatgagggcacaaattgcagcttcaaaggtggctgccctcaatggtggatttgatggtagtagtggctttggaggtgagtttggtggtggtaattgagaagtttgagcacttcgatggaataagttggatcatattggatgatccacatgtcctttgctagtaggatatgtcatttccacgattggttcttggagtccttttgtgttaatttttgcaattatctaagtgtcatttgctagtaggatatatattacttttagatttgttatttttatgatcgaaccattcattctttcttgtaggatgtgttatttttaaattatataatgcatctccgcaaaataaaaataatgcatcactgggttcacatagcatattgtggtgatatggagacagacaatgacatgttggtgagcaatttttgttttcattggtgaattataaatcttggttgcgtgttgttgtatatggcattgtgcctacaccatatttacatgtttgaaaattttgattttcgatttgaattgtggtgtttgaaattgtaaatttaactatggttaaattatgcgcgttagaaatatttatgtttaattattgtggtgttaaacatagtgtaaaaagggattgcatgctaaaataaaagagaaacaatagtaggggctattgctagagttggaggtattttttgggtccttgggagatgggggcagccctcatttaacttttaggggctttaaaataaggcctattgctggagatgctctaatgttatgaatatagaactaaccatctacgactccctgttaggatgtatgagtaatttttaaggcctcctttaaattatatgaataaagaaagcaaagaaatagaaaaaacgcagtattctaactagaatagaagtgttaaactgatgattgcaaaacatataaaaacacaggaatgaccgcttgattggaccgtaggaaaaacataagaatcggatgagagagatacactcaaagtaaattttccaagagctttgagctcttgctgagtttctttcaaaatctctataggattattcattccataggaatttcaaatgattagaaatgattcaatccgttaattaaaaggcatttatagaaatttttcctatagaattgaaatcatcccaaaattcctatatatttcctccaaatcaaagggaccctaagtgagtaccatttacaaccaactccctctatttcatattataagtcgtttgacctttttcttagtcaaaattctttagctttgaccaaatttataggaaacaaattagcaacatccacgacatgaaattaattttattaaatttaatattaaatatattttgataatatgtttgttttgtattggaaatattagtatgtttttctacaaacttggttaaactttaagaagtttgactaagaataaaatcaaacggcttataatacgaaacgaagggggtactcaaataaaaacagtttgcttaacacttactccctccatcccataaaaaccaacctataattgaatgggacattattgacggttattaagtactagtttcaaccgccaactagcacaactaataaagggaaccttagggcctgtttgggggagcttcttgctgctgcaacttctatcaaaatcagaagctcccccaaacagtccagcttttggtccagattctgagaagctgtagttgtagaatctagaaaatgaactagaatccagaagctggaaaatccagcttttccaaattctcagaagctgactaccaaccagctgcttctcagaatcttaagctcccccaaataggcccttagcatgtcttacacgcataccaataataaataatgtagttgtattaggattggaaaattaatgtggatgcatgaattatacgccaaagtgaaggagaaattaagccggcatgcaaagaaaaacacctccagtgaatcacgtgcaaccacacggatttaggggccctcaagtcagctcaaaccgactcaaagtgggaccaaacacccgggtaccttcataggggcccacatgtcagtccctcaccaaagttggtgagcagagtggttgaatgggttcggccgaaccaatcttggtgcacctgacacccatcttccacgtggcgactcctcagcgctccccaatgacggttatgcgcagttagcggcccctaactgccatacaaccgtcattacaaggctataaatagagcttctctccctcacatgcaacacacacctcatggagcaattcactctttcgctttatattctctatagtttttagtaggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41488 - DNA, 1095 bp, Oryza sativa
  unsure (1)..(1095): unsure at all n locations
aaaacaggaaagtgcagcttttttttttccaaaggtttgcacttcacttccagtaaagcttgctgtttcttttttcttttcaaaaaattgcaagttgaggctatgcccccgttcaacatctgatgacaatggattagtaagaaaaatcaaatgattcttgaatggcaaaaaaatgtataaatttgtactatcctattcgacataggcaggcaatgtgactaacactttcccatctcagtagcctccgtatagtgcagcagtcacaattattattatagattttggaaatcggcagacctaaaattaaatggatgtaaagacaataatttaatcagatccaaacactttcgatgagaggtaataccttactcatgattgaggaagtccgatagtatccatcggttgtatattgatctaacgatttgatagtgcttatctcgctatatgttcttggagggctccctatccaccttatataggtaggggatagggttacaaagagaatcgaaaaacctaatcggatttggtattagtttgctaatctattatatgataatcctcactcggtactctaggtcctgccatagaacacatggtaacattgcaaccgagtcctactctatataatacatggatctggcctatcacctatctctaatcgaatatggaggttgtatgagtacctagtatccatattctccacagtagcccctgagaccttgataatcgagttgcagtcttctcctccacagtagcccctgagaccttgataatcgagttgcagtcttctccgtgattcataacctatactgactactgagtgcttcaatcttcgatgcgaaggcttctcgattgattacttgcgtttatccaaaacaagtccagattgaaggtatgatccacgtgcttgagctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41489 - DNA, 718 bp, Oryza sativa
ttttaaataaagcgaaaaggtaaaaggtggcgatgcgccgaattgtattgatcgtggagatagattacatagaccccgggtgtacatatttatacccatgggttgatacaagtccttgtcggacaagaaagaagctttcctaaagataaaaggaaaagataaagtccttataggacactaaacacactttcctaaagataaaaggatactaacaaactattcctaattaatagataacttgccatgccacattctctttgaactcggtctcttctggataagcttccattagtagatcaatttccttaaccgaatatagcaataatcccacaactgacgacttgacaactctcatcggctaatcgcaggacttcgaagccgatgctgactctaagccgatgactactccgggcttaccaaatttcactgttaacacatgcgcagcagttttggagtatgagaattcatgcttcaaaatttcttgtcttgataactccaaaaccgatcttcctttgcttcttgcaatcggctttcatgagccgatactgatgtgctccaccatgctgaaactgatgcgcttgccccctgagccaatattgttgttcctccattaaactctccaccgtgaccatgatcttggcattgacttcttcttcagacatgtggatataaaattcgtggtctcaccaggcgtgccaaaagcgtgttgacgttaaac

SEQ ID NO: 41490 - DNA, 11820 bp, Oryza sativa
ttgccccctgagccaatattgttgttcctccattaaactctccaccgtgaccatgatcttggcattgacttcttcttcagacatgtggatataaaattcgtggtcccaccaggcgtgccaaaagcgtgttgacgtaaaacacgagacctgggagatctacttaactccagtgcaggtccaaaactcgccttcgggtatgttagcgtgccagttgatttgatcctgcaatcaacaagatatcaaaacaaagaaaccgcggttaaacctataaacgatagccgatcggctaagtgccattgacatatcattgatctttgagccgatgtcatatgtaaattgatcggcggttgtaaataggtaataaagaactaaatctactcgatcggctatagatattagaaatatataattcttatgtcgatatatacttaaatcaagcgattgggatagatcggtcgccatgccgagacagtataaatcacttagatcgaaatatatattaataccaggattatatatgttcgtagcatagccgatcatatagatctagcatgtatcggctaatactccgatacaactctatgttaagatattaaaacgaatagaatataccaaacaaaagcctaatatacttaaatgaaataagatctttacataaatggcagatttaacatgtcaataaaacacatagagtaaatgtagttaaatcagataagatcggctaaaactctgatgttaccctaatcaacagccagatggcaggctagagattgatattctagcacgacttaatagatcaaactcaactgatgtagcattaagtataaaaacaagaacaatatctagacaatcaagccgctggaagtttcatagagtggtagatatctcatataatctaagtcaacttcggtgtctaacctaatcggctgccctctaccgatagatgttagccgattgtaggttagatagcgagattgccaaagattatgtaagatatatgataactcgacgaattacataaacaggattagagtgtcataaagatggaagcactaatcccgagaacgcaagctgtcataacaagttttacctcttgttgaagatcgaaaccgatgtagctcaacccgaatgcaagaactcgtcgaaataaaactaaagcaaaagggtggcgatgcgccgaaattgtattgatctagttcagtcacgtttgcgagcccttgcaaaagttactaaagagaaggaatgagttgctcggtgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccactggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcatcgagcaaaacatttaagagaagtaaaacagtggagtaattaatcagaaattttaatcaacactgaacagcacacccatgctgcacaggcccaaccattctgaacaaccatacccggctgaacagatctaactccaaaccaggagctaagcaaattattacccagtataacatccatagttacggtgagaggtgtgggactaatcacgaaaaacattgctcaactcgcccataaccgtgggcacggctattcgaatagttttactctggccaaaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcatcccctcaaaaaccagaggcatggactccccagtgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactgtcaaaaccatgtgctcacaacccaccattatcaagttttagttggcaagtaattaattaaccaatcacgattaaccatcgtgaactatcaataaaccatcattaaataataatgaatcataagttatcccaatagtgtgctaatgtttctaagcatggctaagcaatcacatctaatatctagctgaaccaatatataaagctcaactattcaaattataataactcaaggtatcaaggattaaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaatattcggtcttcaattaatcttcttgaacacttccgacgcactcgcgaaccttcacaacgacggaaacgacaagctaacacgcaaaacgaagaaaaagactaataaaaaccaaataaacaatacataaaaagtaaacaaacatgtagatcatatttttagatgaattatgagacttgaacggcctcattctgacttcaaatgaatttattatgaattttacaagattaaatctatttaaagcccatttaaaaagaactaaataaatttaattcaatttatggataattttaatatgtagatctttattttatataatttttgcaacttgaaccacattaaactgagttacaatgaattagttatgaatttttaaagattaaatcggattaaaacacttatatggattttaattgaattatgacgcaataatgaattattttttaaaaggaaaaggaggattattgcgtcagcggctagggtttcacagtgaaccgtgtgcacggcaacggttcacgggaacggacggccgagatcaaccctatccaaaacggacggccgagatcgaacggatccaccgcggctcacggacggacgacgacgatgacgtcaggggtgacatcagcgatgacgtcagcaccgacggcggctcggcagctcggacggcgcaagctcaccggcgaacgacggcacaaggacgcgaacgaagggcaccaacgggtagagggcgacgcggcgaactcaccggtgaccaaagaagcggcggaggaacaacggacagcgccggcgacgaggaagaagcggcggcatagatcgggtctacggcggcgacggttctccggcggtcttcggcgatggtgaagcggcggacgaggacggcgacgactggcgaccacgatggcggtcttcccgagcgatggcgacgactggagcaatggcgaaggacggctggagcggcggcgacgacggttgcgcaaaagctacacggcgctagagctctacggacgacgagaggcgaaggcgagggtggcgatgggtagaggagagctcgggggtccttttaagggggctcggaggcgacggcgaaggcccacggctgccggcgacgagaaggaaaggtcggggaaaaacgaatcagaatcaaactcgaatccgcctatttccaaaggaaattgaccggagtttctataagagaaaaggaagaggagatcgaggagattatttcccctcaatctattcggccggagaaggaaaggcgcggccgaattggaaagcggcggcggcgcggctcggctagggtttcgggcggcggcggcggctcgaggaagacgaacctgacaggtgggacccacctgtcagcgacagagagagagaggagagcggcagctcggcggactgggccgactgggccggggagggagagagaaagagagaggttttgggccggctttcggcccaaagccaaaaggaggatttaaaaacatttttctatttaaattattcatgaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttttaggcttttaaaatcatttctaataattccttttaaacaacaatttataatttacggatttttaaacaagaaaagctcttaacaattataattagatcattattgatcaaataattactgaactgttctttgtatcatttaggaattgagctccgaaaaatccgagaaaatttcagagagttgacttaatcatggagaatttaataaaaattaaatacatccatgctttatatttaggaaattttatttcccacatttaacttcacttgtaaattaaagaacatttaataaaaattctattaataatttattaaataatttataaatcctgaaacaaaaatcaggatgtgacactcggcattacaacaagaaggtagtacccaaagatttttcggaaggtgaacttgtattgaagttgattttgtcgattgggactcgagatagcaaattcggcaagtggtcgccgaattgggaaggaccgttccaaattcataaagctgtatccaaaggagcttacatattgcaaggacttgatggagaagtctatggcagagcactaaatggcaaatacttgaagaaatattacccaagcgtttgggttaatgcatgatcggctgatgttgccgatacatgatagccgatgtgttttcatcgtcttgagatggccgatattattatatcgcccttgtttttttttcatattgtaatcagttgtggtttgccgatattactatatcgcccttagttgtttttataattttatcaatgcttttgacattgtaaaattaggggggcacgtatgtataaaaaatgaaaatgaaaatttttgagcgaagttagaagttgtattaatcaacacaaaggattgttaagacagtaaagtactaaagtatgttagccgattacaaaaaatttctaaggcctattacacaaaaagtcatcgagacaagtattgctggatagcagaaatagccctttgcctaatttgttctacttcttcaatagcttgggcatcttgagcatcggttccagggatgactttcaaagatttggtcagatcagcaacattcttgatagcctatttgagtcttgctttctgctcttcgatggacttcgggagatcggccagctttttatgttccatacctagctcgtcgttgcattcttcaagttgtgccaagagctcaatcttgcgagcttcgagccgatcaatattggacttgatcgggccctcagatagctgatcaagtttggttttctcttcatgaacaagctgtcgattggtttggattgtagctttgatatccttgcgctcccgacgttcggctagtcttaacttggctttttctagcttgaattgatgttgttcaagatagaccgctagagtaaggatatcggcaagctcatctgggattagagcttggatctcatgtagccgagtcctaattggctaacagttcaccaccaagctatctaaagaggaggcctctagccgatgagagatatcttcaagtgttttcttcacatcatcgggtaagggggctagagctttgctcaaagtatcttcttctgcttcatcgagataatctctgatgtcaaaagagaagagatcagctaaaacctgcagggacaattttaggaagattgagagctaagtaaatatagccgatctaatttcttgcatcaaggggaaaacttactgggatagcaggagcagctggttgttcttctccctcaatatgatgacttcctacagccgatggagttcggtcacttgacgattgctgtacatgaggagaaggaggaggaggaggctgtaaaagagacaagtgttagacaaaatcggctgggattaattaataagagagttaaataacttgctggtggaaccggtttgcgaattgttgttgccgatttcttcttcacagcagctttctttttctgcaactataaagtctgtgattcatcggctgaaaatgaggtgattacaaaaaggatcaaagagagctgcttactcttaagaagtgagtaggggcagaaggagttggaggtgtttgcttaggcgaagccgatggtgtcttttctgtatcgcttacttcggctgcagcctgatcaacatcatcatcaatgtcttcttcatccagagcttgctcaatagatggatccaggacaggcagatcatcggttggtttatgtttcttgagtttggctttcttctttggagctacagttaatgtatctgctgccgatgacctggttcttcttttcttacctgtatcggctggttctctgatgagtccttgaagaagagttaaggtcttgggggcatcatagccaatgacaggaggggatggtccacctccatttggaattagtcctggggcatattcaatgtccctaccattattgctttgatgtggaggggaggactctgttgtctgcaaaacaggaacaaaagattagtcaagtaatgaattggctaaccgttatgcagtttagtaatgacaaaatttacctggggtataacatcagggaatagatctgtcatgtacattgaggccgattggtgaaataaatgcagcttccattcgccccaccatctgtcaaagtttctgctcttgaaacctgccagctcaatattttcaatactgcctagaggaggtccttggagattgagcagccgatccatcattaaggttgatgaaatttctcctcggcactggatcttgtcgacaaagaataagccgattgggagttggcccagtccaagttgtctagccgagctcattgggtggtaaaactcgtaagagacttggatgtttcttccctggtgaatgcctacgggtaagatgcatgggctgattgcagctgtgagaacttccctggctttttgtatctttcataattgatgtcttcaaatctaaagtctgatggaagttcaagatctgctgaatcttcataagggaaccaaaccagtgcatctttctgaaagccctcatagaagctgcagaaccagtctttgagcagctcaaccgatagttttgctccagcatcaattggtgtggatgcatattctccgtatgacatgcatctgcgatgagtgcgttcttctccatcattttccacaatcggctctggtaatggaaatttagcttctgtcacagatggcagattgacaactttcatgaccatcagattcagccaagtttacagcagccaccatggtccacctgcaccaactactgagccgacggctatcttggccgacacattgttcaacatttggtacagatagccaaggaggattttgcccaaaggaaattgtttctttgattctagggcttcagctacaaattgccaattggttgtagggccacagctggatccacagaagagaacttttctagccacattagcaagaaagctacatgctctcgagaagtaacagacccttggcccgtatatgctgccacatagccagaccagccacctatgcttttagttctaaaataaaactgattttttgtgttcatgctcataggattagccgatgaagtcacatctaaaccagtgatcatggtaatgtcgatcaaagttggagtcatcggccctcggttgaacaagaaagcattgatggtgttggaccagaaataggtggcggcagccatcagaggttcgtccttagcagatttggctatggtgagagcaagcgcttggccgatcccgatctcattccaatgaaccttcttactagccgatatgcactggtaccatgtggtccaactcttctcaggggtggttttctcaagagatgaccaagatttgaaagtattcttccagtgacctagattagggttggctagtctaaaggggattctgttggtttcaccgatgataaaatcagtggggtcaagattgccgattgggccaagaaaatagtggttttcgtgcgacaggctggggatcgcaactaggttggaaatgtgctgcaaatccaaagaaattgggaagaggaaaacacaatgagaaaaggaggaatcgattttatgcgaggaaaagggatctagccgatgagaacttacctcagcatactcggctgatggcgcggtagacgggctggaggaagacgacatcgtcgcaggcggagatctaaccggagacgaagtcgcttggggatcgcctcgagcgtcggaggaatcgccggagagagaaaggagaaggttggcttcggcggtgaagacggaagtaacggggtaaagatttctcgagggtgacggttagtatttaaagcacgggtgtaacggtcggaaaacggtaaagtgcaaaacttgctcggagtcgatatacagcaaattcgaaacattaccaaatatttcggacctggggggctcgccgaaattgtattgaacgcatgggttcatcttcgggccatattttctagttctctcaaaaactttcctcaaatcggctatgtggtcctctatctccttagacttaacaaccacatcatcaatgtagacttcaaccaaccagccgattagatcatggtatatgtaattcatagctctttgatatgtagctccagtactcttcaagccgaaagtcatcacaacccattcaaacaagccaattgcaccagggcacctaaaagccgtcttatgaatatcctcttcggccataaaaatctaattatatcccgcatttccatccataaaactcaaagttttgtgccctgacgcaacatcaatcagctgatcggccaccggcattggatattcgtcattcggggtagctttatttaggtctcggaaatcaatgcacaccctaaccttgccgtttttcttaataacaggaactatactagaaacccactcagcatatcggcaaggacgaataaaaccaacatcgtataattgtttaatctcagccttgacaggttcaagcatgtcggctttgcatctcctcggagtttgttgatgtggcctaacccctagtttgataggtagccgatgttcaacaatcgatcggctaagtccaggcatctcataatactcccaagcgaagcaatctctgaattctttcaacagctctatcaacttggttctaaattctgcagacaaattcttactaataaatgtcggccttggtcgatcacctggacctatatcaatttcttccaaatcatcggccgacataaaaccctgtccttgtttgtcatcgagatcatctactgtgtccttgttgtagacatctgaaccctccacgacgccctcaaaataatagcttgggttctccttcaattggctgtatatcagaatcggacacttttagaaaatctccaccccaatcttttccagataaacaatcaagaccatccgtctcccaaagagctaaatcggcactggcaacattgactgacctgtcggctggcacaatttcaatcttgtcgccttgccactgaatcaggcattgatgcatggttgaaggaatacaacaattagcatgaatccaatcccttccaagcaacaagctataagaacccttcccatcgatgacaaaaaacgttgtagggacagttttgttgccgactgtcagctccacattcaaaactccattggtttctgatggattgtcgccaaaatctttgagcaccatgtttgtcttgatgagatcttcagcgtttctgcccaacttcctgaatgtagtgtaaggcatcaaatttactgcaggcccaccatcgaccatcatcttggacatcggcttcccattgacttaaccatttatatacaatggcttaagatgccgattctccgtcccctctggcttctcaaaaactacctgctctggcgacaaaatcaatttagccgattcttcttcaacttcatcgatatcggcttgcttgatcccaaactcggtaggcaacgtgaaaaccatgttgaccgaagcagttacaacgctgtttcctttagccaacctttttgcttcatcggctgtggcttcatcggccaccagaacttgattcttagcacgccactcctgcctcggctttgttttcttcatccgatggttgatttcctgctcgacttcctaaaagcgctctctgttcctcaatctttgaacccttttcttttgattcttcataaagataccagaaggacaccattgagtcttcatgttttcattgtcctcttatccacgatcttggtttactggacccaatctttgatgaataggaattctcatctgccttagccgattgcccctactatatgatcggctcgagctctctccaacatcactgcacccaggacagtcctcaatagatggcagcctcatgccttcattccaacaaaatctaaagaactcacagccctaatgaggattaaagccatcatcatcttcttcacaatgcttttcctgttgcttgtcgtacttcctttgatatttgttgataatcttagtcgaatttacctgaaaacctcttacacggcccccatcggctgttcggccagctgtatgcaccatattaacaggaaaatgattgccatcaaccttcatcggcctcttagtgtcatcaaatttgattttgcctccttcaatagcctcttggatttgttgcctgaagaccttgtaatcattagtcgtatgagacccagaattatgccacttgcaataccttttcttgcccaattcctcagccgatggaattgtgtgaccagtaggaagttgaatttgcttctcccggagtagtaagtcaaaaatcttgtcagccttggtgatatcaaagtcatacctctcctcttttcctgtgttctttacccattggcacggtataacctttttgctccttacccattcggccacagctatctcagaatcatcatcctcatcatccgacccatacatataaggacagacctttgttcatgcaaggtcaccttttgtgcgagatgggacaagctgtcaaaatcctcagatgagaatttctccctgattggagcaatcataccctgaaaagccaaatcggctaactgggcatcagtcaaacttaagctgtagcacttattcctcatctctctgaatctctgaatgtactcatgcacaggctcattatgtctttgcttgatcgatgtcagatcggacactttcatctcatgaaccaaactataaaaatagttgtgaaactgtttttctaaatcggcccaactgttaattgatccatatggtaaagaagaaaaccaagtaaaggccgatccagacaaagataactggaacaacctaaccttcaaggcatccacagccgatgcttcaccacactgggctaaaaatcggctaatgtgctcacaagtcgatgtactatcttgccctgaaaatttcgaaaagtccggtaccttaaaccgattgggcaaaggaaccctctcaaaccactcaggatagggttgtcggtacaaatttccagcatctttcggcctaagcccaaacagctccttcatgacatc

SEQ ID NO: 41491 - DNA, 1711 bp, Oryza sativa
ctgataattcgaattgccccctagtaattttgaagatccggctgaatattgtgcaccaaatgctcaggaataacttgaggaatcactgtgccatctggttgtacgtgatgaaccaagtgctctggaataacttgatttgcagcatgctgcccaggctgaccacccagtgttgcaaacccagccaatgcattcatagagccttgctgctgaatcggctgaacaacctgctgccttaatggcgtttgctgaattggctgcaagacctgtcgtctgggtggtgtctgttgaactggttgcacaacctgttggattgggagtgttgactgaactggttgaacaacctgctgccttggcggtgtttattgaatcggctgctgctgggtttgatcaatggtgtgctgaggaggtaagaacatagatgcaacctggtcttgcgttagccgattcacattctgtccagcatgctgtggctgttcccttaccaacaaccagggatttattctttggcctggagccgaaggtggtggagcaggtgcaggaagcgacaccagtgctgccggctgagccgatggtgcattaagaggaatcgactggatgactggttgattatcggtgattaatggccgataattagggaatacccctcctggtaagtacactagtcctgtagcttgatactcggccattgaaccatcaaccattgacttcaccatgtttgccaaagtattagttaatatcccaaattgattgattaaagcatggtgtacagcatagtcaacctaatcttgaaagttgttgaactgcaactgtgctgcattgccgtcttgattaacacctccaccttgaacaccatcaccttgaacaccttgagaaccatcgccttgaaccccgtgcactccttgcaagttgtcaccttgatttgctggaaaaccatctgtagaacctttgtcactcggttgagccgagccatctggagcttgtttcccttcgtcatccttggaagaactagtcccggggtcatcaggaaccacctttattttatacttctgaacaagtgctcccttgcgggtctgcatgaacgagttcaagaactgttctcgtgcttgctacatcatcgcttcaaaatcattcttttgatcaggtgtgaacttctctggatcgatggtcacaatgttcccttcattaacctctgacaaacctaacttctggatcttctctttaatagaacctgggctagccgaggacggtgatgatggtggtttctcgaccatgaagaaaccgcttgctgacttctaatgtgtcccatcgggcatgccaatttgtgttgatgcaaaaaacacacactggcctgggagatctgcttagctcctgtgcaggtccaaatcttgatgagatgcgagtgtgccagtcagtttgttcctgcaactgacaagatatgcaaatagtagatcaaaacagtcgatcggctgacaagccgatggagtagttccagccgatagccgataatagtcgatgtcgataccagccgatagcgatagggtttaagcaatcggctatatgtccaatgtagataatgatatgaaggcaatcggctgataacgatgtaatgaaataacaatataatctaatataaactaactgacaaataatgatatgataaataagcatcgattcgaaggttaaagcatacatcggctggaggtccgatgtc

SEQ ID NO: 41492 - DNA, 5066 bp, Oryza sativa
  unsure (1)..(5066): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatgtgaaggtagttcaaagtccgaccgcttaatcgtagctgctaactactactaaaaactgtccacatggtaagcacttgaatatgcatctcccatctgttgaatatatcagaacctgcaataatcatgttcttaggctcccattggatggcctaattagctaaagaaaaagccaaattaaaaattttcaaacttaattttgagatattttcactatagtttctttttcaatattggcttttaaatcaccaagaacatatatatatataaaagttttacctacaaatttatttgtatttcctaataaactgttttggcttattagggaaaaagccaaacgatggggcccttaagattatcagtttacatcgtataactgctaacaacaacataagagtagaataagatattagtttccgtttgggtgaaccctatattttatctaaaacaaaaaaaaacaatatagctcattggggtgaacccttaagagcagaataagaaattaggtcagctgcagtgagaaagaactcaacgagttcttgaacagaatattggttaagagataacccggtatgttttttgggggtcatgatccaatataccaactgattggtccttaaagtccagatgataaccaaattcgtcaatgtaatcgaatatgaaccaagaagcttgagtaaacctgaataggaaaaaaaaatgttagtcccattcgaaaaaaaaaagtagtgtggtttttcatacatgcaagacaaagtaattgacatttttggtttggataatggctgcgggaaacgggagggtttgctggggttttggacacgggggagaaaacgttttaagaatggagagacgtattctatgagaaaccgccttcttagtcaggaagcggatttacactcagtaaaagcaatataaaaacgacatctcacattctcaccacgtcgtcctgtatccatgtcgatgtttgacctccaagcacagaaatgttggaggaattgtcacccctttccattcaatttatacagtggtttcggtgaactacctggtcggatttattttctaaagaatacccacgtctcaaaataataatccatgtgtatgcaaaacaatctcaggaagttacagcgtaataccattataccactatattatcttgccgcacataaatgcggtaattccgagtcaacagttaactgctggttcagcacaaataaaaaccaaaccaaagaagaacagcgaaaaataatatctgcaattaaatgagtccaaaaaggaaggaaaaaaaattaaatgatcttcccacatcaaaatgcaacgggccgctactatttatgtacattcccgcatttcttccgatgatgccactgcagctagtgttactgatcagcagctctacatgtttttactaattaacaagaaaccgtattgatctttgcagggaggcatcccagtcttctaccagccggagccccgatgagcttgaagagtctccacggatttgccggagttgagtagtagatgtcgacggggccattggtgcagttgatgcttgagtcgacgaccctggtgtgacggcgaccacggtggcggtcaaggtagacgacgatgatgctgatgtcgtcgtggaaacggcgcctcacttctctatcgtcttcagatggaagttgacctccctcttcctcgtggcttccttcaaagcggcctttaccactctgtttgctacatcctacatgaatattcagaggaacttggtgttatctcattgtgtgattcctcgttcattcatggggaataaactcccgatgatggcatgatcgaatgctgtagatgttgtctgaacttaccgttcttggattcttgaagacaatctgcaccgcagcgtcatcgctaagatgctcctagggaccatctgaagcaaatatcaggaacatatcatttggtttcagcttgcgaacttgaattgatggttctgcactaagagctagctgctttagaggaatagggggaccaatgctacgaaacacgggatccatgctatactcttgttccttcaagtaaacatcaccaatggttctcgatacctgacagtagaagagtaaaattttagcccatgtctctagtatttgacataaaaatcttatggtatcttaagataattaggtaagtgaaccgagagataaagcctgatcaaaatatcaaaccatgtccaagtgaccaagttcattactctggtaagatataataaaagtagctgtcatactttcacacttggcactataaattgtgaaaagtaaactatgaaaacaatataactcatcgtttttcattagttttcctggataagcaagagtagctgtcatactatgcacagttggcagtacaaactgtgaaaacaaaaatactaaaacttggtcatttttgctcgttttaaaacaatgacaaatagtagtcacaagctcacagcatcttcttaaagcactgcctgctgaactggtccaagtcctggaaacgtgtaaaacgacttttaagttgtgaaatcttcaaagcaagaactttaagactaacaattactcaattagtctaacacatatgatgaactgcaccaatcaagctatgcaacaaaggttgagtaattgacagaaaggggcaatttattttaactccttggacagtaagttcaggatttctgaattcaatccttatgaagctctgatacatcatatgagaagttgcaaaatgcacgaattcactctaccacacaaagctgtggataagttatatccagaagcaacaatttttaccaccaaatcctggcatacatgcatcaaattaattaagtaaagagaagtattttctcatcgaactctcacctgaatgatccccttcaccctccacgcaaccctggtgtgcaccaggatctggccatccaatcctgtgggctgtgttggagtcacctcccgcatcgagttcttccgcggctcttcttcaccgaagaagaggaggggagggggacacaggcaccgactgcaaccacaacaccgtcgtgaggggacactggcgccggttccgaagccgccaccggcccagacgtagccaggggaggggaacacctacgccggtcacgtaggcttggccgcaggcccctttgcgttggctccgatgggcggcggtcgtgcagccggctccgctcttgcgtgcaatgccctctgcttccacccagccaacgccagccgggtcagcgtagaccgaccgtccggccggcaccagatccagctttcaccctctcctctacgtggatgcgaaggagaccacaacgcgtccggataaaggtagacgaagccgaagctgaagaggaatccaaagaatcccaagccaacagactgcgacgcatttgccgtccccgaccttatcgacgttcgggttcgaggagtcgccttgccacccagcattcgtggtgtcgcctcagccttgtcgttgccgtttgtccctcccctccccagccaccttgtcgatcgtccctcccccggctgcaacctccgtccctcttgaagcagtactgaacatcatgaaaggaggaatttatttttgcaatgcaaatgtagctaacggtttggtttatggttgatttgtagtctctgaaaatcagtgtatcgtgtggtatcaagcaactgcagcagtgtctgtcatgttctaagagacttagactgtgcaaatggacctaacaatgccatatatagttaataaaaataaatcatgagtttgcttgtcatacagagtacaatggttctagcatggaaatgtttggatttgtttctgtaatgattttttaccttatttgcttcatataatgtcctgtatagaaatggatttattggataaagtattggatgccataaaaatgccaatgtcatgcaatttcgattttgtatataactagcaaaatgcctcaaatatcattagtgggtatgatggcactgattgcattgatagtctcctgattatttcttttttcatcacttagctgtccatgttcagtgattttttcttcagtactcatcacatactatatcagttagtatttgttctctcttgtcattttcttccaggtgcaatattaagttctgaacatagtattgtctacaatcagatttggggatcagactgcacgtaggcttcctgactgatacactcaattaagggaaattaacaatcactagagttcagtttcaagttaatcggaagtaatcaattgggggaaattgagactgacaagagttccattttcagtcaatcaaaaggttaatttttttttgttcacactgacgatttccaactcaaattctgttgacgcatgtaaacaatctgagagtttagagcacgtgaaagctaggcaataaagttataacaccgagcattttgataaattactttgctcaaactgggacctaacatcaccatcagtaaaattttgaaataacattcatctataagcgaatttacttccaaacatcactttggtcgttgatgttaaaaagaagaaaaattattttcaaaagcattgtttccactgctgtcaaaaattaaaaaaaaattggctcacacctactcacctgaggtacgttcttttactaatatcgttgtattgtcttaattttgattttttttttgtcttaggaattccattatcaggactacttaatatttcttagcattcatccaatgcttcgggcatatgctctgtcggtgacatggggccgggggtatcgtgactagaggcttgggtagccgctgtcacccacgtggcctgaccctatcgggggggtcgggcccgaggatgatgtggccacccctccctctg

SEQ ID NO: 41493 - DNA, 10235 bp, Oryza sativa
tgtggttttggcgccacgtgtgtgggttaggtgagcacagcggggctcacctaaccgcatttaaagcaggttggacgagcgcgccacgccgcatttaatgcagcgcagcgctcgcttacccggtccgtgaccggtcgcagtggtgaccggtcacagaccggtcggatcgcgggttaggtggcaacaggcggcctgtcacacgcctcgccccgtcccgtcggaatgatgagagcctccaggcactcgtccctagccggagccggcgtgctaactcctggagttggcacgtcagtcccggccagattcataccaggcttcattgcaaccattgcaaggaagtcattgtatgaagaagggcagacatgtggcatgctaaactgacgcgtggtggacaaaaatgaccggtctgtgactggtctgacgccggtcacgtcatcggcagacaaccgtgctcccacgttgcatctgcttccggcggagtggaggtagatatgacccatcccgtcggagggtaattcggacagcggcaattgcaaatctccgcccattaatgaaggaatgacaggggtatcccctgtgtcaggcgagtgacggcgctgagcctcactcaaggacaagctgtgatttagcttccaggagaaggcgcgtgccaagttttggtcaagatagggtgggtccccacccaaaagaagagtaggtagaagtggtgcatgtggtatccccttgagatataaaaggaggaccttgcccaccgaagaagggggactggaggacgacatttagaatagctgaactctcttgctctccaactctctgtaactctttcacacacagatccaccagaacacaggagtagggtattacgcttctcagcggcccgaacctgtctacatcgcccgtgtcttgtgcgtttgctctctctcgcgaacattccatagatcgagggtgaagaatctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtgctccaccgtccccctctcgccgaagtcttgggcgggaaaaggcgctcgaggaggtcgaaagattcgcgacttcgccgcccgcgggcgatggagaaggacggcgagacggggagcgtcgcctcctcgtctacagtgatggcagcacgtcccagggcgcgctccaggccgcgggtgcgctcctgcgtcacccgcccgtcgtccccgatccagagactccagcccgacgttggctggatgacgtggccgacttgatcatgacggcgcagcagtgcctagacgccggcgggcggtcctccgccaccaaggcctctggcgctgctaccgccggctccgtgtcgtcaaggcggagggcgcggcgagcggcggccattacccgccgttcgtccgccattccctcgtcaacgcctccgactcaagaagatgtgcgtggggggccggatgcccgcctcaatatcgagcgccggcgcaatggtcgtcgtgttgcccacgcaacggagggcgcttcctcgtccggagcgccacttcggtccgagcacgggggccagccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaaaggtcaggcgcggggttggctaatgaatttgccacccgcgtcggtccactcttgggaggatttgtgccagcagttcaccatgaacttccagggcacatatccgcgcccaggtgaagaagcggacttgcatgcggtacagcgaagggacgatgagtctcttcgctcgtacattcagcggttctgtcaagtccgcaacaccataccgtgcatccccgcacacgcggtgatctacgcattcagggggggcgtgcggcacaaccgcatgctcgagaagatcgcctccaaggagccccagaccaccgcggagctttttcagctcgcggaccgtgtggctcgcaaggaggaggcttggacctggaattcctccggttccggtgtggcagctccggccgtccccggatccgccgctcggtcagggtggcgggacaggaggaggaagaagaggtcggcccattccgacgacgagggtcacgtcctcgccgtcgagggcgcttcgcgggccacccaaaaggggaggcctgcaagcgaaaaaaagaaggaggccggcgctcccagcagggagcgcccgaccggcaagtggtgttccgtgcacaacacctccctccacgacctcgcggactgccgcgcggtcaaaagtttggctgagcggacgaggaagtgggaggaggagagaaggcaggagcgctgtgagggcaaggccccggcggctcccgccggcaaccggcgaggtgaggccaagcagaaggcccccgccgaggacatcgacgatggcgacgataacctggggtttcaggaacctgaggccaccatcgccaccgttgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgatgccatcaaggccccggggatggtgctccggccgtcccagccgatcatcggtgtgacgccggggcacacttggccgctaggtcatatcgacctcccggtcactttcggtggttccgccaacttccgcacggagcgggtggacttcgatgtggcggacctcagtctgccctacaacgcggtccgggggaggcccgcgttggtgaagttcatggcggcagtccactacgcctatctccagatgaagatgccaggccccggtggccccatcaccgtccatggtgacctcaaagtcgcgcttgcttgtatggagcagcgcgcggaccacctcgccgcggcgtccaagcccacgggcggggcgacgagaggctcagcgcctccatcccggacgcccgagggcagtgaatggtcacgtgcgacgaggtcccggtcaagggaggttgccctttgggcgacgggcccgtccaagaccacacgaatcggtggggtcttctgaatgacaaataggagaaacgcgctcgtctccttcctgcgggcaaacgccgacgtcttcgcctggagaccggcggacatgcccggggtccccaggaaggtgattgagcactgtctcgccgtgcggccgggcgcaaggccggtccagcagaaattgcggcggcaggccccggaacgtcaagccttcatccgcgaggaggtggcgcgacttctggaggccggattcatccgtgaggtcatccatccggagtggctggcgaacccggtcgtcgttcccaaggcgaatggcaagcttcggagggacaggcttctagatcgcggcgcgcttgctccttccgcgctgcctctcggagggacaggctgtccgccagccgctgcaccgcgccctcggcctcctcaagagctcgcccccgctcggtgagctcgtcctcacggaggtggagtgcggactcctcttcggcgcaggcggcttcgtgcgccgccagtgttgcctcccgggtggcgacggcggcctcgcggtctgccagctccctctccttcgcgttcagggcgcgggcgcgctcctccagcgccgtggcgcgagcctcaagggcctcttcgcgccgccgagacgccgcctcgttctccgccgcccgccgttcccgggcagcggcggcgtcaaggactccccgggcggtgtcgagcttcttctctagctccgctgcccggctcccgtattggaggcggaggtcgtcccgcgccttgttgagcacggcggtggtgatgagggcagtctcccgctcctcctccacctccctggcgatctccgccaggtccttacggtgggcctcgagctcggaggcgtgccggcggtgtgccttgcggcccgcctccaccatggcttccaccgagcgccgcccctcctcgtcgcgcgcccacgccgcgtcgagctccgcccgctctgcctgcaggacctccatctaggcacttaacccgtccagcaccgtggtgttcgcggcggctaaggcctgcaggaggggctccgcgctcagtggggcagcggaaggcagaggggagagccgcctcggtgtgggtgctgcgcggctctgtccgccgatcgacgtgctggacctgggggcgtcccccgaagctggcttgtcccaagcatcgcccgaggggtcgggtccgagcggcgcgctcgcggcctcgtcgtgggtggcctcggaagtcgtcgtcgtctcgggcggagtcgggtcggaggcttgggaggccgcctggcgtgcgcgcgccgcctccgcctcccggacggactcctcggcccggcggagtctggcctcctcccgagcggcttcctcagcctggcgaacccggacggcctcctgggcggcttcctcggcttcccggaggcggtccgcggcttctcgccggtcagcttcccaccttcgagcctccgcggtcaccgtctcctcggcctcagaccggtcggacttggaatggcggagggggtgcgacgggatctcgctgaggcaaaagaaaaaccataagacaaaaagaaacgggtgagtgaaaactcgccttgggagatgggagaatgaatacggccgcggtggacgcgggaacgaacctgcgaggaggtcggctaaatgaccaccttgggggcgagatgaggttcccccgtcatgactcggtcccccccatcttgcggagccgtttctttttccgctccccctcgggctgcggcgtcggcgcggcaccctccgggcgcctgctgccggcacgcaccgccccgccccctcggggaggagatggggaaggggtaccctcctgcttcctcttcccccgggcgtcggcagggcggctgctgtcacaccccgaagttttcctcccaagccaaaattgtaatttataaatgaccctaagaaaataccggtgcaaatcaggagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattctagggaaaatcctttttccttttctttttcttttccctccctttttcctccttttttcgaatgggccgccggcccattctctcctttccttccccctcccccttgctgggccggccgcaggccgaggcccagccaggccgccccgccgccctcctctccggggtcgccgacaggtgggacccacctgtcgggtccttcccccacctcccgccgatctcgctcgcgccgccgcgcccgcaaccgccgccgcgcccacgtttccgcctcctccgggccacgtcgaccacgcccgcacgtgcgccgcgttccccgcgcccactcccctctcactcccgctcgcacccgcgcccgagatggccgggattcgattttcgaatcccgcctctctctcctccccactcccccacgtcgtccggcgattcccgcctctcccggccacgtccggtcctctctccccctatttaagcatcgccgtcgtcccctctcacttttttccacttccgccgtactctctcgagcctcccatcgctcccgcgccgtgcaaccccttgccgccgcctctcccgctactccggtcgccgctagccgccgttagggtcgccgccaggccgcgccgtcgccgccgtcgggttcgcgtggccgagatccaccccgtccacccctcctccgtcgaggttcgtcgccggagccctcgttccctcgcactcgggtgagcaccaccttcaccgccgccttcggccatggtttccggtcgccgtggttcatccccctctctctaatccctctcttctccttccttagggcaccccgaagctcgtccgcccgccgacgtcgtcctcccgtggcttgccgtcgccgttcgccatcgtattcctccgcgccggccaccctcggtgaggcatccctcccctcttttccccttcctctcctcctagtgccgcgcagccgcctccgcgtcgccgtttgcgccgtcgcattcgccgtcggtcgcatgcgtcgccggcaacgcgttcgcgcgcgcgtcgtcgccgtcgccgcggtcggtcggccggccttgagccaagccgagccgcgtgccgccgccctttttcccctctcccgcgccgctgaccggtgggccccgcatgtcggcaccgctcctccccggtccgtggatccgatccgccgtggaccgccctctcccgggccgctgaccagtgggccccgcatgtcggtgccgcaccccctccgtgctgacgtcagccctggaatatattgcgcaataaatagtttaaggtttttcttgtatagtaataaacacactgaatcttctaaaattcatatctaattcatccgagctccgtttaagcccattcaagtctcagtaaatcaagaaaaatgtgtagaatccattaaaaatggttttgttccctgtttcagtagtcttatagtctgtttgcaatgtttgctttgtatgtcgctagattccgtttcctccgacgctccggtgtacttcgagatagtcgccgaggttcctccagcagcagagcaaggcaagtcatgcttgtcacttgaacatgttgatcctacattgcaaatgctctattgttttctttcaaatattgcattgttttataatattactatgggttgtttacctattgttacagccatgctattttgataccatgctcctttgttagcttgggttataacatgattagagttaggactagggtttgcttagccatgcctagttcaactagttcacattggggaaaatcctattaatgtttaggctgttagttctaatggtaatgttggattagtgacaccgctttggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagcttttctctagccgacgcatccaggcaagggtgggcgtgatggagtttggatgggccctgcgacggcctatgcggcttccggattcacctaggcacgagaggggactgcccgctgccttgcgaggagtaggggtgaaacctgaggtgtggtgtgcttggttagagggggttatgcgaatggtcctgtcacggcctctttccggtatgtcgtggtggcatgtcggcgcacgggaacgtgtcgtggggctgtgtcttgtgggtacagttatacacctctgatcagagtaaaactattcgaatagccgtgcccgcggttatgggcggtcaaccagattcaccgtgattagtctcaccttagcgtaatcttttgaaactggatagtttaggtggatggttgggcctgtcgcaacatgggttagcgttggacagtggatagttaatattaattaattattacaactgtttaatctttcaacttctgtttataaatgctcgctttatgcaaatgaaccactttagctcttctttgataattccctgcatcatacccctattccggtatgacttgctgagtacagtgggtagtactcagtcttgctctacttttcccaaccccagagttcgagttcgggtcagatgaaggtttccccgaggagtaggcttcgtccgtgccgtcgaggatgcctgtggagtggtgttcccgctgcagttttagtcaaggcttagctcttgttgtctttcttttcttccgctgcatttatgtaagatttttatgatgtttgtaagacgtggatctgaatgtcaacattgtcgtttgtgtaccccggccggtcctggacggggattttaatgcacattctgcttgaaattctattcgggaatttctgggcgtgacagctgccccccaggcccccgtcgtggggcccagaagcacgaccccctcccggggtagattgttccccctgcagctcccgcccgcgccatcgtggccacggagggcctgctcccccgacgccccgaccgcctgcatgatggtcaggatgttggcgcgctctggatcgcagcagagggggaggactccttgggggatgagggatgcctccacggagctgagattcagcacccgttggaccaccatcttgaagtcctcagggtcccagtcccatgtgcgcccctggtgggtcctcatgaagtcctccggcccggagtactcccaggcgccccgggcgcgccgttggagcggcgcgatccggcgacgaaggtagtcgccgaacaccatggcgccagtgagtccctcggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttcagtcgtccacttcttgcggaggacgcacggaatgtagcggtgcagcacctgcccccgcggctggaagtagcagccaccgactaccgacggcggcggcaccggctgtacggtgaagaaccaccggaacacccggagagatgggcgcaccccgatgaacatctcgcacaggtgtgggaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccgggtagtgtggcgccgggcgtccttcgcccagcacgaccacctcccggctggtggcagattccggcatgaatcggcgcggcagcccggcctgcctctcgctcacgatgcgggaaggcggcagcacgctaccatcgagcggtgcggagccccgtgccatgatgccgacggaggaggagcttgagagcgagtgagtgcggcaagggtagggcacaggaaacaaagagttagagctcaagtggcgaaggcaaggggaagaatggtgagaggaaggaaacgaatctcttccacggcgtctttatacccttgccaacgctattcccggctcctcgtttcccgcgcccactacctcgccccctcgtttctcgcgcccacgcctccactaacccaactcgcccgtttgcggcgcacgaggcagatgtgcggccgtagcagttgagatgggacagatcgtgcgcgcgttaaccacgctcgctaaacgcgaaaagcgccatcatcacgcctccaggcgaaacgaaccggctcgtcccgattcgcgcgctgctcgagtgatgtagcggtcttgaagaggccgttcattattatcggtcgattttcccttgccgatgcgcgcgacttgcgaccgctgggttcctgcccacctgtagagaccggccccacctgtcaccaggcctaaagagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcccgaggaagatgtggccacccctccctctgtctccccgaggggt

SEQ ID NO: 41494 - DNA, 5719 bp, Oryza sativa
agatatgaccaatccgtcggaggtcattcggacagcgcaaatgcaaatctcggcccattaatgaaggaatgacaggggtatcccctgtgttaggcgagtgacggcgctgagcctcactcaaggacaagctgtgatttagcttccaggagaaggcgcgtgccaagttttggtcaagatagggtgggtccccacccaaaagaagtgtaggtagaagtggtgcatgtggtatccccttgagatataaaaggaggaccttgcccaccgaagaagggggactggaggacaacactgagaatagctgaactctcttgctctccaactctctgtaactctttcacacacagatccaccagaacacaggagtagggtattacgcttctcagcggcccgaacctgtctacatcgcccgtgtcttgtgcgtttgctctctctcgcgaacattccacagatcgagggtgaagaatctcacttagcgcccctggccgaaccggcaaaggggggcctgcgcggtctcccggtgaggagccccacgctccggcatgctccattttatcaacttatcatttaatgcttttttttagtgagcaacaactgtaaacagtaggctgtattgctgtaaacataaccattgttgggttgagatgtcaaattctgtatgttgcattctgtattaaaggagtgtgtgttcttatctgagatgttaagttcatcaattttttgttcagtatgggagttggttaatggtttcaaatttttggggtattttacaggtgtttgacggttatggtcgtacagacgaagcatcttttgtttagaagaacttacaaaggtccatgatgatgcttggttgacttcctcagcagcatccacaatgtaatcaagagtgcattttggcaagtatctcaaaatgttattctggtggtactcataagatttggaaggtttgacctcaggggccataggatctgtcccttgtgctgccgcctccaccgtaagggggagaagggagggccaagtaggaggagatagcgggcatggcctggtttcacgacagacgccgggaaggaggaggttggagggcgaagggttgatgatggccgcaacttgatgccttggtgacagctcaagcggtgtgatggtggtgtcatggcctccagatttggcagcgaggaggttgtggcagcacctcgggttctgaccttctatatagctccttctgcccatgtaaattttctgtaaagttctcttgtgtgatgtctattcaggccctcctccccctgattctttgatggtttaaaagatcgattttgtgattgtgttggatccattcatttttgttaaagattgattctgttggccgtgttaagatttattcgaggcacaggctcttccttcagtttatgtgatgcagaatgttggagaaacgggaaccggagtcctccttcctccggggccctagtgcgccgttggctatatatttatgcaatcgattggcctgacaaaaaataataatgtaatatgatataaaatttgttcccattgcaacacatgagtgaaatttcaaatggtattcgagaattcaaatttgaaatagtaatatcgatctaaatttgataaaaaaaatgtatcaaaatttgatgaaaaatgtcatatagctgagggttggcatatgacactaaatcgaaaaggtgaaccttagctacaaaggcttagttgtgtctggattataaaaaattaatcatgccatataattcacttaatatttcatatcttttaattcgtaaacaaaatatcatttcgtaacaaaatactagctcagtagctctcatggctcatatttatctttgatgaatcatgaaacggctattgtcggggtaaatatctagcttcgaacatgatatcttttgatttccattgtaacacgcgggcacacaactagtatacaagataaatcaagacaattgtgggacccacaaagcccggagaaaacagtgcaggtgcgtagttcaaaatttgaacagtacgtgtgggacccaccgaaaatattaagcacgttttctaaaaaaattaagtgggacccacaaaagcccaaaaaacaagcccaaatacctggtccatccaatccacaaaagaaacaagtcaacatagaaggcccatatgaattataaaagtccatctctcagcacgaaggaaaaagtatacttcgactccctcaactatcgcccaagtatgatttatgtcctccaaccacaaaaccgggtatattaactcctccaactatcaaaaccggtgcaaacaatgactctgggtggttttggatgacatggcgcctacgtggcagtcttggcgcttacgtggcattagaataaaacaaaaaaataaaaagaatatgtgagacccacatgtcattcacacaaataaagtattgcatgtgggacccacatgccatcctccctatccttcccttcttcctccttcctccctctgtctctctcccttatctctctctcctccggccttccgccccgtgacgagctccaggatgagcacgccgaagacgccgtagatgtcgcacttctcattgatccgaaggctctggcacgccagctccgccgccacattccccataccgtcctggaaccggctgctcatcacgtgcttgtccagcttcggcagcagtcgcgccagccagaagtcgccaatcatcgggttgcactgctcgtcgagcaggatgttgctcggcttcacgttgtagtgcaccctgccctcgccgaccgacgcgtggtacaccgtcccgaacacgccgcggccgatctccgtcgccttgctcaacagcgcgtcgcgccgcccacgaagtcctcggaacggaggaggctgttccccggcccaaacgtcaccatattgcccgtggcaagcttgctggacttggtcgagcttgacacgatgctctccagctctttctccggagtcgtcccgccgtcgctggccctccgccgcgccgatatgttgagcagggtagatgccgaggttgccctcgagcgcgctcgcgtcgaggctctggaacacgcccgacgccggcagccggccgacgaggcggttgtgcgagacgttcaccgccaggaggctctcgatcccgctcaggttgttgtactctagcctcagaatctccagcttattcagctccgagatgcccaccagtatcggccctgtcaagctgttgtgccccaagctcctgccatagcaaacccgatgcatcgatcaaacgtcatgcaattcgtcgttgtcgtcttcaatgcaacgaggacattgtaaatgtaattagcaattttttgacttacagttggtacaggaacgaacagttgccgatgttgttggggatggggccggcggcgagggatcagttgcagtcgagctggagcacggcgaggttgccggcctcgcacaggtcgctcggcattgtcccgtacaagccgctgctgtggaggtcgagcacggtgaggttgtggagcaggccgagctccggcggtagctgggtgcggaggtcgttgcggtacaggttgaggtagcggaggttcatgaagagcgccatttccgccgggatgcctccggtgagctggttgacggagaggtcgagccattgcagggtctccgccagcttcgtcgagcccaacggcacgacgccagagagcacgttcgacgacatggtgaggagaaaggccggggaagagagagataagggagagagagggaggaagaagggaaggaaacatgtgggttccacatatttctttttatttttttattattctaataccacgtaagcgccacgtagggtagagactcggtcaaaaccgccacgtaagcaccgtcatccaaaaccacccaggggcattgtttgcaccggttttgatagttggaggagtcgatatacccggttttgtggttggaggatatgaatcatactcggacgatagttgagggagtcaaactatactttttcccagcacgaatcttgaacagataagggtccaaaaaacgaaagattaagcccaacagagaggaatagcaattccgttattttattttcacgggcggcagaaacatcttttattttttattttttataagtagtagagatatatatcagtttttaagaatactttccttgtaatttagcactccctctattcaaaacataacaattgctagatagattggtattagaatgtcttatccaaaaaaaaattaattttaagatggagggagtaatacactgcacagcggcaacagcaggagcagctggcgacaacatttcagtttcaggattgcatttcacgctcattccattgccaacatcagttcttaatttagatcaatatcctgtcttgtctggttatattctgaaattctgcttcgatcgaggaccttgcaaccctgattctcagcttcactttgtgctctcccttgcaacaacaatccatactggattcaaaattgtatttgaccaaacaggttttgcagtcccgttgcaggagacaatacgtaatactccctccttccatttgaactaaccaataataacaataactaacagataatatatagtgtcaactccaaaagttattcagatcatacattatgatgggtagaacagggtgttgaaagattattcagaagatatcagcgatgacggtgccattagacacgtggcatagcgacttgttctttttcattcgaagcttaagtttggtatttccactgccatcgccgtcgtgtccaaccggcaacacctccacaccggtgaagacttcaatcctgtcaattatttcaccgtcgtccatagacacaatgcggaagaatcttgcaatgcagaacctgcccgagcccaggttgacaagctgcggatcatgtgattccagccaacccttaggtgggtcaaattccttccaatcaccaataagttgtggctgggagtgggagtccatggtggagagatcagcagcagccaacggcgacatggtcctggcctcagtcgagaagccaaaccagagcttgagctcagggacatacacaaccttgccatacaagggtagattcccattaccgacttcccatgtgtttctcgctgtgtccaagcagtaggttgcgttgcagctgttgtgggatatgcagatgttagagccgaccactgcataggatgtgatcttggggtaggtgaagcagcaggtacgatcagagacgaatggcggtggccggaggaggtggcagttccatgggccctcaaagatgttgctgcacacaaaggcctcaaactgatcactcagcttcacatcgcccttctctggctcaggaaccctctccatgacatagaggctgccaccgccaacgctgggatggtcattggcatcagcagtacttgggatgaatagagagatgggccgtgacttgggcttgtggaggtttgggatactcaccacggcgcgcgtgtcggcgtcacaaaggaacatacgcctggtgtggtccgctattaccaccttgcgatctacaagggggaagcagtcgagagaaatctggtcggatccatgtgtagaacaaaacttgaggatgggtctgggaagccgaatcctctccatctttaagcctgctgccttcttcttgggattacaggagtcggacaccagtgtctgagaggtgtagtcttcttgcacagctgctgact

SEQ ID NO: 41495 - DNA, 725 bp, Oryza sativa
acatcctcaaatacaaagcacttccctagttagatgtaggttagacttcccgttcgagaaactctatcttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcgggtgctttgaagcatttgtgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtcccggacacccacccagatcccaatagaatccgccaaatcctgcgggaaattgtaatcccattcaccagctcctacatttaagtaacaagagaactattgtatttatctaacacctggattatctccacctttcatttgatccctatttatagattacgttgcgttgctaacgcgccgcaccttctatttc

SEQ ID NO: 41496 - DNA, 34469 bp, Oryza sativa
  unsure (1)..(34469): unsure at all n locations
nnnnnnnnnnnnnnnnnnnnnnnnnnnnnnnnnnnnnnnnnnnnnnnnnnnnnnnnnnnnnnnnnnnnnnnnnattttctccgtatctttactttactgtcataaaagcacaggcatcctccttttcatccctggctcatacagcacgcagcgcacgtttaaaaaaaaatgctcgctcacgctaaaaaaaaaagaaaaagaaaaaggtggttgttgtgcgatcccaacaaaacagaaaattcgataaaaatagaaaagtaaaaaaataaaaggtggttagatgatagaaaattcgctaaagaagaataataaaaaaatgtagatggataaaaaatccccactttatactagatatatatatctatacatagtataaataatttgctatacacggtgatataactaatttcatttaagttgagtatatggtgaggtaaaatccataaatatgggactttaattttaactcccgggatgcactagaaacagtgcttaactacccctgcatatatgcatacttaattaatttgtatccacaaatacaataatactgcatattaaataaaggactagggttgatgatcaatttaaaagttttaatatttaataatatgatgatcatttgtaactgaggaagtatcatataaagacaaaaggaaccgggtaccgaaattctttgccatgcatctagtggattttgacgagtgtagctagtgccgttgacccaaaagtcagttcatactgtagtaatgaacttattgtttccttcgttttttaacattgttgatttttgacatcatatttgatcattcattctatctaaaacaatttataaaaatatcatttgttttgttataacatattttatcataaataaactttaaacatgacttataatttatcatatttctactatctagaaaaatactcgtacgttgcaacgggtaaaggctattttatttatataattgtcagaattttttttgtccagaaggtatatgagatttttttttgataatattgatatataatttggaacttttattgggatgatggtcaattctaaagcaattaggagtttgactctcgtcacaagttaacatgcgaattttttaaaaggatttcttatacgactccttatatattttcaaaagtgaacgaacttaaaaatcgactcagatacgaacgacgtaccaaagtattagtagaaatatctttaatttttataatagtagagataaattattatttaaaagtaaagggcgtgagcaacgtgggcaacttggccgggagagctaactatatacaatcttttatagtataacacaaaaagctcagttcataatcgtaaactagctactatctccatcctaaaacatagcacatttttcatattgttcagattcatattattaggaaatatctcatcatgtataggtagctatattttaaaacagatatcaattattaattattattccctccatcttaaaatataacaacttttatcctttaaattttatcttaaaatataacaacaacttctcctatcaacaaatcacatcgttaattaatttcaccatttaaattatttacctactttattttctcaatcaatcataattctttctcatttaatgttatctgctttctcaatacgctagcttgcctaactctaaaacgaatgtatagtaactaagtgctgcatgcatgtcaatgaatgatgtcatctctctctcgatctatataaacccctccgcgcaacataggcatatatagctaccttcatatattaagcacttaattaagcagctgtggtgcgagatcgaggcaaatacgtactcatagttaggtaaaattaaggcacccagagagatagagagagagagagagagagagagagagagagcttaattaatttgcagatatatatggcgcacaatggttgtccagctgctgctacacctacaacagaggtattatgttcccatgcatattgatctccattgggtacccaagttctccttctcaatctgtggcccgggctttgatctccatcaataatactatatatctgctctgatagtataaataagagagaaaaataataagtattaacttataatttttaatatataagaattaaccctacatatactttaaaataaatatattaaataaataagtgagataaagagaaaaaagagaggtgaagacaaccttatggatgctacctgtctaataccttctttcccaaatattcgagctaacccaacttagaaaaagcatagagaaagtattagctcgttctaattgtttaattttgaccacctgttaaaaatcactcgcatatctaattatttggcggatagaaaaatattatttcaccctttaaaggataatattttatcttaaccatccattcttcgcatctcttatcttttcaaacctacctcttataacccatttatcaaacacacccatataaaaaaaatcagctattggaaagctaggcatgtacaaaaatctaataatggtaataaatttcacaaaaccatcttaaaaacatatataattttttaaaatatttttttacattaaatttataattttgtgatacaaaatctttaataaattttatagtttgccatagttttatctaatatagttggtggaatttactcaaaatttaatgcgtaaagtgcattgacagttcttaaacttgtaaagttgtgtcatataccacattaacgtcacgtaagatcctgaagaggttgtggcgatttagaatctagatgacacattatgataagttctggagcttggatatgtattttgagagtctagggacccagataacacacccctacaagtttaaggaccgcacgtacaatttactcaaatttaaatttatgtgattagatttgaaaaacgcatcacatagacaaacaacagaaaaagaaaagtaccgttcaaaaaaaaaacagaaaaagaaaggactcaccagaggaggcagcggccggaattctcggcgtggagcccgcactcgccggtgaacctctcaccagagctggccgccggcgaggtcgtggctggcggagctggccacgaggcgccggatctggccgagctcaaggcatggctgcggcagctggtcccgcgagtcaatgaccggtgggaccaactagttagccttgtgtgtgttttgcgctcgcggccgccgctattttattcggacgacgacggtttccgccgccgccaccgccgcattgccattgtcttcgccccccgccgccgcctgctcaaacccatcggagagcaaaccgaatggagctccacctcacctcccgcggcgccctcccgctgtctccgccgctcgccggccagcggcgtcctcacctctctctctccacgccgtcgcttccggtactctcttctcaatctcaaactcgcctccctccccacctatttttctcgtcttcgctttgcaaataccatgcgtttctactacttgctgcctgcctgcgtgagtggatacttttgaactagaatggggagcgaaccttttcttctttttctccctcttcttttttttaaacagtgaatctcctaactagttgttgcccagcgattcgagcgtctaatcatacatgaagggattaagacgtggcgtttagctctaattgttggttacttgtaaaggtttaggctaaatgaccattaccataacaaagctgttcgttttccctattttccttgttctggactgttatcatctgaattcctaaataaatgaatcaggcacaactaagttgtctactgtatcattcattggcgtgtggtagtggctactctagactctagtgctgtagagtagatgccatctctctggtccttttgagtgaaatttgtgcttgattggccctactggtcccatcccatgcatagattcaagcctcgtctgatttattgtcatattgtatttcctactactagcaaagatgcatccgggtttaaatattttcaactttcgatggccttttgatctgatagaagaatatcttttttcccccacctcttcttgctactgcagatcaagaatcacacttattcagtgccacctcctttctccaaggctcactgcgcgataggatgccaagcttctctagcaactaactacatgtatgtaaatatgaactgtatatgacaagtctcactgccatgggttacgtttcaatcaagtccacaagtgataaatattgtcctgatcgtataacttgcagggaaacctctgcggtggctgatttggactgggagaacctcggttttggccttgtccagacagattttatgtatattgcaaaatgcgggccagatgggaacttttccaaaggagaaatggtaccatttggacctatagaactgagcccatctgctggagtcttaaattatggacaggttagtagggagtttctacagtggattgggaacttcaaacattggtaacatgtgaaataggtactctttgaagtcctaaatgaatttactgcgcttaaacagtgattattttcgtacatagggcttgtttgagggcttaaaggcatatagaaaaacagatggatacattctgctgtttcgtccggaggagaatgccataaggatgagaaatggtgcagagaggatgtgtatgcctgcaccaactcttgaacaatttgtggatgcagtaaagcaaaccgttttggcaaataaaagatgggtaagaaattttatgttttcctatgctcttggattaagttctgcattcaacaatcttttgtcttcataatcctgtcactctctttaatgtactatatttgtaggtgcccccaaccggtaaaggctccctgtatataaggccgctgcttatgggaagtggagctgtccttggtcttgcacctgctcctgagtatacctttatgatttttgtctcccctgttgggaactatttcaaggtttgtgttaagtttttaacttaacttccaccagatactcgagcaactcatccaatatgtaaagaaccatgtatcctagggaaataatattccttttgcagtgattataggatagtggaattggaattacaccacaagcagatttgctatcacgattcctgattccaccaagaatagaaattcatcccctgttatctttgtaaactaccatacatgctgattaaatttgttatctttgatttacaggaaggtttagcccctattaacttgattatagaagaaaactttcaccgtgctgcccctggtggaactggcggagtgaaaaccattggaaactatgcctcggtaacttctggcactgcatctatgaaagctacaactatttaatttacagcttctgtggccatcatctagttagttatatttgcaactatgtacttacctattggctattgcttattctgctatatgtacagcatgtaactatgtaccctctaaattctattgcttacgcagttaggcttctctattgtttcaagagtaattgaattcgaaacttaaaatgtaaacatttttgttcctatgaagctattatgttggatatctatgtggatttcatattatttagtttcaaatggtcagctcacggcttattttaatttttttccccttgagacaaataaccggaaatggaaatctcactcgttgtgatttgtgaggaagtgatgttgtggtaaaattagcctgaaatggaagttagagtcagtcagtgatgatttgtttactgaatactgatattctagcatatatacatacattatgtgctattactcacactgttttagttttaatcttatggtttctcagtttccatatttgttgccaccatgtaggtattaaaagcacagaggattgcaaaacagaaaggatattcagatgtcctctatctagatgccgttcacaagaaatatctggaagaagtgtcttcgtgcaatatctttattgtgaaagtatgatccttctcttatacctatgcttattttagcaaatattttcagtagctggagtcagaagtagtttttcctcagcgaagcgcatgatgttatactacttagtcaattacaacctaatcgatatttttttgttgttgcatgattaggcgttcccatttggccaatgcttatttaggttttatgcagtgaaatggcacaagttcccttaggatgtgtaaatcgtttaggttcttttttttttatcgtcgtaatcatgttattttcccgcatcagggcaatgttatttctactccagcaataaaaggaaccatactgcctggtataacaaggaaaagtattcttgaagttgctcagagaaaaggcttcatggtaaattactcatcagcatcatggagaccaggaaagaaatgactgcctagtgcattttacctgtgaatttgagataagctttttatagttaccattccacaataccaaattaaattcttgttttcaccagtagctcaagtttacttaaatgattagccagatcctattttcctagtggcctggaagagctgttgttggcccatcatagggttatttcctcattgattacaggaagaaaaaatatgttatttaaatgcttttgttaatgttatgtagctttaattaatgttaacttactgtaaggttgaggagcgccttgtgtcagtggatgagcttcttgaagctgatgaagttttctgcacgggaacagctgttgtggtgtcccctgtggggagcataacttatctggggcaaaggtgaaacttctgctttgcttgaaagcttacttgctgtgcaatatggctatttgatgcagtaaaaatttgcagctaatgtctttagaacacatatcacagcagtttcgggataagactggattagttagttactactctactagaaatagcaccaaaacaaatggtactacctcggtaaaaataaaacctggtgaagaagaccttggattagctacgtgtttcataggctaggttttccttaacttttcaccatgctgatatgattttctcacttgtgatcatttcttagggtttttttttgtaattattacctcaacatttacctggcatgatcatgtcatcctgttacaaacaccaccaattgctttaccagcgtttggtctgagagtcaacattttctctgtttttagaaaaaccgaaatgcaacatgatatggaatgtagtattacacgcgcaggtggtcagttagctataaacttgagatctttcgggattggttgcccatgataattgtagagcaattggagtcgtgctgccgcacgcattaaaatgagatatttaactatgctaagtttgttcttgagatagttatgacaagacatataagatccgaaaattgtactgctaaccttgcagggtggaatatggcaaccaaggagtgggcgtggtgtgtcagcagctgtatacttcacttacaagcctccagatgggtcatgtggacgattgtatgggctggactgtggaactaaaccagtgatcatgtacctcccttctcgctgtatacgttgggggtatttggcgcattgatccgataataatgcaaaataataaaaaatgttgttctttttatggtcagaacaaattccccatatactattagtcctgtgctcctgaagttctgatcacaagaacagtgtgctaatgtatcctgttatcacaaaatactagtatcaagaaaatctcaaataaaaaaagactggaccttatttgttttgaatctgtgcaagagatgtattcctgttttgagttgtgtttgcagttgcatagcagagcactcctaatttcttctctgccgcaatttgaatgttaattttgtataggccttgtttagttcccaggattttttttcctagaaaatctttggaaatatgcatggagcattaaatatagataaaaaaagaaaaaaataattgcacagtttgtatcgaaatcgcaagacgaatcttttgagtctaattagtccatgattagccattgctacagtaacccacatgtgacaacgacggattaattaggtttaataaattcgtatcgcagtttccaggtgagttatgaaattagtttttttattcgtatccgaaaacctcttccgacatcctatcaaaatgtccgatatgacactctaaaattaaaattatgtttcggtgaactaaacacacccatacatgacatagccgcaattattcaaaactcgggccccatgtgtcagcctcagagctgccatgcgcaagggcgggcccacacggggagctgtggtgcctataaaaggcggagaacagggacccaccagaaagcaagcagagcaggaagaaattcaaatttgcgaatattctctctctctccccggcgaaggcgacggcgaaggagaaggctacggcgatcggcggcgatcggcggcatgaagcttaagatgaacaaggcctgcgacatcgcctccatctccgtcctccctccccggtaatccccttctgctcaatgctcatgcatgctgtgtttttgctcatggtggggtggtgtggtgtgttcaggaggaccggagggagcagcggcgcgtcggcttccggttccgtggcggtggcggtggcgtctcagccgcggtcgcagccgctctcgcagtcgcagcagtccttctcgcagggcgcctccgcctcgctcttgcactcgcagtcgcagttctcgcaggtctccctcgacgacaacctcctcaccctcctcccttcccccacccgcgatcaggtctcacctcacctcacctctcctctcctctcctctcctctccttctccccctcgctcttgtttctgccgcccaatggattttggtatttttcggtgccttactgattggggattccactcactcctgtccctgtgtgttgttcggtgtttatcagagtcttccgctgaattgccttgtggatttttggtgaaaatccatatcagattcagtattgatacagcatttgtcagttttttttatctctggtcgcagttgcaaaaaaaaaaatgtatgctgcagaacgactaatagatagtgcaaggtccaattactatgagtaggctgttcctgcaatttcagatttgttttgattactagtggtacaaattgctcactctgctgcccaccaccttgctgcacgcttgcactgataaatcagggaattgaactccgtttttgtctgtcctgtaaaactgtttgcaattgacacccacccttatacatgcagttacacgatttcattacatgaatgcctgttcctcataaattacttttgcattattcatggaagcatcattggtgcatcacaaactgagatttctgtacctgtgcatctaattacagcttgactagttagaaatggcatgtgtagtgttttgtatcttgcccattaacattcattcatgtcttcattgttgtacagagatttggcttgcatgatgactcatccaagaggatgtcctctttaccagccagttcagcttcttgcgcgcgagaagagtctcagctgcaactggcaaaattaccaagcaacccagtgcaccgctggaacccctccattgcagatactagatgtaaactctcaagacccacgcactacatctcatatatccttcatttcgtttataccagaatagcagcatttcacctgagttccaggcacactttgttttttccaactgggttctgtttttctattctgcatagaatgtaagatgatcgctgcatgcttttataatagaaagttcaattgaaatcattctttatctggactccaaatcactaagttgttgtactgccatagtattttctcatcagtataactgacagatgggtatatcagcaggtcaggttactaatgaggatgttgagcgcaaatttcagcatctggcaagctcagtacataagatggggatggtggtagactcagtccaaagtgacgtaatgcagttaaacagagccatgaaggaggcatcattagattgtaagcccctaactttcagtcataaagagttattgtgcaacttctgttttgtctatgaatttctgcactctatttctgtccttgttcagcaactggaactgaaagcaattatttttttatgtttagctggtagcatacggcaaaagattgctgtccttgaaagctcacttcagcaaattgtaaggataattgatggttcagcattttctccactttccctctttccttttcttttgtgcaacgtcagagttaacatactaccgtgttatcacagcttaagggacaagacgatctcaaagcactctttggaagcagcacaaaacacaatcctgatcagacaagtgttctgaattctctaggcagcaaattgaatgagatatcctcgacccttgcaaccttgcagacacaaatgcaagcaagacaactgcagggtgatcagacaactgttctgaattctaatgccagcaaatcgaatgagatatcctcgactcttgcaaccctgcagacacaaatgcaagcagatataagacaactgcggtgtgacgtcttcagagtttttacaaaagagatggaggtacttccagttttgatacaactctgataagtccaactgtccaagtgtctacaaattattctgaaaactatcatttgcatataaatgattatcattcttgtgtatgagcatgtgattttttttctggtatatccaaatatgacagttaagtttccatataagcatagttacctaaagttttcttctatattcaattattcatgatacttgagaacctaaggtccaatatattcagtatatgatatctttcagttttcggtttttatgagtctgatgatgtctgaaggagcaggcacaagtctgcgtgaacttaaatttgtcatgctcaaacctcatcaattcgcatagtgaaggcaaccaatgtgatgtttttgtctatatttgattgtgttttgcctgtttgcgcagggggttgttagagctatcaggtctgtcaatagtaggcctgctgcaatgcaaatgatggcagtatgtaaattcatgactcaagtaattttagccataagtcttccagtatctttctctaacttctttttggtcttggctgaaggaccagagttaccaagtaccagtttcaaatggatggacccagattaaccagacaccagtagcagctggaaggtctccaatgaaccgagcaccagtagcagctggaaggtcccggatgaaccaattacctgaaacaaaagtgtaattttctgctcttggctccttacatagttcagtcattagctatgtatttatcactactatagtatggagaattgaactgaaagacctcttgatggaatcaaattcaaatcggttttaaatccttgagatcctatttaaaatcaagtgttagaagcaattcaaaagaatgattaatattccattggtttcgttacgaagctggttaaatactgccagtttaaatctactagatagtaattattctaaattttgtataatggaacattatctcattttattggaaggaattgtgtcggtgcattccttcgagttgtgttactagcaagacttaagctaccaactgttcttcttcggatctttgttggattttctattctgacgaggattgtttgttaatgtcaggctttctgcacatttggtttatcctgcaaaggtgacagatctgaagccaaaggtggagcagggaaaggtaaaagcagctccacaaaagccgtttgcttcgagctactacagggtggcacctaaacaggaagaggtagcgattagaaaggtcaatatacaagtgccagcaaagaaggtaagccatgcagccctgctcctttctgtatcagtaacgaaagaacatgtttacaaggccaatttgttaacaagaagcatctcttgctctaattggtaatgttctaaaatcaatatcactgaatgtaccaaagtggcatagctttgtatcacgcaggtttaataaagatagtaggtggtcgccttatgttcaactcgtgatcatgtttgcttgcttgtgaatgcaaaatgcaggcaccagtcagcataatcatcgagtcggatgatgacagtgaaggacgtgcgtcctgcgtgattttgaagacagaaacaggtagctatcaaccgttgaacttcccctcgaaaagccagggtgcattcttttcgatggatgaaacccagcgggagatctaggggataagagagctgaattccatgcaaccaacaattaaaaacgatgctttcaatcactgaatctgctttgccggctgtcatggcgagtgattgcgtaatagagtagagtttcaatcatctagaatttacttacagtttgcgtttgattacccttctactgctactgctagtatttacgggttggtgcacatgtgaacatatggtgcaggtagcaaggagtggaaagtgacaaagcaaggcaccgaagagggcctggagatcctgcggagggcgaggaagaggaggaggagagagatgcagtccatcgtgctcgcatcctagctaattaatggtaacgccgcatgcatcgtcatcatcatctcaagattgactgattgttttaacataaagccaaacaaaggaaagagataaagattacgacaagacgaaattaaaaggtaaatcaaccactaaactagagagctagaacctgctgtccagtgctgctgttgttattgttgcggttgttgttgggaggtcgagtggacaactaacttaccatgctgccgaatgctgtaccgcatcacaaacagacaccacttttcgcacatactgtagagcaaccagctgatgccattcctatatatctgtccactttcgcacctggctatagaacaggcagacagcaggctggagtagcatcctatgctggcattcatgtcatgccggttcggttcggtacagttcagttgagttgtcatggaagtgaaggagaagcgatgatgcccggcaccgacaaaccagtcgctgcacctgcacgtacgttctctgtgatgtcctcctgcatattatttgtgtttgctgcttgttcgtctcgaaaatgtccttgattttcatatgccctgtgaattgggggaggctaaaggtaaaaagcagcaggtgcctgccagccttttcgctggcatttcagttcagatagagaaagatgcatatgcgggatccagtattccagtccagtgcagattgggagtatcgtttgctagtgctcaccaaatctcagatagtataatacggagtattagtaaattaacgtcgcctgcttgagattgcgacaagcgcagcacgcattgctacagcatttgcggctcatgactgacgcaataacaagctgtcccaatatccatctccctagcagccattgaatgtgtttggaaactgaaaaggatatataaactccatcaacaataatgctacatatcaggattcaggagagagagagagagagagagagagagagagagagcgacagatggtatcggattaatcatagatagatacccctgctgtagtaggtagttagtgcaaccgttgcaccatcatctcctctaaaatgctcatcggtacgactattctgttgtttagtacttggacagagtctccctgttaatgaaatgatgtcgctacactgacgtcttcattagtatagcatctcactgaagtatgtttgtcctccccacttgtaaactgaagttaatgagacacatgacaactctatacaaaacaaaaaaaaaggttaggagtataatacagcgacacagtgtttgttgtgtcaggaaaagttcgttggacagtactagcgtacttcatcatcactagtctaataaccggtatgtgtgcatcaggaataataagcaaagggatttttattggagttgcctctttaaattttacagagcgagcagcactatcttgtttgattagatatcttgccaaacctagttattaggttttccaaccaatttgcctggccaggtttaacaagaaagatgaagcaatgatggagggaggggtggctatggctggtagggaggttagatcagatgggagaatggacatgcagcctagtagttacagtgacctgagtagtaccccaaggttctgagttcaaatcttcataggagcgaatttcagattggattatttgaggactaaattctatatttgataggccaagtttctagcttaaaagtgttgcatatatccggttggatttagaggccgggtaaaaaaaaaaccccttcttaagaaaaagggaggttagatcagatgggagaatggacaggcctcgccgacacatttctgaggatcaaagcccacgccttcttttatcattattacaactgccaagtaaggcctaaggattaaggtgcattaactttgcaagagattattaaagcaaatcactgactcgcagaatgtgaaggcacatacttgtaattagcagtttagcaattgctgataaattgataatgagccacgggcgattcgttgggctcacttgtctttggctactcagtgtccttcaggcaatcagggctgcaatttaattagcggccaataaccctggtcgtgcatagtgtaaaatttgaagaaattaagcaccgcacgtgtttccttctggagacatcattttaagacatgaatactcatatactagtactactatagtattgcatctgggtaagaccaaatgatcagatagaagagaataagagttggaagaaaattaagattttcaaaatatgttttttaaactgctaaacggtgtgttttgtgcaaaaattttctatatgaaagttgctctaaaatatcatattaatctatttttcaaatttgtaataattaaaacccaatcaatcatacgttaataccacctcattttacgtaaaaaaacttaatcttcatcttctttatcttcaagagaaaagaacacattatccaatacagcaaagtatcagacgcaacacacatggcatgagtagagtaggtttgcaagtcaagatgtgctagacaattcagttgctgattcggtcttaaataacaatgaagatttggcggggaggaccaaccagattgaggttagatgtgtgtaagaaaacaatccatctaattctatcgactcgctgataagatatccaaacccagcatcgcaatccacatcatagcacccttccgtagaacacaagggaggttagtttaattgcggaaatatgcatatccattttccatctttgtactcctgcaggctctagtgcagtgcaccccaggcaagtgactttatacgccactgaaattgctaggtccaccactcatttatgttggaccaactcttctcgccctaatccatttctgaactaaattagccataatcaattactgaagtaatccactctcaattgaactgaaaactgagaagatacgtattggaaatggcaagcactctcaattgtttttgcactcttgtaaacaaatcgacaaaaacctgatatgccatggttagatgttggtggacaactctatccgtagctaagaaaatctccatgccatcaccatctcaatattactacttgacaagatggagccctttttgggctctcactagcagaacagaacaaacaaaacggtagatatcaatcaccctcaatgcaaaaccaatctctttatactcgtatactcctatgatactttcatatctgggcacctacaactacaaacacctcaagacccacgagattatatcattgctacaggctcaacacagaatttatcaagggctcgcttcagcttttgcctgcagctagcaattactttttgtgcgagtggggaaaagtggtgcgtgggacactggccgaaagtccattttgcttgtgcaagccatgtggtgtgggctgctacagcgccattagctaccttacctagttagttagtgttgccttcgctccagtccactcttcacagcagggcgagaagagaagtaggagtaacagaaaacagaagaggggagagaggaaaagctactagaactgaccgaggcttgtgcaagaaaggcttctgattccttccgtcatcgttgccaaaaggaagcacagctcaggtcctagcatctcttcacatggccaacaacatgtcctgaagaattttaatgctcgtcttcatctggtttcttggttcagacttcagagtggtgaagttccctgcgatctctcggttatcacgtaagtttcgcatgaagcaatatctgtggatttgaggagtttttagcatatcttcctttgataattttgcttggttttgacagtacacaaattaataacagaacactggaacctgttggttttatgctgccagtttgctgcatttcatcttctcttgctcctgcaaaatctcatttcttttgttctttcattcttggcttgcatggttcatcgggatgaatcctaagtgttcatcagctaactgcagagtttctctcaggaaccaaacctgctgcaagaggattagctcaatgaactaaactgcagagaacatcaggcatatttcaattgcaaagtgtagaggaacaagccaactaacatggggaagagaagtcaaagactggctaggcgtcaggagaacataggctgcatgtggggcctcatcggcatgctctatttccgacgtgacgctaagtttctgttggacaggaagcaaggaagcagaaggcacactttcggtgggctttcaggtaattctctccaggttcatggttaaagtaaaatgtaatacctgatgaacatgatgacaatgcaaataggatcgtgatcatgatctgagccacttactttgctggtagaactctgaggatatggttttgaaatttaatatgcattgtggtcatctgctatacaagagactgaaaacagaatatgtaaagcattcttattattatctccagaaaaaaaaactgattactgtcagtaaatatgaaagtcgacaattttgcttctcgtttgtttgattaccattactaagcagtttgtgaaattgtgtcaactatgtgcagcaatataagtaatgcagcacctgcatggcaatacaatcaatctatgatatttgaccttcagtaaacatttttctgatgtcatagactgtcaataaatccctctaatctacatttcggaatcatctggcaaatatgaaggcattcaagaaaaatatttagttatcataatttgtatatcttcttacaactctgcatggtcgcaggtaggaggcactcaagaaagaaatccagggactttgaagaaacagatgaatatggggaggatgtaagttattttagtaagtatgtaattttaatggtaaaaagcatagatgctcatgctggtggttgctgttgtctgcttttgttaacaccacgaatatgcaacagaagtctagtgatcctaaccatacttgactattcagttacttgtgtaacaaaataattttgatgaatggaactgaaagtgccatattgatgttaatggcagtcaattccttcatgctaagtgttttcttcagagccagaacatatctagagcaagtatggagaaaagaagtcgtccaaaatccaaatgcaacatatgaacttggtactgcttcgaaaacatgcacgggaaagtttagcttaatgcaagttgtggaacaataaacttaaaaaaaaaagcatgacaaaatgatcccacatatacttctttttgcctacttatcatgtgtaggcttggatttagcaaccattattccttctttgatgaaagggacttgattcaagcattctgcattaaccagcagagaagaaaaaatttgagtagacagtactagcaatctttacattgtaatctgttgggtgagttctaaaaccagatttgcttcaagtgtatgttggcatggtaaacatcaaatagttttaactgatatagctttccatcaagcttatgtttatcatgtagacagtactacctatttcttttgatgcatgttaaagattacttcttggaataagtgtattgttcttatatttctcagaacatagaggaatgcgacacaaggaaacaaaccgtcaaaagactcatggaggacgagctgggtaaggtaaaacaggtgaaaaagattcccaaggaagaggttcaaagaatattagctgacctgggacatgatgtctgtctggaaaaaagttcaatgcagagcaccaaacaaaacagagccaaaagtcacagcacaagcacagccatggcttctccgtctggtttgctggatccaagtggttccaaatccatgaaacaggcagaagaagatgatcttgaactttctttagcagattttgtgggagaactctatgggtaccatgatgattgcaaaaataagagtgaactgtgtccagaattgaagtcacatatccatacaaagcttagtgagttgaagagtgtgccctgtcaacgtgcttatgaggaatctccagactgggggcaaagggagcatttctatgaaaaatatatttgtaacagcagatcttatcaatctaacaaactagtagatgcaccagatatgctaagcccagagaaggaacttttcttgaagacacttcagaaaccgagtccgcatactttggagaaggagaacacccaaaataatcaaaacagacaggtagtgaccaagttagagccaaggaaaattcttgaaaaaggtgaaaatactaagaattcaaaacagcacgaggtagccatcaaaacacatagtaaagagggcaggaatatctttttctggaggaaagataaatcaattatgaagggtacatcagaaggaactaatagtagtaagatggttaacaaaatagttatactaaagccaaatccaagagggatcgatactactgtagctacagcctctacatgtttagatcagcaatcatgcacaattcaatctccaaaataccctgcaacagagagttctaaattttcaattaaggaagtcaggaggagattcaaaattgtgactggtgatactagaagaggaagaccatcagtgtatgaagatgatttacaaagagattcacaaaggatcaatgattcagtctttaaagtcagaaaggattctaaacagtcagataaggacaatttgagacctttgaccagtggtaagcaaaagcaaaggaatgatggactaggtgaaattaacggagacataattacatcaaaggatacatccatcttctatgaagaggcgaagaaacatctgacagacattctagagtataacagtcatacaaccaagcatccaacagttcatacctcaaagtccttgataggaatgctttccctccctcaacgcaacgcatcatcacctaggagtagccccaggttaaaaggccgcattgacctttcacccgaagagataaatatttctgccattcaacaggatgagaggacagaatatgcaaaagaaagagatctgtctgacgaagattcagggagtgttgcatgtggtaatagtgaagtactagatggtaaggctgatcaggatagacactccatgaaacaagaaactgcacaagatggtgagtacataataccatagtcattaaaattatcaaatattacgtggctcttctctaagcacaaaggaatatttgcaggtgacattatgcatattgaagaaatcgacaagccggcttgctccgaaacgatttgcagtgaagggatcaccctaaaagagcagtgtacatgtacctcatcactagtatgttcacaccaatacttagtgatattccatctggtctccattgttgttttgagttataatgtgtttatctacactgcaggaactgattgaaggagccgaacctggcagagagcatgcagggatgttgctgagctatcctgagaatgtggttgagagcctagaacaccaagagccaaaaactcccagatcaagtgcatcacttgaacttatatcacaaatttcacccgaagggaaccacgaaaagcaagagcaacccagccctgtatctgtccttgatccattcttctgtgaagatgttgacagtcctgaccatgaaactatgataaaatgtatcttctcatctaaacatatcaaaattacatttccttttgaccttaagaaaatatgtgttctaatctaaaggtgatgtattttggtcttgcaattatccacaggtgagatgcatcaagatatgatgaggccccacataccagatgctatatcagaccaatgggtcttctgggaggacgaggatgccaggctaagttacataaaggcaatgctggagctatcagaactatgcacataccaaaatctagaggtgtggtatctagaagatgaattgatcagcccttgcatgattgaagaactacaccaaggcaatcaaacagatgatctaaagctcccttttgattgtatctgtgaagctataacaataatccaggagacatattttagaaaccctccttgcttatcttttctcatgcacaagatacagccacctccaatgggagagaacctcatccaagaaataaataagcatatcgagagacatctccataatcaatttccaagaacattgaaccagctagttaacatagatctggaagatggcacttggatgaatcttcaattggaaagtgaagagattattgttgatacatgggagttcatactagatgaactattagaagaggtcgctaatgatttgttgatttgaagcttcaatttagtcactgctggtatttttctctgctatttgtagaatggatatagaatgggtagagtcatgactcataagtagaagttatgttgatgacagtaagctgtccgcatgacagaatcaagaggaccagtggaccagacaagtattgtgtgattttactgcttgttagtttgattgatacatcttgggagcctaagaacagtaggatcttcctgacactgaaagatgccagtgcagcataaatgcataatgccacagactcctcatccatgcactgcagatagatttaacagagttggaaggtgatagttctgtacaatattatgcagctgactaaagaatcttatgttgtccttccaatccttgtgtgaattcttgttattgtgtgtataagtgtgtaacagtgtacagttgtgtgtgaaaaatcgaaggatacgttttcagaaaggcgcgcatgtgtcctcttagcatatataactaatcaaagaatgaaagaatgtgatatttcagatggaacttagtttttttttcctgcttgagcaaccatagtgatagattgacatatggcgaatgcaggtatacaattttacttctggtctttgaatcatcctgatccactaggatatctttgtaattcgagttactgattgtcccagaaatgtgccccagaaaacactggtgctaagagtttaagcttagactttatttttatccttttaaaagactactgcactacagacaaaataaacaaagtggtgttcttgaagatagttaggtgccaaaaattattgcttgtttatctgaccaacataaagttcatcaatattcagcatatgatcttacgcatcaaagtgatgtcagttgaactgttgagctgactaccccaattggtgtgctgataaatgttctatactctgttcctaacttgttttgattttgctgactaaatattagataatggacagcttggctgaaatgatcatgtaaataggagttggcaaagaagatgtaaataggagttggcaaagaagagaagattctgacactaaggccttgttcggttcggaagggattgaagaggattggaggggattgagagtgaataattccattctacaataggtgtggaacaaatcccctccaatccttttctcatggggattaaccgaacatggcctacagggttcttgagttatgattactagtattaccactggtactacatagtcctgaactcctgatgtataaaaacaagggtaattaaaaaacaaatcctgaagtatatgtggagcagaaaaatacatatacctgaaaatagacacatgaaaggatggcaacacagctaatcgcatgatgtaaaaccgtgacagataatgtttattgggcagtgcgatacaacaagatccacagggagggaccaaacaaatcaagctgcttggaatctcccacgcgttggggtcgttcgattagtttagacgcccagataactgtcgcatcgaatcgaaatatcaaacggaaatcggactgcgagtagaagaggagcgatcgactcaccgtgcgtgcttaaggagggaggaagcgaatgccctagcgacgggggagagatcacccaaactcctcctcactctcactctctttccgcctcgccaatgcgcgcggcggcgacgaatgtctcagaaaccctgtggaattccccattttccaaatcacgcaactgttgtagctgtagctgcggaaaatcttaaacttactttcctaaaaaaaaagcctcaaaaagggtgatttggaattccccaaacctgaaactaatttttcttaaaaaaaatatctcacgttttgtcagtaatctgaggataaaaagacctacatacatataggtaggtctaaattgttgaaggaacatgtatatagtcatacgttaagttgcatcttatggatttcatgagactttctctggtatagacttatatgtatgcgcctatgctatgattcatatgcatttgtgatggctatttcagccatattttgttcaaacttttgtatgaaacaaactcgtgcaaaaactgatactaaaattatcaacggaaggacagtacttgagatatttgtaatgttatatcttctctggcacgtcggaaaatccttgagttgaagcttttctttatatccaatttatttgaaaagatagaaaatatgatttgggagtatatgattgccagaaaagggacgaatgaacgaagaatatataaaaatcagctagtgtgggatgggatctcgaattttctgtattactaatgtaccaaaactagaccaaaaaaagaaataatagtgttttctttttaaacttgtattacgtctttaattttttgttgggtctaaaaaagcgaaacaatcgcttgttacatgtgccctggaaagtgcctccacgtgtcagtcatccagatggctccggtaaaagaagaaaaaggaaggcaaattggcgaaagccccatccgttcctccgccacaaaccaaacgccaattaatggcttgaccaaccaccgcgcgcgccgccgtctttcgccgacgccgaggaggccggccatggcggcgccgcccaggcccataccctccatccaccggcaaccgcccaagccaaccaccacccacgtcgcccgctgcttccgcgacccgcccaaagcccccgacaccaacagcaacaccaacccgctcctctccctcctctccgccgtgcccgactgggccgacgccgtctccgagcgccgcatccgcgaccgccggccgctctacacccacgccgactggcgggagcaccgcagctcccgccgccacctgcgccacctcctctcctccctcacctcccgcgtcatcctctccctcgcgccccccgtctccgccttctccgccttcgccgccgccattgccacctacaacaccctcctccccgcctacgccctcaccgcctcctccctcccctaccagctcaccgcccccgccctcgccctcctcctcgtcttccgcaccgaggcctcctacgcccgcttcgacgagggacgcaaggcatggatgcgcgtcatcgccgccgccgccgacctcgccgggatggccatgcgccaccacaacccccctgccacgcgcgccctcctcaactacattctcgccttcccgctcgcgctcaaggttttgctcttgcatatgttttttttttatatatttaattctgtatttatttatttatttttctactgtatactaccagtgattcaatttggtaacttcactctctgaaattatatttcatgcagttacctttcactagtctctgaaaacatagaccagcgtttgttttcatgcaattatgcctgatttagttagctttcactcactagcgcggcaactgatgatatcattcgtgttcttgcctcagtgtcatataatctgccattcggacataaaaagggaccttcagggtttgctctcagaagatgacttgaatgttgttctcagatcaaaacatcgtcctcgctgtattattgagttcatttcacagagcctctatatgttggatttcgatgaaaataagcggaatatcatggtaagttggtaactcttctatctctacctgcagatttcttgtcttgccaattacctgtaacataactcaacatcattttttttttgtcttgggccactgataccatccattgtgcattgatccaatgttcaatcttactttaggtgtatttacttattgttatcttcattgtcttgtgagagttaccacccgttgatctgcaaacgctagacttacttcaagtctagtaatccataatggtacaatctaatgctgtttacttttcttgattgtaggagtctaaactatcttgttttcttgaaggaattagtgtttgtgagcagctcattgggattcctattcctctctcatacactagactcacttccagatttcttgttctgtggcatctcacgcttccagtgatactctgggatgaatgtaaatggatagtcgttccagctacttttatcagtgctgcctctctattctgcattgaggaagtaagtctcaacttatttttcaaccccaagttgtgcttccatttaaaactgttcaaaattgtgccttggtagctaccagctgcaggcagcaattggccatggttttgaagacattggtgcatttcaaaacagtgatggctgccccttctagaacctggttacaggattagttttagtgtggttttaggatgcatttatcaatatagtcttgcctggttttgcttatgctcgtctttttatcagtctaaaattagtcataactacacatatgtggtttgtctttggagtaacatggaaaggcagctgcaggtggttgagaatcgggttgtcctaattttgggaaactcagtgtatattgctcagcaattagccaacctctgcttgtcttcaaccacacgagatcttagtgaatatgtttcttactactttattgtgtcaaaatgtttagggtacttgtttagctttgatgcttgagaggagaggattcttaaagaatgtagtctgtttttcttcattgtgtttcaccagaaacttgataatcttgcttcagcagctgttcccatttccccattccctacctgtattgtactaccactaacccagtagcacatactcacatttcaggttggtgttcttattgaggagccattccccatgctagctctagacgagctgtgcaagcagctccatgacagcacgcaggatgtgatgtcggtgcaaaatttggttcacaatcgactagccgccaagacaaaggaccaagacagtggcagcatgcgatgttcagacaacgggtggcctagctccaaaagcgaacaagcaaaaattgattgagcaaaggtgcggaattatgaaggctatactagtacatgtcattgcaaagcaataaaggccttgttggttcaatatcaagcaaggtataaatcgatggtgtgcatatgtaccctggctgcatatttgccatcccattcgcaggtccattttggtacatggatgtactccagtacgagagctaggatttcatcatccaatgtaaaattgattaagcgatcagatgcggtgaccttacgtagcctagtttgctggaggaagcatgcgtgttacggatgtagagagatatggtgaatagttcctagatgtgtgtatatatgtagaaaagattttgacgagccgtatcagcccgtatgtaaagatttgacattacgtactgttatgttgttattgccaaacagaatacagtagctggtggaagggctttgacatgaagagagttgtcgtttagtccttcctcttttatggtcctaaaatatactccctccgatttaggttataagacattttgactttggttaaagtcaaactgttttaagtttgactaagtttataggaaaatatagtaatatttataatactaaattagtgccatcaattcaataattgaatatattttcataataaatttgtcttgggctgataatgttactacttttttctataaacttgatcaaagttaaagcagtttgactttgatcaaagtcaagacatcttataacctgaaacggagggattagctatctcatacatgatgagatattatttattaggtactctctccattttatattataagatcttcatttcatattataagatgttttggtctttttaccccaccgtactaccgtatatataaatatgaacacacatatataaaccatatatatgcataaatctatttaaaatccaaaacatctataagaggtagttatattttggacatggttgtacaaattgatggagatagtgtaagggtgttcacagtgcgcggaggtggcattcagccttgaccatcaatgtcgtagatctgtcgccacgcacacgtctgctgttttccaactaaagaccacagagccaaactaagctaagcattctttgtcagaatttggtaggtgtggggtaaggcgcgatgtgagtggcgcgttgggagagggtatggccccgtgcgacacccccacaccccgtgcaaggcctggcggtcgttaatgaagctaccaccctgagcatctttgttgcccccaaagcgatgtcgttcgccagatccgacaaacccgaggccagatctagcgagctcgacgaggaagcgatggtggcatagggcgcaatagatctggcaactaaccttgttttcatcgttgttccattccacctcagaccatagcagcggcagcttgatggagagggccgcaccaccaaatccgccccccgttcgcatgtcgccgagctcctgtttgtgctatgccctgctcccactagccaccgaacctgccaagggatgaaggccgccggttggaggaggagaggtggagcccttcccgacgctggcaccatcaccgctccgctcgggctcgccgaacgagttgcctcgcttcctctatcagggaaaacatagagatgagagagagtggaggagagagattggtaggatctccaatagagcatgtatctaacaccatttttttaagagtaaatttcgctttggaccagttctttttaccagagtttcacaatggaccaggcctaacattaggttttcacttaacaccatataattttgcactagattgcactttggactaggggttggtgatttgggataggatgttggctgtggcccatccacgttagcaggcaacaacctctcttcttgggcaccagcattgctgatccggccaccgccaagtaacaaggatgtgggtgagctctgcacgtgcatcacagccgagaaggtgcggcaagtgggagaagcaatgatctcggacgacaagaatgtgcttggagattgttggggtcaccggtcacagaacagagagatcggcgacggtcttgaatgggtcgcggacgtggagacgttggatccagacaaagagatgttgatggtggtagctgggtcattgatccaacaaggacgtgatgtggtggctgggttgaggtaccgtagccttggcgatggctgtggcttggctttggcggaggcgacgacagcgcacaaccaaggcaagaagatggctagcagctgcagttctgcctgcttgtgtagatgggccagttcaaattgctagcctagtccaaagtgcaatcaaatgcaaaaacatatggtgttaagtgaaaactttgtgttagccctggttctttgtgaaacttggatcaaaagaactagaccaaagtgaaatttactctttttttttatctaggtggtatatgaggtttggcaaaatttggtagcgtactgctactgccctaggctctcgatgcttatagcactgcatctttttcatgaaagagagcaggttgccaacgctaaacaacgacaacaacatgacagatcttctgataataatactataatcactgatggacaagatggttttcattacttactcctagtaacaagaagattaggcgggcaggcaggcaggcaggcctaataattagagatgtgtggtgatgcaggggaaaaggggagagaaatgattggcaacccgacgtggtgtagtgaccaaaatttaggtaacgaaacgtaagcagtggcgccctgaatgtgaatcgatcatcgctgtcggggtggtcacggcgttcctttgtttgtttgatgcagctactactccagtagtgaaaagattggactcgtagtaggagtacatcagcaagagacagatgagcagaagaaagtatagaagccagcaggagtattagaagtataggacacctgccatgccattacccttaccctgttcagtttaattaagtactagtacttgtagtactatgctggtgctgatgttgtgttggcaaacagagtctgacagacagaaccttgctggtgagcttagttaggcccagtattattattgacaaaagagatggagatttcctcatttccatctgaactggagtagtagtagtagtacttataactaaccttagttaggcccagcattattattattgttggtgatgggtacgtgagccatcaagtttgaagttgcaaccaacaggactacacaaagcatgcatgtcaatatgtcatatggcaaccccattcatttcgacccggggcccggcaccgcactgtagcgaccaacaaggagaagatgaatgaagggaaggcaaccaacaacgagggtgtgttcggtaccaagggtttccaacccttctccatcgtatttcgcgcgtatgtttttgaaactgctaaacggtgcgtttttataaaaagttactatatgaaagttgcttaaaaaatcatattgatccatttttgaaaaaaaattagataataattaattaatcacgcgctaatgaactactcctttttccgtgcttgggtgataggttcccatccatcagcagcgaacacaccctcagtagcggtcccttccttcatcttctccctcgttgtcgcgtcggcaacccattactccaacagggcatgcggggtaaaatggtactccctccgtcccagaatataagaagttttagagttggacacggttattaagatagtaggtagaagtaagtggtggagggttgtgatgggatgaatagtgaaggtaggtggaaaaagtgaatggtggagggttgtgattggttgggaaaagaatgttggtggagaagttgttatattttggaacaaatcctaatggctacaagttgttatatttggggacggaggcagtaaatgattcagattgcttcaaatgaccattcaaacactactccctccgtcgcttcattctaacagagccatcgcttcccttatttgcgaaatggcatatttacaaacgaaaaataatttataaaaagaacttttatatacatgttcttattgatttaaaaacaaagattgaaaaataaatttcgatgaaaaacctcagaatcagctccaaatttaatgttgaaaaattatattttggctgataagtataagcgaaaagatgagcccctaagagcaagtttaatagtatagccaactactagctctaattcatctatagccaatctaatagcttatccatacaatagttacatactacactattaatacctggtcccgccagtcatacacataccgcgccttggagtccgtgctacagctggctacaaatctataactcgctgctcttctctctccttatttatcttcttaaaatatgtttgcagctggcttataacctgctattatacctactctaaaatataataaattttagccttcaacatatgtgattatgaatagagatataaaaaaattggtaagaattagtactgtatattcaaaatctaaaagtttttgtatcttgtaatggagaattacatggtaaatcaccccaattaccttactctcatcctcacaatcactcaaaaaaaacagggtaaatacgtgctgcgagtggcaaggccaagaacagagaacgcatttgattaatgatgattagtactaatagattagcagcgggaggtagagatccctcgagacagtaggggattaggacctaattaacccctaccgccacctacgactacttttttactgtttattattatttactactattgttattataatttactcctactagtactagtcttttcctctttagttgcctgtcccttctccagttctccctcatttcgctttggcttcctcctcgaccaaaagcgcacacaacacaagcaagaaagagtgagagacaagcatgcatacattagattagtgatgatacaagtagccgccaagagcattttagtggaggagtattgagtgtgagggaacctcctgctcccccaattcaatgtcctcctcctcctcctcttgctccccttccacttcctgggaaaaagcctcttgatctcccactctctctcaccctctccgcttccagccgacttccgccctgcaggtaaaggtaagttcatcttcttgatcctacctttggattcaccttgggttggcggctgatgcggtaatgctactgtttcggtatcttaagatgcgattttttcgggctgaatgaatgtggctagttcgtctacggcgaagaatcttcgcttgttgcagaaacaaaagattcttcatttccggctgaataatttctccagtttgcctcaacaaccaaaaccccttgcttttaggtgtcttgttcaattttcaccattttaggttgccaactatttctcttgtttgtttcttgagatctgttatccatttgcctcgtttgttattctgaacggagatataaaaatttcctatctggagcatatagaatggaagcatctagagttggtaggggctcatcatcttcttagttcgcttttcctttccctttgttggtatggtattctcttttgcctcccacgagaacaaagcgatgtgacatgtgcttctcatctatttttttccccaattcagatcgccttttctttttctttttcccattctcctcttctttttgacttaagatgcacatacctgacttatgtttcttcttgtgaggtcaggattttagaggatttaacaccatttgcgtccttttgttcatctagttgcagtgcatttcgttccatttattctgttcgactagtacaaattgtggagcttaatctttcaccttgtgtccacatgttaggtttcagcaatgaggcaagatgttgcctccaaatgcgacagccgttctcggtcaggagcagctcctgaaatcatgcgatcccctcgccgcaccatcggagaaaatggctatcgggacacaagacaccaccagttgaaatgctcagatggcaacctgggagagctacgcgtagagagcatcccaaatttccactgcaagagcttgcccacaagaagccgcaagaccaatgcggaggatagtattgtgggaaagcgtggttctatgtaccagagctctagtgaaattagcatgataagaaaactccacgaaggcaggaggaagaaaatagattctgcacttgacggggatgcatttctgtcatttgagattgttgattcatcctcccagcctagcacaagtggagcttaccttttctcgcatcagaatcgccgctcagaagctaagtcttctgtggaatctcgtagaattcatcgagcatcgagggacttcctggatctttcattccgtgagcttcctgatgagaattgtaggctggaccgtccacgcatggattgcaccctgttgaaaaatgatgcaggcgatggtttcttggagatctcacttgaggaagagatgaccaaaggtccctgcagaaatgcagctcctcagttgataggtggagagtcaagtaaaggtacagaagcaaactgcctgcaaaacaagatcagtgtatgtcccagtgagaataattgtagtcagagagagaggaattcaacaaacagtttgcctgagtccatgtcggccaaggtgagcatctctgatggcacccgtccatcagaaagtgttcgtcatggcatagagaacagcactaaagttcgatcaagccccttcaagaagattctggaccctattatgaagtccaaatctattagaagtccatctctcatggaagactccaaccatgttactatgccggttaacaggaaaaattgtgtatcccgcaaatcattgctgagtgatttatcaaggagtgaacaaagccaatcaattaattgccagctgaatggagaaaggcagcatacaactaatgctctatcacctgctcatcttcaggcggttcttaaattggataccaagaatggtattccagtttttgagttctgtgtcaagggccctgaagaatccatttctgctaggagttggaaaacagggaatgacttgaactggatttacactttccacagtggtggaaaacgagcaagtgctactggaagggcctccaaagatggacgttggtgttcaccgccgattgtaggccagatgcaagcttcttcgtacttgtgctctgaagttggaaaagatggtgttctgactaactctgtcatcactgagtttgttttgtatgatatcgctcatgcaagacagagcttttctgctgaggagaaaactcaatgtacagagactactcaatcgacattgtcaagtgccgtcgagaaatcagcctctggtgactgtccccagaggattaatctgatggaccagcaaaacagtgcaagaaataactctgatgtatcaacatcttgtccgtggtctgaagaagatctttatcctcatttggagattgcagcaacggtcatccaagttccatttaatagaagcaagtccaaagaacttaagagtggtttgtcacctggtactgtaaaagtgattacaccgagtgggctgcatgggttaccaaacgatgatgaaaccagtccatcacctttgctggatagatggaggtacggtggaggctgcgactgcggtggatgggacatggcttgtcccattgctgtccttggcaatgcatatgataataactgggccaattctgtcacaaaggaaggcgagaatcctatggaactctttgttctggtacacttcacttctcctatctttattttttgtgtgaaatcactttgggctatgcatgctctggtttctaagatacttggttgccttcctgctaactctccaaagataacccaaggctgatcgagaacttcttttaagaaagattgatcaaattttccaagtgttagatttgctcctcctagagaactgcccttagacccactttttctttagtgtagtaatcttttgttttcgttgtgagctataaaatcatatatgttaaccatatggctcgctttagtaatgcctatgagtttataggaagaaaatcgatagccttgaggcttattttgaagatcaaggaaacaagacagacatttgacccttaaaaccattgtcagtgacgtatctaggcttattcagtatatcgacgattcatctctgttttcatccatgtattgatcttagtccaaaaatgaacaagttgtcatattcttcgaacagggtggcaaagaagagctccctgccctttccattaagggcaacgagaaaggacagttattggtgcattttcacgcgcggttatcagcaatgcaagccttctcaacctgcatttctctgctgcactgttcggaagcttcgacagccgtaagtattgagaagggcaagcacaagctctactccagttcacttaagatgctgctcgaggaggaagtgagccagctgatcgaggcagtcacggcagaagagaagaggaaaacaaagaagagaagtgagaagccacccagaccagttgtgctcgacccacccttctctcccatgggaagagtgtaggtattgagaacaactgtgttctcatggtcatggtgtgcaacattatgagtcatatttgggtttcatgtccatattttttgttgtgataaaagaagcacttttatgctgttcataaagatggaaggtgcgtgtagggttttttcttatctctttg

SEQ ID NO: 41497 - DNA, 15408 bp, Oryza sativa
aatggatactccgatcaaatggtggtggtggggatggatggattagggcattaggccacactagctacgagttaagtcagtgctgaactttttgtcaggatcttggctgttcatttatgtttgttgcattgcagaatcctatgggttgactgcaagtgcaaattttaggctttttaagtagaaagacactactagtccgtactactagatgtttctgttttactcttatcgggctaatagtgcatgttccattttctttatatattttgtgatgaatgggggaggctatgcttgtttttggaaagaggaggttctgattgaatggttggtgaggaagaactggacagtataccaatggcgtattgtaattctggttccaaatttaggacgtacaggagaaaatggtagagactaggagttgggagattgtggttttgggtgctcaatgcatatgctgcagcatcattctgagaaagataatggaccttggccgtcagtgaagtgttttttccttttttttttaaaaaaaaagaaattaaagcctggcctctacattgcgaggggttatttctggttcatcatgaattgaatttggcgttaaaccaaagctggcacaatctttagttgttgaaggaacattcctgtgtgttatgcttaggctccactcgaatctcaacttgttttgcatttatctacgcttttatctagttatgcttatgctccattaacatatagggctctcttctatgagcatgttccccggattctaaatagtgtgttgtttcgaacactttaattaattaagtactaataaatcgtttttttgcttcggactggtcttcacactagttgctcctcctcttcatcctcagtgaagtgaagtgatgaatgcattctttctttgtaaccagtagtcctctttctttttatatttggcaggttaaaataaaatcttagtactggtactgcactaaaactagtgatgatgctggttttgcccagaagaagcagcagtagcaaaaggtaggtgctgtagcagcaagcaactggtggtaattaattaattaaaatataattataattatagtgatccagtcactaactcagtccagtacaaaatggagttcccaaacaaaatgggaaaggaaatgagcgcagcccttccttcccatctgctgccacatttcatttcatttttcacctcaccatcgccgccgccgccgccgcagtgagctagggttccgaccgaccgggggggcgaagggcgaaggcaatggacgagtcgaccgcctaccgcaacctgcggggcccgtcgccctttgtgttggccatgaaaacccgcctcgccccgccgccgcagctctccgatccgcctccgcctcccctccccgccgttcctccctcgctcctaccgcccctcctaccaccacccgagaagcgacgccggggtcgtccccgcaactgcgaccgcctcactgcgccgccgggcttcttcgccccgctgccgccgccaccgccaccgcaacctcaaccccccacgctgcctgcgcctcacggtgctcaatcccgtactttccaactctaactcttcacttgtgcatgtgctgatttttttgcttcttgtgtggtgtggacagggcaggggcaattcggtggcctccagccccaccttctccaaattgatgcaggagaggtatctatttctctctctctgctatatagattgtgatgtgcctctgctaccgctgctgttcatggttggccccctctttttgctcgctcaacgacccacagcttaggaattaaggatcaccgactaggattaggatcaacgtactacaaatacacccggtgactgccttctaaattacatttgatttcgtatttagatatgattgataatttcagtgaaaaccggtgtttcaaaccttaactgcaattcgatagggatgtcacaaaaacatggtttcaacagattgggaatagctctacatatcctgcaaaaaagtgtggattttgtccaccaccaaatcgacccatatctgtagaaaattcactgaagcagaaaatagaaaacttcttttagtgtttctgcccaccacattctttgctaaaagatccatatgcaaactttcacaacatttttcatgccgctccaagaagagattttttttttgtttatagttttctcaaatatgcaactgcagaactgatcataaaaaaggcagagtggtgtatgcataatgcttcttttggtgcagatgatgtatggctacttactatgttttctctaatcaaaatgtggcaagcgattttattcttctgaaatgaccatgcaggaaatcataccgaagattacggcactgtcaaagtcaaatgggagggtgatctgtgttctttcagtgcttggagctgttcaagaagcaactctgctcctatcatccggtgttacttcatatcacaaggttcagcttttatttccatatggcatatggggagggaaacactgctcaaagtttaacactccccctccccccatttagataacatagtattccaaatatataaatgtcaagtgtatgttcaagtgatttttaaataattatcgaagcggtgagggggcattccagttcttggcctggattaactcaaagggtggaatgtaggagtgccagtgtttgagatggcggccttgaatttgatcccatccatgtgcaggggtggaattgctggcatgtgttccaaactaaaataaaaaaccgcaaatgtagaaggatgtttttcctcaaattgagctttttgtattattaaacttactgccaggtcagttacttttataaaagcaaacagataaagttacagagttacataagtacaacatcaaacttaaaattaaataatctgtaaccaatcaaacgaataacgttgttgcttatttagctaagttactgtgacaaagttgataccaaaactctcattcaatttttgcagggtcctttggaaataattcgtttgttcggatccattttgacaccaaatgaccaaggatgcttgcgtgtaacccttgcttctggcgatagttctgtgattggtggtgttatcactggacctctcaaagctgcaacacctgtccaggtatcttcaaatttttgagacagggatatgctcaatcagtttttagtaccacatatcatggtaacaacaggccacaattcacatacatttttatactcttccaggtagttgttgcaagcttttacagcgatgtatactggccaaacaggacacctaagatcattgcaccttaccctaattcccagtctaccatcaggaatggcagcactctgtctagtgagcatgtcaatccaggatatgtatcttacactgcagtggatcaacatgaatcaagtgaggttgatgttaagccctcactcgggatgcttaacttagcatcattggatcgacatgaatcaagtgaggttgatgtcaagccctcactcgggatgcttaacttagcatccttgtaggtaatttaactcaatggaagagatgtttgacatatttttagagaaaatgcatcagatagctcagatttcgtgaaccatcaagtagtcgtgactttgtggcttagttgaaaagcagttctttatagatggaacattgtactcttggattttcattgttgaaattcatgtgggcggcgggcatatagcttcagtgctaatggtgctctgatgaactggtaattttgagtgaagccaaagggtgtgtgctcttgagctgaatcttgaccttacatgatgtggctggcaggtttggtgggaacttgaaaatatcacaataagattggcaaggtacagctggttacagtaaactgatctcagaaggaatttgctcggctttctatatgtggtttacattttgcaaatgtctcatgtgtaaatatgtattgctaacctcatgatgctatccatgcttcaaaaggtggcatcgtgcctttgaagttacatggtgtaagatgggagttacaactaacaagagatattcgttgttattttcgagcctgttcaattttgtactaccaatcagcagggagagatgcaatttttgtactccacgcagaaatataatgggttgcaaatgcagccaggtgtttgctcgcaagtagtacttcatatggctggtttctaccttctggacacacatgccattgcggcaaagttgatcccttttttttttcagaaaatgggatgaacctggccaatacatatccaacgggatgtacgcaggcaacggcaaagttgataggaaatagatgggccgctccagtgaccggcgctgtcgactttgagcagcccattgattgaagaatcaggctagtttgtggggttaagagatactaatactatcttgcagtttcagtgaatgccagtgtatagcttgtggcaggcaaaaccgtctagaaagccagatcaaaacagttctcaactctctatcctgtcttgtgaactgaaacatgctcgcttgcgccgattgaactgcacaggaaggaaaggtgaaaagcagtggaggattgcaaaggtgaagttaagctactagtagtacatacaagccgaagcagaagtgtgggatttggcttggccttggccaactgatggatggatgtgggtatccgactatccgaacatgtaaatatggttgaatgctgatggtgtatcaccataagacaggcaggttttcaggtgagcagagtactcttcttccctatttatgggacctctcgaacaagaaaattacattgcatatgacccaattgtgtgactcacgtacaactactcaacctagggtgtgtttagttcacgccaaaattgaaagattggttaaaattggaacgatatggcggaaaagttgaaagtttgtgtatgtaggaaagttttgatgtgatggaaaagttaaaagtttgaagaaaaattttagaactaaactcggccctagttgtttccataaagcaggacttcaaacctggttatatcagtgagaacacattttccagagctctaaatcgcgtcatattcggatgaatgttttaataggcgggtgggcagagaggaaaactaaaatggcatttaccaatgaagaatcttgataacctggatgatccttgaagacagtaaccagaggcgcattggataacctaaggaaaacactagtaaagtatgcaactcaaaaaaatatgcagcataaactaggactaggtatcacaactactactgtacaagtgatcgtgctgagcacatggctcaccgtaaagaagaacaaggtaatcaagtgtcactttagaatctccagatagaattgagatctaatgcagttgtaataactactgcaactttagcagtgatagcatattatgaccgttggatcgatgcagccaacagcttggatttgctctgccaccctctgtacagtatacgctacagtagaaaattgctacagtgattcgtgaacagtattttctgatgatctgagccgctggtttttgatccatcagctaccttgcaactgctaaagttgcagtgatagtagcaaccgcactggatctcaatcccttgagataagaccagtcaaacaaacatatatgacagcttgtattgtgcgactccaagctggagcttgatggacggtttaactgtgcagctgcaggagcaggagcaagaatatattgatccacaggcccaagaaatgcaagggcaacttgcatatcgactgtgctgcacatgcagtcatatgaatatgatccggcaaggcaagctgtgacagtaatgctaatgcaatgctggccctcatgcctgccttcacttcacaaaaaggaaaagtagtatagtagtagtagatcttgagcaaggtatatgcatcccagggtgtgcaatgcaagcatggcttgtcctcctcttgtgtaaacattttttcatcatcaactgtttcaacttgcagaggaatagaagatccgatcagaccatccagccaatccaaattactttgactagaagtaaacaatactagtgatcaagtggctgtatgatcgatcacacagactggaatcatcatctaacttgcacacacgcagtcttggacacaaggaacaggcgacctcaacctcaatgcagcatttgcacttgcaacaagtactgtaacaagcagcatataccaacaagttaaacaaccctgatgccagttctctcacctgtacaatcccagtggtcagtggcagagaagtgtgagtatcaaagaaacatacaaagcactctccactgatgaacagccattctgcaacactggaatgaaacaaacacaagttgagttgacaccaagtagagtactctaagcagcaactctgcattttactagaagatagattaacaaaaataggatgataattcatacagatcagttagacagtaacagcacatactcctacgagtacaaggcaacagggtattgtgcctatcatcaatcaaagctgagtaataataatacatcaagtagagtagagtagcagctaggagtaataattaagaacgacaacacttgagaagatagcctaagcaacacaagaagtgaaccgaaccccattagattggacattgatattgcagtagagtagtaattagtcctggagatcagcctcttcttcctcatcctcgtattcaccctcgtcgtcggcggtggcgtcctggtactgctggtactcggagacgaggtcgttcatgttgctctcagcctcggtgaactccatctcgtccatgccctcgcccgtgtaccagtgcaagaaggccttcctgcggaacatggcggtgaactgctcgctgacgcggcggaacatctcctggatggaggtggagttgccgatgaaggtggaggccatcttgaggccggtgggggggatgtcgcagacggtggacttgacattgttggggatccactcgacgaagtaggaggagttcttgttctggacgttgagcatctgctcgtccacctccttggtggacatcttgccgcggaacatggcggaggcggtgaggtagcggccgtggcgggggtcggcggcgcacatcatgttcttggcgtcccacatctgctgggtgagctccgggacggtgagggcgcggtactgctgcgagccgcgggaggtgagcggggcgaagccgaccatgaagaagtggaggcgagggaaggggatgaggttgacggcgagcttgcggaggtcggagttgagctggccggggaagcggaggcagcaggtgacgccgctcatggtggcggagatgaggtggttgaggtcgccgaagcttggggtggtgagcttgagggtgcggaagcagatgtcgtagagggcctcgttgtcgagcaccatgcactcgtcggcgttctcgacgagctggtggacggagagggtggcgttgtagggctccaccacggtgtcggagaccttgggcgaggggaagacggagaaggtgagcatcatccggtcggggtactcctcccggatcttggagatgaggagcgtgcccatgccggaccccgtgccggcgcaagcgagtggcaaacctggaaccctgcagcagcagcagcatttgaactcagatttgatttgaggagaggcagatctgagatagttagggtactagttaccttggaggcagtcgcagttctcggcctcctttcgtacgacgtcgaggacggcgtcgatgagctcggcgccctcggtgtagtgtcccttggcccagttgttgccggcgccggactggccgaagacgaagttgtccgggcggaagatgtggccgtaggggccggagcggacggagtccatggtgcccggctccaggtccatgagcacggcgcgcgggacgaagcgcccgcaggaggcctcattgtagtacacgttgacgcgctccagctgcaggtcggagtcgccgtcgtagcgcccggtggcgtcgatcccgtgctccgcgcacaccacctcccagaacttggcgccgatctggttcccgcattgcccaccctggatgtggaggatctccctcatcttctccttcctcttctttcttcttcctcgtaggcggcggcggcggtggcgaaacaagaggaggaggcggcggcggcgtcgggaggcgttagtggagtgttagggttggggcagttggggtgggacgctttatatagagggtgggggcgaccgacgaccacactgacgccgtctgctttttttggacgagccgagcagagggaattcgaattttgaaatctctctctctctctctctctcgggcaggggaaacgaaacggaacgggacggcctgcgtgttgccagactggtccccctaacggctagtcactgcattggacgccgctctctatttccaatcttttacaaccaacggcccatttaacgttgggcctgtttaaatcccacccaaaattttttattgtcacatcgaacgtttaagcacatatatgaagtattaaatatgggttaaaaaataactaattgcacagattgcaactaatttgcgagacaaattttttgagcctttttgctccataatttgacaatgtagtggtacaataaacatttgctaatgatagattaattagtcttaataaattcgtctcgcggtttactgtcggattctgtaattagtttttttattagtctacgtttaatactttaaatgtgtgtccgtatatccgatgtgacacgccaaaactttacacccttggatctaaacacagcctaaataaaagagggcagctaccccacggaattccgttactgcacgatagtcacgggataaaattagcacccaacagatttaataccgattccttttctgatcgagcccaacgttgtgcacgcgattcccctactcgccgcctccgcgtagatacctcgtcggcgggggcgcggagcgccgcagcaactaccagccagaacccggcgcagagcgcgagaaggatccttcccgcaaccaaaacccggctcggtatcgcgcgcctctgcacgcgatacatcgccggcggcgccttcaactacaacaagcaggagtgctccttcccctaaatccagtgcctccgcgcgcgataccttgctggcaacagcgcgtgcacctagtcgcagtagtcctcagcaaaaatccatctcaggtgccgacctccatcgccggatttccttttgcgtacctcactcaggtatctattcaagtagtttttagggtatcagcttctctagtttttaggtatcattttttttctctagttaggtatcagcttatctctatttttcaaggtataatggtttgtgttctgcttgttatgtgtggggtgaaaaactaactagaaaaatgtgtggattattcatgcaattttagttaaaaagttttttatggctgaaagaaaagagaatgaattcctcggttggatctgctggaagaatgatggaagaggtagcaaatgaggggaatgttgtccttagtgaaagaagtatgaaagagcaacatagtgacaaggatgatgtttgtgttgaaagagcaatggaacaagtatcaagtcatgatgatgatgtgttgagggaagcactgcttgaaactgggttgtttacaggtgccatgagcattgatcaaattgatgcaggtgatgagtttgaaatacaagatgagtttggacatgaagatggagaaactgaagatgagggggtccaatctcaacctgcagtccctgatgttggtacggagttcttttcagaaaaataggctcaagattactacaatcgttatgcaaaaaaccaatgtcaccaaggagtacaacatatatgagattgcttgctactccaagcgcacaagctagaaaaaaaaagcaatgtcaccaagcgcccagacctattgatatgaggtgaaaagatggtctcttataattttttttctcatttgtttcagctcggcatgaggaggggtaaattcattgattcatcattcattttgcaggggtgtggaagaaatatagcactaaggggtgtgggagaaagatagcactgagggaaaaatacaacatttcattttttttttacatttgctaaatgagacttgttcatgtaataattcctctttttggctgattggtgaaccatgttgcttgatactaaattgaaagcttccgaacagttgtgatgtatggtcagaaaatgtcaaatgtggttgcacttgccgagaaaaaatgtacctgatacctgaattttgtttgatacttatacttttgaggtggtcatggtaccttgatgtgagatgtactgtgaggctaatacctgtactgtgtggtgccagtcatgaaacctatagcgacaatgtattgtaatgtataaggtctggtgtctgggttaagacctggtacctgggttttctgggaggtaccagacctagtacctatatttgtgaggcggatacctctatactgtgaggtaccatgtctggtacctggctttagaattgataccggtaccaattttggtacctagtgccaggtactaccaggtaccagacctggtacctggattgctaccaggcaccagaccctggtacctatattcagaccctggtacctatatttgtgtggctgatacccctatgttgtgaggtaccatgtttggtagttgggttcagacctgataccttggttttcccttgatacctttcaaatgcgaggaaaaaatcactttagggtaccagcccctggatacttatagacatttcgatttcatggtttaaaacgtggtatattttttttaaaaaaatgtaccacacaaacatgcataaaaaaagttgagtgctgcaaacgaaaggtaagctgggatgtatttcacatggtgacatggcagtagccattacatggtgacatttgttcacatattcacatggttaaaaacaaaaaaaatgatggtaccactacatagttggcctggttctcattgtattgacaagccacggtgtcatgcttttggacatactacaaacttgcattgacagtaaattctcaaaacaagcattatgcacaaactgagtctgaacaggtgaaagttgagatgctattttgcacatgcggctcgagtagcagctgaaggtaatgacctgcttctgattgtgcactgaaacctaatttaattttctttagtattgtcagcaaactattagatgaaaataggaatagtaaaaaaaaagcttaaatagaaagaagacagttgaaaaatatgataccttcgtttcagtttccatcttcttccttttcttgttgccacaaatggcatttgatttatctggtaggaatttaagcttggtacaaggtttcgaggcacatttcctcctttgctcttcagcattacattggttggatttcttgacccttggtgagcgccttggaccactaggcacaaaatgtacagaatctgaattatctgaacatgtagccatatcgactctgtgtgcgaaaaacaaaaaaaggaaaacatgacaattagtccgctttcaatcattgttactgtaatgtcagattatagtgatacatgttacaaaattagttaaaaaaaatcagtagatgccactcctcccatggtatcaaccagaaaatatatatttatcgatacataaagttatataatgtacaattatcgcttcattttaacagcttcctcttgtgcaatgcttcagagttgtatatgttgtgtgcaaaatatatgtttatactacactagtatccccagtgccatgtaaactgggaaaaatattggtgtgtcagataaattttggtgaaccagtactagtaaacagtgacaagatgcagtttatgcatctcatctccctcccctgtatcaaccagaaaaatcaaaacacattggtggcagatttcgacaattccatcagaacctattgtccttctgtaatctagctgatacctagtaaaaataaaagtagatattactcctagtaaaaattgctggaaacacgatgtatgtgtgttaacagtgtacaatctcatctacgcatgaataacacaaaaacaagtaactcgtctgtttcatatagactactcgatgtcacaaaatagattccaaccacaaacaaaaagtttcatgagaggagtaaccaacctgttaattttaacaggtcaagtatcaaatacgactaccccatcacgggatataattttcttgccacccccatcacggcttcccttggcctcgtctataaaaaatcagaaaatctactgaactttgatgtagaccctagaacagaaatgtagatagaagctgaattagccaagttgaaaagttgggatgcgagaagacataggaaatgaaacttagaaattaagatgaatcacatacctatggtttgagtctgctgcatgagagggggttgctgctaagtggtacctgtggacagaatcggaggaagggatgggagcagcggtgcggcaccgtcgtcatgggggaggcggagggagggaggggagcgacggcgcagcagcgccggcatggggaggcggaggaatggaggggagcggcggcgcagcagcgccggcgtgcgaaggtggaggaagcgaggggagcggcggcgcacgccggcaagctgtgagtggagggacgctggcgagctgtgagtagaggggaaaaaggttgaggacagataagtggaggaaagggaaagtggcgtaacgtttcggacatactccctccgtttcgttttatttgacaccgttgactttttaacatatgtttgaccgctcgttttatttaaaaaatttaaatatttattaatttttttcatatcatttgattcattgttaaatatacttttatgtatacatatagttttacatatttcacaaatttttttgaataagacgaacggtcaaacatatgctaaaaagtcaccagcgtcaaataaacgaaacagagggagtattaaatttgtcccgtgactaccgcaccgctacgggacgccgttaagtagattttttttttaaataaaaggaataaagtttcgaacccaggtcggttaaccggaagaaccctaggcaagattctcgccaacagtccatttaatgttaagttcaaaactttgcatcatttcgattaatatttccagttatttttttaaaatgtgtgattttgttttttaagtactccactttagcagatactcatcagtttaccaatagttcagatatccaaaactaggacatgctcaacaaaccttgttccagcaatgagcatttcaaaataaatacaagcttacttcctctataaaaaaacaaatctatgatgtgacacatcttagtaataagaattttaataactcctatatatattcaaattcatagtattaggatgtgtcacatccgtagattggttttttatggaaggagggagtgcgcaactatgaacggttgcaatagccaacactgacgatcacggccatatttatcttattaaatttggaaattaaaataagtaatggctttcgataattccacgcacttttgtttttgtttcaaatatatttgttcttacttgtgaaaatgtgagattttcttacagtgttacccccatttttaaatatacgatgtttttaactctaatatgacatttgaatattcattgtattagaaaaaaaataattatgagacaaagtgatggaagtgagaatcgatatgagggacaattattaatagtgtatagggatatcggcttagtctggcttattctacctcacatcttcatcctaacaagctaaaaaatacggcacacctcaacttgtttgcttgcttcattcggcttgtttagctcgtgatcaacgacgagtggtgcggcgagcaaagacgagcggtgtggggaagagagggggttgtgccttgcacgataaacaattggccggtcacctactcataggaagagagcaagtcgtggaccttgagctcaacggggtagagtagctcaatcccccgtgctaagggtgcaggtggatcgacccacggactcatttataatgtagataagtgtgttcatgagtcgatcaggtttcaccaatgctttcgatttgaaaggtggacgatagactgacacgcgtagactatggcacatacgtgtgccatagtcggtaggcggtgttggcatggcacacgcaacaggaggaggggtgagttgacgagtgttggcgtgcaacgatctaaccactacgactagcgattatttagagcaaatttaatagtgtagcaaactactagctctaaatcatatgtagtcaatctaatagcccatttatatagtagttactaaattggtactacatcattaacatattaacatatggtctcatttctcatacacataacgttttagagtccgtgttatagctggctataagtctgtagtctgtttttttctctcttatcttattaatatcagcttatagctgatttatagtctgctatcgtatatgcgaggtggaagaagagtgtgtggcggcaatgtgccgtgggatgcgaatggaatggaatggcgttggggtcttggggagaagtggaagcagttgggccatgttgggctgtagtcgtggactgctgggctgctagtttcccgaattttttttatttatactttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaaaatcgcccttcttaagggcggcaggcaattagatttgtaaattttcgaaacaaaaaattatttttgtaaatatgttaataaaaaaatgtataaataaaaaaaattcctagtttccctggatcattcggcttgggaaaaagtacacc

SEQ ID NO: 41498 - DNA, 27017 bp, Oryza sativa
acggtggtgtacgacctgcgcaccgacgtcgagcagccatcgctcccgaacccctcctccctcgagcggaggcgggatgcgctcctcgcctatgcctgcgccctctccctcgtcgagccccgtttccccatccgcctccgcctccgcctccgccgctgtcgtctcctctcccatctatcggccccggcagctagagcggatcaacgacgatgacaccgacgtcgtggtcggcctaccgcactgcctcctcctctgtcgacgacggcaagataagggacctcccaccatccacctccccagatccgacgacgacgacaaccgccgcgtccagttcctccccaggcggctgccggccgcgcccatctccgccctcgctggtcgctccccactcctcccccgccggtttagggatgagagaggaagagaggtggagagagagaaggggaagaagaggctgacatgtgggacccacgctgagtcagctgccacatcggacaaaaccggagtcaaaaccgccgagggacctagtctacactggttttgcaagttgagggacgcgttgtatccgttttgtggtttaaggatgattttgtaattcaatgacaagtcgagggaccttcggtgtactctttccttcggcttgttatgcctaacgagcaataatttttaggccatgttagattcagattattcaacgggttattgcgaaggattatctatttaactattgagataaattaaatattttcataaaacagatttaaataatactagcttaaaacaagcggtataagcaaaacattgttttcaagggtagagcaaataatgaggtgataatatgagaagaacagggcctaagctcaactcgtttaccattcccagtgagccgacactaaaaaacacaatttttcacacttttcttttattttttcaaatggactaaaaataataccgtgagtaaaaatcacatttatttttacttgcagaagatataagcgcgcttaagacatctatgagagaacacattatctttactgacggacgatataaacagtgaggatcgattttagaaaaatatgtatttgtacctaactttttcataaaaagtctgctaattaaatttataccaaacttgtactaactccgtccaaaaaaaaatgtcaacctatacatagatgggacattacatagaacaatgaatctgagcatctccagagatttgttgtcctatgtaatgtcccatccatgtctatgattgttttttttacagagggagtatatctcaatgagaactaaaactttttaagctgaataattttctatttgagatcatttagggtttaaaatatttgttataagatttaagatctatttcacagaatttcatatatacgattcaaataacctccgatggacacatgatatgtgtcaaagttgtagagctagatctacaactttgtaattcatgattttttttatttaaaatcatttaggctgtgttcgccacgcctagtccccaacatgaatagtgcgcacgaaaaacgaagcgatccattagcacgtgattaattaagtattagctatttttttaaaaaaatagattaatttgattttttaaacaactttcgtatacaaactttaaaaaaaaacaccatttagcagtttgaaaagcgtgcgcgtggaaaacgagggagaagggttgggaataaggggtgcccaacacgtcttagagaggcaaataagtattttaagtttcgacaatggaaatcaaaacgatagcattttaaatattgacattaagtgcttcatactaagatggtaatgtaatacatgtgtggagagaaacgtattgcgttcaaatcccacaaatcacatacttctggatttaggccctgtttagatcccatgataaaattttacaccctaccacatcatagatgaaaaaataactcaaatgtttgaacacatgtatgaagaaataactaattacacagattacgtgtaaattgcgagacgaatcttttaagcctaattgcaccatgatttgacaatatggtgctacgataaattcatctcggcgtttacaagtggattatgtaatttgttttattattagactacgtttaatactttaaatgcttattcgtatattcgatgtgacacgccaaaactttacaccccggtatctaaacatagaaagacacaagttaggttttcgtctattccaaacagtgctatatgaatgttgagacccccctgaagcgtccaaaatattgaccaatggattggaaaaatatcatgcaactaaccaatagtgaaaccttgtggtcccccttagaaaaaacaaaatcatgcaactaaccaaaatctagcaggaaagtgagtgctccctcttcgagatttagctaggggacaagtttcatgttcgggacctaattcgtgttctttaaatcttcctccaaaatcttctaatcaggtgggaaatctcattggttacatatagagggtgtttagatctaagggtgtgaagttttggcgtgtcatatcgggtattatataggtatcgcatggggtgttcggatactaataaaaaaactaagggtcaattgcatctatgcccccgctttcaaacccaattgttgttttagtcccactttttagggtttgcagttttaccccactttttaaaattgaagcagcgtctacctctacttctaacagccgtttggtgggtcctgcattttgtgttaaagaaatacaaaagaaaataaaaaaaaggttttaggaaatatgaatttaccttagtatccctgagtgaatggatagggtctggtcctcacctcccaacccgtgctagtgtgaattggaatcagcgagagcgtgctggcgacggtagcgagggtgggcacgcggcgaccgcggtgagggtgtggggacacccgataaagtcatggtgcccccacgaatacgtaactgtccaagatgttcagttacgcatgaaatgatataaaagcataagcttcggttatacattacttaagtcacttagttcacaacacaacataaatacaaaccattacataaatgacctataaagccttattaactgctagactccaccacaggaattgcttgggcatagaatgacctagaaaccataattgtcccactctaacgggtcaacaggatctccacaatcatcttcctcctcatgatctgaacccatttatgagtacaacaggtactcagcaagacatgcctatgatagcaaatacaataattgcaatataaaacatgcattattaagagccggaaggtttaaactctaaccttaacatttatttcatagagcctatcttaataaacatttgatataaacaacactattgaatatttaatttaaacgataataacgagcataaaattaatataaatgtcacttataaataacttgaataaaacatcaagcaataaataaattaaccatattaattaataaccatttagtttaacttgtgcccataatctggaatcatccatagacacatcaccattaattgggagcacggcgtattcgaatactctacgactctgcagcgtctgcctagctttacccacacgatactcacagctagccgggctgaaaagtaacaaggcgtaatattgctccatatctctcccttctgcctagtaagttaaaggatgctcgggtcattgctcggagtgatccggtccgaggtgtgtaccaacctacctccgcatccacttaccattgttcgttactcgatgggtagcccagaacttgatgggcccatagggcagttctgaactctcgggcccatcgagcccacatatataaatcacataaacataaaccatgtcactttgcttcacacacttgaaagctaatggccaatacatcgaaaggcctgcataagttcaatcaattggagcaatatacggccaggttcgacaaatcgatcgtgtggatgggcgaaactatgtcattcttattggcacaagagggttgattattatatcaattttaaataagaaataaccataaatatatccatatatccattacgaccataaacaggtccataaaaccaaacacatgaactccatcatgtgtaccacccgctcacaagcggttgttaacgaccaaatttggtaatgccatgggccggattcaaagttagagtcgaagccgatttggagaaattccgttcgagaaagcagaatacgcatcagttacaagtagcatcggctaccacatgaatcggctataggcggtatcggctgccacatatcggctaagcgctagatctgacggagtcaagccgatgcaaccaatctcgggaaagatggtcccatgtccatcattgggattggtcgaagcacttcatagccattgccacgcaatgattggagtcctaaaacggagcaattgtatctattaattaggacaattttcagtttccttagagatatgttggtaagagtccacctgaagggactcattcgtattttaaatttcgttagagataagagtcatgtccagcaaggacatattatgtacttcgaatataaatatgacccacaccatgtaatcaagggacgacggttcaataatactttggcgcatcgtcacccttttttattttcattgtttcgacaagttattgctttcgagttgggctgcatcgggttcgatctccaatgaagaggtaaagcttgttatggaggtttgcgttctcgggattagtgcttgcatcttcatgacactctaatcctgtctatgtaaaccgccgagttatcatatataccgcatagtctagattggtttcgtcatctaaacttcatcggctagcctctatcatcgagaggcaggtttaggcttcgatatcaagctagactatgcggtgtatctaccatcttgaatgagttttcatcgatttgattagatcttatgtttcttctcacgcttaatgctgcatcggttaggttcgatctattaagtactatctttaatcgttttatctagctctttctttgattgctaacagagatagcatcggagttttagccgatcttacttgatttagtcgtcttgtttccttatttggttctggatcatctaaatctgccccttatatcaagatctcatccgtttaaagtatattaagcttcctatcaatctgctagttcacattgctcgtttgaatagtttcaattttatatatttcatctatgctgatatctcggtataaggtggtatggaatactagccgatactagctgggtttgccctatcggctatgcttagggatggcaatttccctcgtggggccggggacctgcccctacgggggtgggggtgggtactgatttcgacccgcggggagtcggagtcggggccccggccatgggcgggaacggtggctggggaggacatccacccgcgggtgacctgcctggccccgaagatgtatattagactattaatactaccatattgtaagcccaaaaagcccatataacctatctttaagtgtttctcaaatactatcaaagcctgttagaatctaaggctctttaaggtgtccataacagcaacagaatatataatacaataatagcaatataattaatttaaaaaagtcgtgcagtctatcgtactccaaaggacaagtacgctaccaaaataactctctaactactggttgttcaaagaagggtgcatgtcttgcaaccttcaggctcgatgtagtcgtacaaaccgtctcctcctggcgcggacatttcactcgctccgactaccgggccaacgccaacgttttctatttacgcaacaatcatcacaacaataaataacataaaaaaaaagataaccaaaacaaatagtatcacaaagtgaaacaatgggtggaaaggattttaaagaaataattttagggatttttgaaatttcggtgtacggcgaaccatagggctaaaattagggtcgcgacagcgggtgctcggattgcaacgaaactgacatggatggatttggaataattctaggagtttggaataggtctcggattttgattgtgaggtcaaacggatggtcaacctgatagaataagaaaaaagatttttctgatttatttttcaacaggaaaataggatttcctgttcttctcgttatgtgcacaggaactggccgtaatcccatgacgccggttgcagaggaggccggttttgagtggggaggcgccggttttgcgatctaggggtcgaggcgattcctttttgtggtcggcggcgaggctggcggtggcgggcagaaacaggaggcggaggcggccatggcggcagcgactccggcgaactccgggaagggcggtggcctgatgaggttcactgaggcgagaggagtcctagggtggcgacggcagaagctaggcggtctggagcgacggcgcgccgtgcagccggcggcggccgaacagagcagtgacggcaggaggcggccccggcgacgttctggggacggattggatggggaaagagaggggaaagggagtacttggcatgaagaatccatttttaccttaaatttcagaggattagcgacgtatacgacgaattttggagctcctgtgaatggcgccggactagggtttcggggattttttcctccggtgacgacgattgagtcagcgggagttgggggcggatttgaggaggtgaaagaggtcgaaattgcggtccttttgcctccggtgttgagccttctagtggaagaacgaaggagttatggaggcgggaagctggaggtgtcgtccgggcattcgtcggtcgatcggcctcgtgcgtgcgcatgcgagcgtgtggcatgcgtgggctggcacgagctgggcgcaaggcggcacgggtttggtgcgaggcagcacaagctgggctcggcctagccgagaagagaagaagaaggaaaagaagagagagagaaaagaaaaaaaaagaaataatagaaaagaaagaaaaaaatatatggaaaaagagaattaaggttaaaatagagaaaaagaaaatattggggaaattaaaataaataggatttgaattggtgtggaatttagatggcccgacatttgggatagaatttaatttggattcaaaggaattatttgaaaggtaagatgcactttgcaacaaaattaaaccagaaaagaaacatcaaaaataaacatgggaaaataatattttaaataaatgtctaactcgacagttatatttttagtgaaccaaagcaagctaaatcaattttaaaaagttgtcaatttctaaatcaattttaaaaagttgtcaattttagggctgttacagagggactgcggacggctgctggcggcagccgtggcaagggcgtgcacgcggcggcggcagccgtggcaagggcgggcatgcggcggtggtggccgcggtgagggcgtgcgggtggccgcggctagggtgtgcaggcggctgcggcgagggtttgctgacagcggccgcgagagcgtgtgcgcggcagcagtgacgaccacgaggcttccacgcggcggtgagggcgggtgggctggcagacgcgccgctccgatggtagccaggcggcggctgctcccaggcaggcgacgaggcaagcgaaaatagaggcaaaatcacacaaactgaaaaaaaaaaggggtaaaaatgcgggcaaaaatgcaataaccaccaagggtataagtgtccctttactttacaactaacaccatcaaactggctgttaggactggggtagccggctggttcaatttcaaaacatagaggtaaaactgcaaatcctaaaaaaaatatgggtaaaacaacaattggatttaaaagtgggggcatggatacaattgccccaaaaactaattacaaaatctgtcacttaacatatttactataacactacattgtcaattcatgaagcaattagtcaaagattcatctcgtaaattagtcgcaatctgtgtaattagttaattttttagcttatatttaatactttaggtatgtgttcaaacgttcgatgtggcagtgtgtaaatttttttgtgggaactaaacaggccataatacattttcgatgaagatattgtaccaaacaaatggtaacagaacatgacaacagttaagactgatccccaggctaaatgacaagcacggatccaaaacatagatcatatcaaagttatgaacaaatcaaggagttaattttaagctcagcttgaattgaagtttagagtaagctcataacttcataagccagacgccaaaacaagaaagatcattagcattagcacataattaattaagtattagctattgcaaacacaaaaagatgaaaatgagatctatttgattatttaaagaaatttctaaatataaagttttcttaaaaaatagatcgcttaacagtttacgatgctgcttaatgtaaacaaggagtagctctccaaataagcccaagagaaggcgacataacttcggatacaacactacactacatattagacgaagacgctgagttacctcctacactgccaacgaccaaaattatatatttttcagacccagaagtaacaaccaaaattatagcaataaaacagggagttttcaaaatagtgcgtcaaaaatgttcagaacacagcatcgatggtagtgtgattagacttgtgaaataatgatttgtgtgggatcatttggagttccactttcccactgccgccattggcatcctggaaacatggcttcacctccacaccggtaaagacagcaacattctggtcaacatcaccccgagagtcactgttgtgactcctagagtggaagaaccttgtgatgcagaacctgccagagccgaggttgacaagttgagggtttttgcattccttcaaatcctctggcaggtaaagctcctcccaacgacccactaactgtggctgggagtccatggcagagaggttacaagcagccaagtagtgcggtgactcatcggagctgaagccaaaccagaggttgaactcaggcacatactcaaccctgccatggaagggtagggtccaattaccgacttttatccatgtgtggcttgccgtgttcaggcagtaggtgccaacaccatcgatggagatgcaaatgtgggggtcaccattgacggtgagcgatgtgtaggagctgatctctgggcggctgcagctgtgccagtacttaggttcacgaacgtacggcggcggcgggaggagttgccactgccaggtcttggagaagttggtcgatgtccgcttgtgcttgcagtagacaaaggcctcaaactgatcgctccactgtgtgcttgagttgacctctggcttgggaatcctctccataacaaaaagactgctgccagggcggtggtgttcatagtcattgtcagcatcggcgttgggtacaaacacagaaaagggcatcgacttgggcttgtggagacagggcaacatgtccatcagccgtgtctctgcttcaaagaggaaagggcgccccaagtgatccacccagaacatcttgtgatccacaaaagggaagcaatcaatcctacatgcctcgtttagagcaggtcggaacttgaggatgggtctgggaagccgaatcctctccatctttaagcctgctgccttcttcttgggattacaggagtcggacaccagtgtctgagaggtgtagtcttcttgcacagctgctgactctgatccatgtgcgattgttgttggtggtggtggtgtagcggtgttaccgaacagctggcctgccagatcgacgcagcgtagccatttggcgccttggaaggggacgtcgacgatgagattcttagcccgacgcgacaggcccatcttcagagtcgatcagcaactcccaagttccagctgaagcgaccgggccgtcaaaggatgaaaaagagaatgggaaattagttgcagataagaggtagtacaagaaagggtgtattgtttgcaggagttaggatgaaggaaggaagagtacctccaataagcagcagcagcaaacagaagatgtagccagccgagccgagataaagcttcctaatgaataacgcagatagcaaatgtaagcagaagaaaaggaaactgactttcgatcatacaggatgaagtcgaagcacaagtaaacaagcgattaaccttgaggcgcgcggtcggagcaggaagtcagactgggatggagtctcgacgcctaaaagtttgggtctgccatgccagggagggagggggagaaaatcaaggggtaaattagaaacagagaagaaaggggaatcttagtttttagttaaaagacaaagacaaaaaaaactagcgaccctaaatctagcagatacgagcaaggaaggaagagtacctccagcaaacagatgcgaccgcagtggattgcgcgtcctgccctgccctgcgatggatctatcaaagagtgttcagaccttcaaatgcaaagatgaaatcacgaaaacctaacaaacatcaccgagaaaacaatatatatgcaaagattaaacgaaataaaaggaatcggctttcgatcaaacatgatatcaaggtgcagcagatgcacagctgctgacctgaggagcgcggtccggtcggagaaggggaaaggggccagcggcggccggcggggatgggagtggcgaatcgagattgggatgggggctccggcttccccttccttttagggttcccgcatttctgcttctgtccgtgggcctctcttagaatgagcttggcccacactggtaaattatgggccggcctacgacggcgtcaaatgtcccgccgaacgagaaggtacacttgacctccctcagtcaaatgacatgtagatccaatctatcttctgccctataattcacccactacagtcctactagtaatatgcccatgctaaacactacggtacaactctatttgtctttaattttttttaaaaaatatttcatgttagccaccgccgcccgtctcccctcctcctactcgccccccaaccctgtccctctcctgccgccgctgacgggccccgcctccgcctcgcgtcgtccccgtcacctcgcaccgcctctgccttcccctcgcgtcgccgcctacacctccgccgccggtgctgccgctgtcgccttgccgtctccacctccctcttgcgccgtcgccctcgccgagcgcgggtttcgccggcggacgcggagaaagtgaggaggcgagcgctcctctccttttccccggctgcgaccaccggcatggaagaagaagaacgcggcggcaatgatctcaaccattgtggcggcggcgatgactggtggcaacgatgacctcgaccacggcggtggcaacaacgacgacctcgaccaccacagcgacgatggtaatgacctcgacctcacccgcttcaactggttgctgaccggatttggacgagaatgagatttcggtcatcggatcggttgatggcgagctcctggttaagagttaagagtaattaatcagaaattttaatcaacactgaacagcacacccatgctgtacaggcccaaccatcctgaacaaccatacccggctgtacagatctaactccaaaccaggagctaaacaaattattaccagttatagcatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtaacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaagaaataaagtaatcaatgcaaattggccataacaaaggaataagttcacaccacccggtgacattctaaaataaatgcatagttgaaataaatagagaattttaaatataggatcaacatgctcaaaggattgtgtttaggatctgtgtgacttgccttgcaataatcggtcttcaattaatcttcttgaatacttccggcgcactcgcgaaccttcgcaacgacgaaaacgacaagctaacacgcaaaacgaagaaaaagactaataaaaaccaaataaacaatacataaaaagtaaacaaacatgtagatcataattttagatgaattatgagacttgaacggcctcattctgacttcaaaagaatttattatgaattttataagattaaatctaattaaagcccatttaaaaagaattaaataaatttaattcaattcatggacaattttaatatgtagatctttattttatacaatttttgcaacttgaaccacattaaactgagttacaatgaattagttatgaatttttaaagattaaatcggattaaaacacttatatggattttaattgaattatgacgcaataatgaattatttttgaaaaggaaaagagaattattgcgtcagcggctagggtttgcggtgtaccgggcgcacggcaacggttcacgggaacggacggccgagatcgatcatatccaaaacggacggccgagatcgaacggatccaccgcggctcacggatgaacgacgacgatgacgtcagcggtgacgtcagcgatgacgtcagcaccggcggcggcttggcggctcggcagctcgggcggcgcatgctcgccggcgaacgacggcacgacgacgcaaacggaaggcaccaacgggtagaaggcgacgcgacgaactcaccggtgaccaaaaccacggcggaaaagcaacggacggcgccggcgacgaggaagaagcggcggcgaagatcgggtcgacggcggcgacggtgctctggcggtcttcggcgacggcgaaggggtggacggggacggcggcgacttggcgaccacgatggcgacctccccgagcgacgacgacgaccggaacggcggcggcgcacggctggagcggcggcgacgacggcggcgctaggtcacacggcgctagggcgcttccgacggcgagagacgaaggcgagggaggcggcgggtagaggagacaccgggggtccttttaaaggggttggaaggcggcggcaaaggcccacggcgaccggcggcgggatggaaagcttggggttcggaggaaagaaaccgatccgattcgacctcgaatccatgaacttccaaagcgattaagacgatgattccaaaagagaaaaggaagaggagatcgagaagatcatttcccctcaaaagatttcaccggagaaggaaagaatcgaccggatttggaaggagacggcggcggctcggacgcggctcggctagggtttcgggcggcggcggctggaggttgacgacaaccctgacaggtggggcccacctgtcagcgacatcgagagagagagaggagagcggcggctcggactgggctgactgggccggggagagagagaaagagaggggttttgggccgactttcggcccaaagccaaaagaagacatttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttttaagcttttaagatcatttctaattattccttttaaacaacaatttataatttaaggatttttaaacaaaaaaaaactcttaacaaatataattagatcattattgatcaaataattactgaactgttctttgtatcatttaaggaattgagctctgaaaaatccgagaaaatctcagagagttgacttaatcatggggaatttaataaaaattaaatccatccatgctttatatttaggaaattttatttcccacatttaacttcacttgtaaattaaagatcatttgatataaattcaaataataatttattaaataatttataaatcctgaaacaaaaatcaggatgtgacagccgccggtgctgccactgtcgccttgccgtctccacctccctctcgcgccttcgccctcgccgagcgcgggcttcgccggtggacgcggagaaagtgaggaggcgagcgctcctctccttttccccggctgcgaccaccggcatggaagaagaagaatgcggcggcaatgatctcaactattgtggcggcggcgatgactggtggcaacgatgacctcgaccacggcggtggcaacaacgacgacctcgaccaccacagcgacgatggtaatgacctcgacctcgcccgcttcaactggttgctgaccggatttggacgagaatgagatttcggtcatcggatcggttgatggcgagctcctggtcgcttgatttagtggcactgggctcggcggtgacagattgggtggcgctgaggaggatgaagtttcatgcaccggtatgcttcctccagtcaccgttgtttctagcgattctctttccatccccactccctattgatctgtattgcctcgtcaaatagtgaccgcgagccgatgcttgctgaggagcccgtactttaggccttccaatcttcaatcaaccgctcaagggctcaaggtgtttacacctaaatttggcacctaggatcgaaataggaaaaattgccaaagtttgaagttctgccggtttcctccagagtgggctggtctgaccgccgtttgtcggccagtcagaccgggcggtatgtggctggtctgaccggcggtatgtagccagtctgaccggcagagtccgagtccgggtctgtttcgccgggtctcgaagtttccttgctcgggaagacatgtttcgggtttcctttggattctatcccgaattggacatggaggagagcctgttgagggcaagaccaacccctatataagggagtaaggccggttcattgtaaagatcaatctacaatcaatcaatcgaatcgtttttcatattgcttttagtttactcttagtttgtctatctttgtcgatttgcgccgtaaatcgtccgccgccgctgcgagagtgcggcacctctttgtaggtttgtcctgaataccttccgttttgcccacgagacgggtagctatatagaatcggctccgctagccgatttagttatcaaaacccatcttagtctagtttttgctagattgaggtggttggcgactctaggatcaccgcaaggcatttaggtgctgcgatcgtgcttggtaatttgtcacaaaaagttgccaatacaaggtaatgcgtgtgtgtgtgtgtgtgtgagttctaaacccagccaagcacccaatcccagtcccgaactgtctagcgaggcacggtggtgtcacgcttgacggtgggccagttaagcatggggctgctggtaaagataatgctggtggttgcattgaacctgtgtttatatgttctggttttgtttatttatagtggtcatatgattgctgtgctatgcaggatgaatcaggttcgctgacttcgcatgacccatccatcaggtgtttgttggagatcttgcatttggtgttgctcgctttgtatacatgcgtggttcttttattagctactggatggcatgagaggtacagggtttcttataacttatttaggcttctcaaagggaaatagtcattttcattggttaattgatttttctggtctttacaaatatcatgtcagaacggattttcgttgtgctgctgtaggtccctctatcgcttcatcctacgattaattaatatgtttagaggcatttcctgtgtgggtcatggtttataggtgcccttatgaatgatatcgtcttctatggctgctatttctctatatcatgggcatatttattacagcttgtcaggcactgagattagattttgtttttagccatggcataggctttattgttatattcttcttactttatatattacagctttttatgttgctgagtatgtacgatgattaaggctaggtcttgaatttatagtagttttgtatggtactccaaatcaacttgggccttcgatgcttgtgaagtgaagtgaccttagtagttttggctctttctggagtaaattatgccattttatgatccttttgctcccatgcctaacaagtttttcagatgtaaatgtacgtacctttcaaaagttctttttttccccttgagacagttgcattccaggggattcagtttgccatgtacagttaaataaagatagtttcatgttcaggaaatgtagtaaggattcagccgtagtctaggtggttcttggaggaaatgcagttctgtagggttcccacgtcattcaggagatggtgcatgtgaggacactgatgttcagggttttttaaaaagatcttgaaagaatatagcttgcatattttgctggtggttttttttttaacgactcgcataagacagtgtgaagttcatattgatagagcagaaaaaaatacaaggatacaaccctgggaggccgtaaccatgaaaagaaaaggtataccacctcccacacaccgacaacaccaagcactcacccaggagaaggcctgcaccggaccggccaccgctaagcgtgaccgcccaccgcaaggccaacaaaggagctacaactgggatcgcccaaaacaatctatacaaccgacacaaaaccccgctctatccacatctcagggattcagggagagagggtgagagagaagatggaaccgctctcccccctaggccccccgacgtggccaacttgtacaaactaggacgctgatacaagaggaagagactctagaacgaacttgtagcagttgattgggaggtttcgacaagggtgctgccaagccaacgtctctagggagagaagcaacgaaagaaccgccgccgccgaccgtcgaggtcagaagaacctcgactgggctttcgcccggcaacaccactagaggaggtgagacggcacgacaacgccctcaagaggggaatgacgctcgcgcgccaccgttgccggcccagcgaggtcgggctgggttttcacccgccatccaccgcctgcctatccaccgttgacaccccaatactccaccgccagctaaacctctgccgacacgtgggcatcactgcacccgcccccctgccgaccagtctccgcaagccgccaccggtcacgccttgtcacctcacgcagcgtcgtcctctacctccatcgaccgcgtcgcaacggcaacctcgccggcctaccaccagtaccgcgcctcctcgcgccacggccaccttgcccggtcaccaccactgtcggccgcaactcccgccactgatgtcgtcggccacctgccgacgccaccagccagctgccgacgtactgcaaccaccaaccgccgtcgggcacttgctgccgccgcccgggccgtgggctccgcgctgccatcgccgtgaggtccgcgccgccgtcccgcaagctccgaactgccgccgcgacagtcctcgctcgatctggccgccggggggccagatccgcctccggtcgccggaaccacctccggcgctgctggatccgccaccctgacaccaatccatcgccgttgccaggggatttagatttgtcctgaaaaccttccgttttgcccacgagacgggtagctatatagaatcggctccgctagccgatttagttatcaaaacccatcttagtctagttttactagattgaggtggttggcgactctaggatcaccgcaaggcatttaggtgctgcgatcgtgcttggcaatttgtcacaaaaagttgccaacacaaggtaatacgtgtgtgtgtgtgtgagttctaaacccagccaagcacccaatcccagtcccgaactgtctagcgaggcacggtggtgacacgcttgacggtgggccagttaagcattgggctgctggtaaagataactagaacttacggcgcgcttcgcggcgccctagcgttcgctttgaaagaagaaaataactaaggagaatggtgggagcatattttagttgagctgatagtgtagggtttgtttcagaagacaggttgacaataaaatgcatattggagctataacaggcagagaaacattaatcaattgttcacatattcggtaagcattgaaagaatatagttggaaagactaagtgtcacaacatttacatcatttacaccgtttatattacatatagttcttctgaaggtcttcgttccaacataggctaatacaacttgaattctgaagtttgtgaccatcacataacctgaaatcttacatctatgtgacgataaaaaaaaaagtggttgaattctgcgagataaaatcagctaagtgtaaatccagaagccatgagaacttattatgcttcatagagcaattaacagcatatatatatagaaagaaactaaatgatcagccaagatacaggtgtagagaaagaaacatccctgctatttgcccggctaccatatagaagttcaattctttgatgaactataaaatgtcattgaaattggtaaaccacctgtgatttcttcctcctgtcaattaatttatagggaaagcctgacaataaacaaaataaaaggatgagataatctaattcgtgcaccaagttcttatgtcagttgatttgttattatgttggcaactatgtagcgatacccgcgctatatttacaaacatgcatttgtcatggaattcaaagaaaacttaaagctaactggcaattctcacatttccaaagattgattaaactcacttgtcaacgcacaacactaaagcattacttcatatcaaccaactccatgctctccttcttgctagaatagttcatatgaaatcacatataatttagctaggttactgtagacgtgtttgttaggactgtacttcatatcaataagttagatggagaaaggagtaagtttctttcaaccatcacacataaaacataatctcattttatgttgattcaattggataagcatacttcgccattatctaggtcacaaagatttgaatctgggaaacatacacctatatttatatagactgaatcgctaccctgatttagtttgcaggtggtgcgatggcagcatcattttttcactaaataagaacatgattagatagtattggagtaatcaccaacaaacagtggaaaatgaaactttgccaaacacagatccaacagtgatagaaaattagaataggagtttccatcatttgacaaaattatagaagggcacaaattttaattgctagctagataacctaacaaaatagcaaggaataaatggtagaatgattgaggacagaaaacctgaagagatcaaatagtgttgcttgggcaacgaagtgaattcgtcaacccaaaatccaatatctcctattctctgcacaaacagagttgcaaaatttcccttatgcagaacttagcacgccacaaccagtgtctaactctcaaagctgctcaaccaggctagcaccttgtgaggtgggttttcaagcacaacctagtactcaatgcagccatttattcatgagattgaatgaaatgaccagcataattccaaagcacttagcaagatagcagttcagtagtgtccaaaattcagggatgaaatgattcactaaatgaagtggcgattaatccaaagcaccttacagtccagtaaggtccaagaagtcctaataccagttctgaaagatagcttttagataatgagttctgaaacatagttgatcgctttaataatgcagatactgcaacttcaaatgttgtctatcataaaatggtcggtaccaaaaaataaattcagttgtgcacctcctgcggcacagccgtggtgcagtctttggtcgaattagaatgaattatcaggttagtcaaatcaattcaagaacatttattctagaaaggttcatccagaaaatgggcttagataagcggtaaaattttctattccaaaattgcgtcagaaaagttggaagattaacagacagatatatgagtagggaaaaccaaatcgaagagaaggaaaggtaaatacctgcacgactgcacaatggacaccatacgctcgcatccatcgatcactcttatcgatcatggcacgactgctcgggaagtggctccttcgcagccgctgtggcggtcatcccaagcctcctcgcattgcaggcagaacatgcatgacagcgtaggaatacaggggaaaaggagatctagcagcttaggctcaagaactgatggcttacatgggattcttcgtaatcagcattggagcttagcactgatggctcatgcccttccaatggaagcgtcggcggtccatgggtaccagagctcgacggtcgtaggcgtcgccgccgcaggtccatgaaccatctcccgcctccatcgccactccagctaggctatcaccaccaactacggcggcgcaatggtagagtcacctccccaggtagagagaaataggggaaaaagagaaaacaataagaacggaggcggcgactggttcgtgagtctaggaggcgtgggttctctctcctttgcttgactcggaagagggtgaaggggagaggggtgggcaggagatgggggacggcggggagaccgcgaggggaagccgtcggcggcgaggagaagtaggggaagggaagacgatgtggcgccgtcgctcaagggaggggagagagcgagagaacggtggggaacagtggcggctagggtttctgggaagggaggggataatagtggtttctttttcataaaacccccttactttctctttttcagagcgcgatcctatatttagaatttcgcctccttcacatagaatatatcaggatgtcgagggcctttacgtaagaatacacaacacacaacctctattaccaaataaatagaggatttttttgcaaaaacgccacttccagctccaggcgacgtggacatcacgggaagcgaacacgccagccaaaaaaccagaatcgaaaacgccacttccagcgccgggtgacatggacatcatgggaagcgaacacgccagccaaaaaaccgcagaatcgctgtggtgcgagcattctacggtcctctttaatctctccgatgctggtggttgcattgagcctgtgtttatatgttctggttttgtttatttatagtggtcatatgattgctgtgctatgcaggatgaatcaggttcgctgacttcgcatgacccatccatcaggtgtttattggagatcttgcatttggtgttgctcgctttgtatacatgcaagtgttacaatgtaggctttattgtaaaatagcattggtggcacctactgtattctgaaaggagaagaatagtcaggctttcagcattgatcacctccatacaaaagaatttcacatttgcgatcattagctatttagctgtgccattccagagcctgaatgatgcaaatgttagaatcagctggcaaaaacttggcaagtaacaacaggatttattattttgagcagttatttcgaaacccagcctgcaccttgtctgcaaattcttttgctcccattggcattttagaattagatcacttcgtacaaaatcttaaactattatgtaacacttgcacattgtgagtatcctaagaagatgagtctttgcacattgtgatgcatcgtagcagaggaatgcattttaccttcatcatcatgattccaactggtgctccgagttctccagccttagcgaataatgacctcccaacctcatttgtcatccataattttaaggcattttgtgttctgacttgtgaagtctaaatcatttacgataatcaacattcaagagcacatgaagtttatatagcacagctacccctacaaaccttttaacttgacggccataagctggggttgaaccggacagacgatacttttcctagtgagaaacaaaggaatcatacatcagaatgtaggttgaaccagtttttaggtttgggatagttccaaggtatgtacctatataattagatgttcaagctgtttaatgccgcttccatcatctgcaggattagcaagacagcagccaatgaatttggatgggcatttcttcaacacactacaacaaaaacaaaatcaacaaatatttgtttacttaaacaccgtgggaatgctggaaagttaggggtgccaccttagatgtcacttttgcaaaaaggcccctgcatttctgttaattacgcattggtccccgctgatatccaccataaaccgttggatctcgatatagggtagatctggccgtacacgtgtccaactgtgccgacccttccgcaaccgtgaaatcgttggatctggaacggacggtgtggatttcgccggtctgcaccaaaccctagtcccgtcgccccccacccttggacgcgcactcgcccttctccctatgcgcgccgccacgctttcctcctcggctcctcccctcacatgcgctgtcgccgccgccgccttgctgtcctcctgccctcacgcgcctctcctcgccatcctcctccacttgcacgcatcgttgccatcgcagactcgccatcttcctccactcgcgcacgtcgtcgtcatcgcaatctcgccctcctccagccatcgtcgccgacccaccgctgcctctccctcccagtgaggtctagaggtcaggtccgccagatccgccgcgccgccgctcgcgtgttctctgtccgctggcgtttgacatgttggttttgcatcatcgatctgctgcagctgtgaaaggtcgacgccatcagtcaaggtgtcgctcccctccctcctgttctaattcctgtccttgcgccgaccagccgaccattagcacagaggccgcaatgtaagtccgttctacctcatcattgattatttcccatgcattcacttgaggttttataggatccaccatcttgccttggtcccattgagttactcatgggttaggatgtatagcagattaaggagaggattggcttccattgctgctgtttgcatccgctttcaggttaagccatccattaagttttatcctcgttgttatggctgcttgcaaggctgcaagattcagatgatgtcctcactgttaaggatggccgcagctctgcaatattcaaatggtaacattcttgctaaaattgccacaaatgatgagataaactgaaatccaattatttcctttaattttaattgcattcgctatggtgcaatgtggtaagaaatccatgcactatagcaatgaagcctgttggggtcatgtatgtatggtcttctcagttgtcgtatttaacgattgctgcttattcttgttataaccaaaacctcgagagatagatcatgatcaaatgatgacatcgccacccatcatcgtactaacgcaatgtatagttacgaatttatgggtaaaataatgataaatgggaatatgacagcacccctttgtgcaggatctttgagctatggatgctaaacgataaaggtggctcacattgaactacaactgctaaaggcttaaaggctaaaggtatggatcttttaaatagaaaatgcagaaggagccttcccctgctgttttcgagggaaaaaaaaaggctaaaggtgtgaatagaacataaaaaactgaaccaatcaaatgacaatttctggtctgttgactattcagtattgcatgaggtttctatttgtgaattagacatgttcataatcaaattgaactacaagaaaaaaaactgagataattttattaagtacacatttggtatgcctgaaatttctgatataatcaaatttaatcgtcattaataacaatttatttggttaaatttgacattactttgcattaatacaaatataaaatgatatacataactcaaaataagaaatcaaagaaatgtggggtaaaataagatatatctatatctatactaatataaaaaagagttgcccctctccaatcctaccggccaaatcatccggatcaatctctactgtccatctgccctctcatgtaatctcatccgtccagttattccaccgatttcgcccccatgtggacacggtgactccgccgggcaaaaccccgctgcgatgactccgccgcgcgtgtcctctctcgcttgtcgcgatcgatggaccagcgcaccgccgcaacgccggaccaacgccgaccaccaccgcacccgtgcccaccgacggaccagcgccgccgctgttacgcctctaccgccagaccaccgcacaccaatgcatccctcatccgcaggagccccgcccgggactgcccccgacggcgccgcggtggttccccctactgccggagccgctgcggcgctcaaccagcgccgacggaccaccatagcgccggagctccctcatcctcgcgacggaccagcgttgccgctgctgcgcctccaccgccggaccatcgcgcaccaccgcatcccccttccgccggagcggagccacgcacgggactacccccgacaacgccgcggttgttccccctactgccggagccgctgcggcgctcgactagcgacgccggaccagcgcaccgccggactagcaccgacggaccactgcagcgccaagccaccaccgcggtcccatgttccgctaattcccatctcgggggttttcgtgttcgcctcgccttgccctggctcacttcggggcggaggtggcgtcgctgtccccgatcgaattctgccgatgcgcccctggctttcaagatctaagtgcatgcgcgccctcgccgcatgccgcccggcgctccggcagtccgggtgcccggacgcgatcggctccgaggtatgttgcccatgcgcgcgcttgctctcctttgcgatggttttggtttggccaccgtttgattgagaggagttctgggaggtacgcgttgtcgtaatttgggggttccgttgcttgcgatggggaatgctcaatgatctgcttgtgcagtttggtttggtggctgctgttctcatacgaacattatattctacatttagtatctgtttgtgccatcctcttatgatatgagcaggttgtgttgttggcattggagtgtttaggttgataatggtcctatttggaagacatatggattgctgctttattagctgataaaaatgttgttttaaatgatcttttgcgatttatgtgggttgagatgattctacaggtggttttgatcatacacagatttgcctaatattggaacttcatcgaagagtagttgggttttcctggctgaggagtattagttgattggtgaactaaaatgcagaaggaatcattcaggaataaatgttgcatcttatcattggaaactgttataaaaaatagtgtcttcaacaacttaatttgtcatagagagaaagattgtaggcaaattcaggttttccgtcatacctccatctcctcacgattcacgtgattagcgagttgccatggatgagccagcaagacgtgcatgcaatcatcagaaacggcatcgcaacagcacagcaccaagcacatgcctattcgccagaccagatctatcatcgcataaaaccaagcatataaccaacaacacgggataatgtaagctcactaaataaatgattaactgttcaatagatcctaaacccaaaatgaaacagggtaatcaccaaacatataagggtggatcccacaatgatgttatgatgcatcccctcgacgagcgacgccgcacaaataatctctgcctgcaaaagcaactaaagcacaacgctcctgcaggccatcctgagactaaatcaaatacaacaatttatgagcaataataattatcgatatttgatctgagcctttgaacaatgaacaaagacctttactttttcatcctacctaaatgcatattccaattctcatcctaattaaatttaccatttaacactatgggttaactaataaaaatacatgaatttttttctattttcccagtggctataagagccacgacaaaacaatatgaaattataaccaccagcaagagcccctgcgtcgctctcccccagaggcgactcgggtggcgaacctagccgccccctcctccccccgaccaccttcctcctccgcctcgccgccaccacaaggacagcggcggcggggcttcacgcctcttcctacgctggcggccaagggaacctccggtgggtggcgatggcgaccgccagatccgccccgccgtggccggatctggcggggtggcggctgacggcgggggtggagacggcgatggtaggggcgagggggtgtgggcgacggtggtcggaatggcgacgatggaggcggcggcggggatggcgacgacggtggggttggcaacggcgatggattggcgtc

SEQ ID NO: 41499 - DNA, 1288 bp, Oryza sativa
  unsure (1)..(1288): unsure at all n locations
acaccaaacacacctaatattactttcttgccacttctcaggtggtaccgtttattgggtttgcagtcgcaatgttcatgttttactctctagttccaattttactgaaggtatatcagcaaacaatgtttcctttgtgcaagtgtgtacctactaatttccttattcatgacttctcagttcttacatcccaagttcacttactgttccttgcccatctccttaaaaatggaaaaaaggaaaacccgacaaaagggatattgttgtactacgaaatggcactgccacattaagcacatggtttttgctctttaagtttctcatatctatattaacttgtgcagatcagtggttcaacaatgctaaacctttcattgctaacctcagacatgtgggctattctcatccgtgtgtttgcctaccatgaaaaggtctgatcatcgggccctcaatctgcaattctgcataaagcatactgcagtttattgtcttacatgtaaccagcaattgaatgcgctttcgctttccaggtcgactggatgtactatgtggcattcggtgtagttgcaattgggctggttatttactcagggtactcacctgttttactttctgttatccttccccatgaaaaaactcaatactctagctttattagttgcaagacacaaggcattctgaagtttgacgttaatcattggaacattaattatatgtttttaatcaagctgtaattttgtaattagcggttattcgtcctgcaaactttataatgagcgactgaaaaataaggcaggaataaattccactatgtaaaaaaatccatcttccaaattacactatcacagctgttctttctgttcactaatgctgacatgttgatgcagcgattccaacagcgacgatggcagaagggggcaagttgctgaggccactgatgttgagggaaagctacctgatgaggaggaggctgctgttcatccaaaatgccagggtgcagcatcatctggcatccgaaaattcgatgatggtaaaactcctcccactattagacctaacgagccacatgctcaaacatgaaagtaactatggactacagaacatagtggaaacaaaaaagaaaatcgaacaaggagagattttgttaacgcggataattatgtttgtgttgaaggaaatggcccctatcatgccctcagcaacgaggagctgagctgagagttatctnnnnnnnnnnnnnnnnnnnnnnnnnnnnnnnnnnnnnnnnnnnnnnnnnnnnnnnnnnnnn

SEQ ID NO: 41500 - DNA, 2723 bp, Oryza sativa
  unsure (1)..(2723): unsure at all n locations
tagatctagtcagttcttgtaagatatggggttgacaacgacaaatagggtccaatgaagacgggacccgcaagcacctcaaggggccaccgtgcgcacaaggtgtcgtgcaaggaactagaaggtaactcagagtatgaactggagctggcctaggtgctattttttttccttcaattttattaccgtaaaacatcactatttctttctcaccactggttccaaactagaagtgatgcccatttcgatccaccagtatgtaggtgtttactagtgaccccctagactctaaaggcattcttagggggtgatttagtacatcctatgggtgaagataataggagtttgtccatagatttttcttctttggccacactgtgaaggtgtggtgcaggccgctacaaaactagcaactttttttgacttgacaaaagtatgatagaatctttggaccacatgttcatggaatcctagagagttaaaacaaacatagtttgtgtgcttcataaaaaaaaacacaaaaccaaaatgatggaagatgccttacctaatacagaagaaagttttggaccaaaatttattaagtctagactttctatctttcctcgtccaataggctatatctatccatactactactacctcaaatatggcagtggaattttctactaatcaaatacataaaccaatggtacttttctacagtagaatactatctgtagagaccatagtgaccatcaacaaattatcagaaccaaactataccaagctgacgctagacttcacgtaggttttgccccttactttttcctatgagtactcatgtaatcctaacccctagtccgcaatctggaaagggcaaatcactaaaccaatcaagaataattggagcataataatatccggaccatctggaaaatcatgtcaatttctccaattgtgacaaggcaaggaattgccattgtcacttgtttgtgaaagtcacccgtgctgcaagtgagctaacacagataaccccgtaaagccctgaaggggggaaaaatcaaaggcatctaaagcactgaactgaatggatggatagtcattatcgacagtcacatgttacacacaacagtttaactttaaccacaccacggtaacgggggttgactgactatagcaaactcttgctatagtgcaacatttcagtataacgcgatcatactgaaacattttccgtcagtatcatctaggaaactgcaaaggtgttacaaaagttgccggctttgccatctggacaaaacttgttcaagcttctgattcaatttctgtgaatgatccaacaattcttggttcttctgtaattgcgcaaattttctgtagcaaaaaatggcccttctggcctcaacagaggttgccttatctcaactagcatagtccacccacctgccaaaaaagaacagaaatattatttcacagtttcaagtcctaacaaaatagtgataccacttcaacacaataacaagctcatggtacatttatcaattgttatgactggttaaaaaatgatcatattaataaccgcaactaaactcatgttaattagttgagtatccatgagggcatgtcctcacatggattctcatatctttgtaagaacatctagcaggctacaaattccgtaaaaagtagcaaaataccaaatcatagatcatagcatgtatcgcattccaaattatctactcaaaattaaatcaacaaaaatacaactatccgattgataacatgtaaaagtaagaagattgatgtaggcagtgtcacataaacaaaatgatatgggaactcctagcgtagtctagatgcaggacccatacaaaactaaactcaaaatggtaataataaactaaagaaatgaaaaggggtgtgctgaattaaaagggtaccttcagccaggtgaggaacctagagagtatgatcagtagactattgtgcagttttctccccctgcgtttaggcctgtattaccagttaaaatcacatgtcagatcagtgacaaactgtgtcgacaaagacaatttctactattcatgagtgtgacaaaaacaaaggtgaacttagttagcttgtgtgatctgatataagagtaaagaagagaaagttattganagcaatattagggtattaaacatgcgccaattgaggagagcgatacnaagttactgatatgctattcgagaagttgaaagtagaatatgctaatacgttagttttaatcaatgagcaacaagtatcattgcattcatcacaaggacaagatgaaactcagcatgtcaacatacatggcaatttttttgtaacctatataatcttgattcttgaaacatttgtatagcacctttagatcaacagtgaaaacatcagaactgatagtttggattctgttattaaaaagataactgattgcattattatgatagtaataaataaactaattccttaatagttaagccagtgatggtcatccaatcttggcagtaattctctgcatactcgtctaaacttctgatgtcaaattttgattatttttttaaaatatttcctgaaattacaacataaaactagtggggaacaaagatgttacatctcaatatctcacttcattatcaattatcatactaaaccctgtattatacaaaagtttcagtcaagtagaaaataaggaaccactagcttgatatgcaaaa

SEQ ID NO: 41501 - DNA, 897 bp, Oryza sativa
cttcccttgttatttgcatccctgcagatccatacaaagaaaatgaaccagttagtacacaagagattgaatgatgttgtttttgttgcctataactggaagatggaaactaggtttcagcttaggcgtgagaaagcaggaaaaggccagatccttaagtcattgaggagtttgattggaacaatgagtgggataattccttacatgaaccagttgaaggttttcgtggatgtgacatacataggatgatgttgatgaagttgttggtgcatcacgatctctttgagctcgctgttggtatttgatacggtcacagataaatccgcaagcgcacgaataccgctgtagcacttcacctcagagtattccaagggtatcgaatcacagaaaacatgtgcatatatctaggaacataattctatccaaggacaacaactaatggtaggctaaggctaaagaggattcctatggattaatttactagacttgagttaaaggtaaaaccctatcgattgcttctggcactagccctccgctggtctgccaagctgaatccagcctacggctctatgatgtacctgaacatggagggatacaaaggatggacaaggctatcaccaccttccgcctacctcactttctatggagcacacaacaaaaaaaggtaaccgctaacctaaacaccacacctaagttattgattactactctagccccacgcaggaacttccttctttatctagaatcctagtactagagcacttaataattcaactaagcgacgaacccgcaacgatgggaatatatgtcattcaagcaactaaattaaataccataaggagatccaaatacttacttaagaagcatccgttaagatacaaacgagagaagaaggcc

SEQ ID NO: 41502 - DNA, 1922 bp, Oryza sativa
  unsure (1)..(1922): unsure at all n locations
nnnnnnnnnnnnnnnnnnnnnnnnnnnnnnnnnnnnnnnnnnnnnnnnnnnnnnnnnnnnnactattaacaaagtttttttaatatgtattaaaaataatatctcaaaataatgtgtttcctgtgcagttgagatcaatgctttacctcactaacgttactgatggcataaagagtagcaccagcaattacaagtatatcacctttaactgggcttgtaccccctgcatagaacaacatgaccatgaacatttcagttgtacttcatttaggatttaactggtcataaagatgacttccaaaattccacgcaaaacttaaattattctccacatattcgtcaagcatgactggagtactgtatttttttaaaaaaaaatccattatctagcaacatattaaactgtggaatagtctttactccttacttcagaaaacagactagttatttttgctaatgtgaactcaaggttcattttgttaccataattataaatggtctgcaatacaaaaggttttattgcacttttttgtggtaagtgaagaagaaatgaaacaacaaagacatatataaatactaatcaccgaactattacctgccctatcacctgcatggacatcagaaaatacaactagcacaagtcctgagacacaaatcgccacaccactatattttctgaatctgtagttggtcttcaaaaacatccatgtaaggaatatcacagcaggaatagcccagcaatcaagaagcataacgcttgtcagagatgtgtactggtaagccttgacaactagaaaagaatagagggagttagtataacattgtaacaccatctgtctattcagtagacaggaaggactgtcttgttatttcagcatagatgaccaggaacttttggtcaacacgctgctgaattatccaacaaataaccaacaaagtattgcacatacctagataatttgcctctacatcgaccaaggctagtactaagtagtagtaccatttcatctgcaagagttagttcatgcataaatcagttccacagtagaatacaaattgaaatactacagcatcagtaggaaattatataaagttatggatattacgttccacaaaatatatgtaattgcttatttaaaattttgagaacagtttatgtacaaatagatgtatttttcaaaaggaagcaaactgttgttacaagtgaatagagcagtaacactaaggcactaggcacgtgtgcttttgaagttataaacgctaatttaactaaataacaataaccccctccgttttaaaatgtttttaaatgcatgatgctgttggcttttgaacattacgtttaaccaattttcttattcaaaactttagtaccttatcttatcttatccttcttatatagtgaaagcagcaagctttcttgcacgaggatgtgccacatcatcagaaatattttagccgtcggataaagagttcggataaataatggtcattggattgaaagagtgcatgtattaaaaaaaatcacaaatgggctaaacatatggaaatttacggaggtttttggtatctattgccctagctaagtatagatactttgtaaacaaattaacttatatcaaaaccttattaagagctaaggtaaattaatagaccatatataaaagttcttaaacaggatcaaaagtcgcgctttggctagtaaatatgaaaaaaaatataagtagtatcttcaatgacaaaacaagtcacaacaaaataaataatatttacatagtttattttttccaataagacgagtgatcaaacataaaatcccaaatccaacagcatcatatattttaaaacagaggtactgctgaaccaaaataagtagtatctaaaatgacaaaacaagtccaaccaaataaatgatatttaca

SEQ ID NO: 41503 - DNA, 1336 bp, Oryza sativa
acttgttccttgggagcatcagggctttcatccttcgtcagagccacaccattacccaccttcctgcttctcttctgcttcttcactggagcagcattgaaatcaatgcatacattctcatccccttcagccaaaggttcatcagcagcagcatctggctgtatggccctctttgggctcttctgcttgttcataaaaaaaggatcagcaaaacatatcaaacatagtgaacaatcgtaccatgcaacagcgaattgtaatgtgacaaaggatcgtgccaatcctgaacaccacacaccttcacaggtgtagatctcactttctgggtgctcctctgcgcggcagccaccgcttctttccccttttcagtaaatgatggaccgaagcacaacctgaagccttagcagcatgggcaagtattccggtgggcggcagccccttcttcttcctgccaaacaaatcaaagtccatccatcacttctgacaacaaaacgcgagccacagataatcagcatgaccggtagagcatcaggtttggtcagctcacatgcagaagctgcaattgcagatatccttgcacttggggcaagtccaggtgccgtcattggccaccttctcggcttcctggccgtacctgcgccacgaatcactcagaaatcacatggtcagccagccttgctctgcctcctgaagctaagaaagaagacgagaagaaattcccccctcacctgttaaagagacacttgcggcagtactggatcgtgcactgcttgttgttcttcttgatcttgtggcatgacgcggcgaagtccatcgtcttctgacggcactgcgagggagcaagaaacagagcaaccgctaaacccaagggtgagcaagaattccccgcaaaaacaagggggggcgagcaagaattcttcagatccaacccgacccaaccaccggggaggaagaacagggacgcacgactcctcataggacaccggctagacacggtgtcgaacagatggtaggcaggcaggtaggtgggaggaggaggaggggttacctggtggcaggtcttgccgttctccggatcatagatccggccgacgacgacgcggacccccttggattctacggacttccccttcgccgccgccgccgccgccgactgtttcgccgccacctcatgctgctgcggcaccaccaccacgacgtcgcctcctccttctccgttcaccttcactccagctgcttccatggtcggcggaccgcggcgggcgacggcgagcgcgctggaacgaggggaacaggaggagggatcgagagggggcgagaggaggaggaaactgaa

SEQ ID NO: 41504 - DNA, 3436 bp, Oryza sativa
aatgagcgaattgacgcttgaagcgatccaccccactgtcaagatccaacatatataaacagacatcagaattaccacttgaatatgtccttgacctaacgtgtagcaattttttttgtgtgattatttagcataagtcactaatttaatacagcatattgatttatgtttgtgggatgcaacaatacagaacagtgaattagttaccataaaatatgccaacaggtgatcaacttcgtaaaagaaatactggagttacctaggatacatgaaactcatctggtctcccccgcgcaaatattcttgcagcatatggggatgatactctaaaatctaaagagatttaacaagtatattagtacagtaaagagtcaagtggcagctctgtcgtaatattcacaaaagaattcatcagtggcacctctcggtaaattaattcccggacatcatctttggccaatttcctcttctcgaactcaaactcaagctttgagataggctgtgctattggttcgcgttcagagtttgctagcccattaaagtaggggtctgtcagggccttgaataataattccatatctcagtattcaggatagcaatgtatccaacatttcaaagctggaatgtctttacaatcaacataagttggctgtgaacactcctacctcttctgcacttggacgatctttgggatcaaaagcaagaaggcgttcaagcaaatggagagccataggatccacacctggaaattttttagtaaaaggaacccgaggctttttcctcatgttgctcaggtatcgtcgagctttctcattccgtatctgcaacccattcaataaatgaatgtaaagcacatcaatatgcattatttctacaatttacacctcgtttttttacaacaaatacatggaagaaaatagagtctgtccttgtgcactatgaatgcaatatgaagtcgctcaggaaaatataccactcaaaacagtacattaataactatatgaactatatgattcactgttagtgattttggaggaaatttgtacagaaatatgaaacagaggctgatgccaagcttaaatattaaatatagttgcgaagaattctgcataaagaagtgaacacacagactagtgaggagtcaatacattgcacttgagtgaaggcacaagcttgcaaggattgaatataccttagcaagggattctgctgaaggagtgccaagtagatcagtcatgagatccaattgatgcacaacatttttccctggaaagagtggctttcctgtaagcagctctgcaaatatacatcctacactccaaatatcaattgcaggggtgtactgcaaaagccaatgacaaaatataaatcaagatatcacctaatgcgacaatgtctaagagaacattctcaaaacactgttgctacattgatccaaacatatcatagtaatataacaatgttggaagaaaaaataatatagccatcaccatgttaaatggaaattcccttacctttgaaaaaaaggagccacacaactctggggcacgataccatctagttgccacataatcctagaacgaagcatggaaaattcattagatgccaagatatggctgttcattgttaagaaatatcttctcaacattaataaatgcctaaccgtccagaatatggctgatggggtatcgttaaatgacactcgggcaaggccgaaatcgcaaaccttcagcttgcaatcagcattggctagaatattcttgggcttaagatcccgatggaaaacacttgctgcaaagagaaaccagaaagtgagcgtgtcaaccacataagcaaaagaaattaccgatttcctactatatggaatctactacctgcatgaatgtacttcattccccggagcagctgatacaagaaaaactggtgatgctctggtgtgagatcatcatttgcttttattacctgatggagatctgactccattagctcaaagattacataaatgtccctgaattccctccttgaaggaggaagcattatgtgcttgatctcaactatgtctgggtgacgcagcaaccggagcaacttaatctccctaaggatgcgggtggcatcagagacatgatcgaaaacatcattgatcttcttgatcgccactcgctcgccggtctgggtgtcgacagcggcagccacaacaccataactccctttgccaatgacttcactgactttataccggtttgcttcaccatattcagtgaagaagtcaggttcctggaatggaagaaggtaaagttcactatagtaacagtactgaatgctaggtggtatgaacgggttgatgacatatttcttgggaacgaaaccttgtgccttgaaaacacccgggtacaaacaatgtgatgtgcaacagataagaaaaggaacttcaagggcattaggactactgtaaaatgtactaaagacatgcagatttagattgcattagatatgtaaattagatagtgaccgagcatcaataaattttgcaatctgattcttccaagtacagtgacaaaccttatctgtacgcccttccccccccccccccccccctttttttttctgaaagaacgaaaataaatctgtacattgtgaaaagtcaaaataaaagcagctgttactgaattttggtttttcccaaacgagacagaagcaagaaaagcagtaggccccattttccaatatgaactactgcccgcagaattatgcctttagtttccgtaaagctctacctttatctggaataaagggttcctgaattggcatacttggttatcttggattcatacttagttatcctgaattgacatactcggttatcttggattcctgaattgacagcactcatgtaagtactatatcagcatcacatcagcaatgattccgcgcgttggcttatgtaagcatgtgaatgaacatgccatggattgcaaacgtatcgttcaaatgagagatggaaccagatccacactaaccggcaacaacgcaatctcatgaaacagagatcgcaactccatgtagagcatttaccattcattcatgcagtaaacagttactactagtaaataacagttcagaggaatccaagaaaccacaagaatccaagaaaagcattcaggggagaagagaagagaaggccatccccaccttcttgctcggatccatgcgtcgcggctccgtgcgcaccggcaggtgcgtgcccgcgtcctccgacaccaacgcaatgtactcctcggggtcggactcggggccctcgtggacctcctcccacccgtcgccctccgcgtcctctcgccgggggtcgtggagatccttgacggtgtcttcaccggtggtggtcaaatggaaggaacaagaagacacgcggcgggagcggtggtgacggaaccagcgt

SEQ ID NO: 41505 - DNA, 4183 bp, Oryza sativa
ctaacctgtgcccggtagcatgggaaaccgttgtttttcttcttttttttttccctttccgtctgttttcataccctgctgcatggagtagtgtagtagcgttgcatgatgatgcgtatagcgattattctttaaacagcaagaataatactccttaagtcttaatatgatgttattgtttttttataatttattttaatttagtataaatatgtaaatgaattaaaattatacttttttatgataaaacaagtcacaacaaaataaataatttttttgaggaaacaataataaataactagcatggtggcccgtgcaaatttcgcggctagcatctttatattttctcatataatagcatatatgttttctcattatattattcaaatatattaaaataacaacataattttaaattttgcaataactttacaaaactactaatgtgtaatattcatattatattttatatacatgttagttattaattatttttaatatcaaattttagttatttgtaaattatatatattcctatatggactctagactcgtcttttaatatttctttttttttaattccgaatttcctgtaaattgtatttctatatagcctatatgctcttcttctaatattatttatttttatttctgaattttcatattatattttatatacgtgttagttattaattatttttaatatcaaattttagttatttgtcaattatatatattcctatatggactctagactcgtcttttaatatttttgttaatttcgaattttctgtaaattgtatttctatatagactctatgcttttcttccaatattatttatttttatttctgaatttttattacttctaattgtatttctatgtggactttaaactcatctttcaatattctttaatttttaatttcaaatttcagttacttctaaattgtattcctatatttgtaatcctatattgaccttaaactcttcttcccatgtttttcttaattttgaatttttgttatttataaattgtatttttatatggactctaaactctacttttaattttattatgtttattccaaattttagttagttttaaattcctatatgaactctatcctctacttctaatattccttatttttaattccgaatttcagttatttcctaattatatttctatatggactctagtctcctcttttagtatcccttattttttaattccgaatttcacttatttcctaattgtatttctatatggactctagtctcctcttctaatattccttattttttaatttcgaatttcaactatttctaaattgtatttctatatgactctaccttttctttttctccgattaatgtgagaatttctaggccatgagagcgaacgtggaggctcctttttctatttctttaataatataatagatatttatattttttaaagaaataaaataaatggttaaacgttatgcgaaaactcaacgacatattatattttgggatgaaaagatgacatactatcattagtcatgacattagtacctgattgttgcagtctgatagcttatttatcattaatcatggcaagtccggtttttctctactacctgatgttcatgacaagtccctgttggctgttgcaatcattgtagttgtgccagatgggataatatattagcagtttgctaatgacagagtagtgacgttgttttcatacatagagaaatccctagggaacatggcaccctgccggctcccttcgcaacttggtgacaccgaccgcacaagtttcagctgtcaccatctcttgggccgcatgttggcggagaaaggcagcccagccgtcttctagttgaaactaaaaggcccagcacaactcatcccgcacggtttcgctgatgaatcgttgcgggttgccgctttggacaccgcctaggcgcctactccacgcgccgtcggattcctgcccggaactagctcgatctcactcgttgtcgctggtgacttgtgccggcttggctaagatcaagtttagtagagccactcctagcttaaaatcatctataattaatttaatagccaatacatataatagttatatgcaaatatacaccacactattgatatataatttctcatgttatatacacattacgttttatgttttatatatgtatgtatatagttgatttatagtatactattgtataacctgctctgctcgatctcatctcggtgatcccatacttggcacgtacacgtgccctcttgatgacataaacaaagagcagacagcttgtgtgcgcttgtctaggtagaaaaaaagggatccgatcgatccgaagagcatggtgaaaagcacgctattaccagtaccaccactgttcgtttcgtttgttgggtttcggtcatcgccccacacatgtcgcgcatgcatggttgtcgccgcgacacgtgccggcgcgcgcacctccctctccgcaccttaactccttcgctctccgcccacttccccatcacgcgcgagcgctgccatcctctcctcctagctaggtcgatcgacgtcgagaatggcagatcggcagcagcagcacgcgcacggcgagggccggacggcggcgcagcgcctcgggtacgcgcccgcggcgtcggcggactcgccgtcgacgacgctgctccggcgggtgcagacgcacgcgccgaactccacccaggtggtcggcttcctcacgctggccgtctccggcgccgtcctcctgctcctgaccgggctcacgctcaccggcgccgtcgtggcgctcatcttcctggggccgatcgcgctgctcaccagccccatctgggtgcccgtcgccgtcgcgctcttcgtgctcgccgcggccgcgctctccgcctgcgccttcgtcgtcgtcgccgtcgccgccggcacgtggatgtaccgctacttcacggggaggcaccccgtcggcgccgaccgggtggactacgcgcgcagccggatcgccgacacggctagccacgtcaaggactacgcgcgcgagtacggcggctacctgcatagccgggccaaggatgccgcgccggcgcgtaagccgcccgcgcgcgccacatgtgtgtcggtgtgtggcatgcagcttagatgtgatcgttcttcttcggtgtgtttgtgttgtcgatttcctcacttcttctgtaggctactttaatttggtattttgatcttcttcttctctggatcgtacgtcactcgggttgtatttagtttggatcataagacgtcgcaccgggctgaattgatcttcgtcatttggcctgattcgatctcgcaatggtcgatcgcaattcctcccagctcgaggttacgctcaatgacgactctttgcgtgtgagatgtgacctagctagaaaagtccaaaattttatcgttttcgcaaagcaaaagatgtgaagaagcaaacggcacagcattaaacaagcaagaagttaaccaaacaatctgaattggaagcggttttgatatgttttttcagttgggactggaggcgagcggcgccacaaaccaaattctgcctcaccaaatgagctgagatcagcgtgcaacggcgcaaccagttccgtgcaacagtcgaagatgcattcagagatcagtgcgcccaccagttccagtcgagcagagggcatccgccatgccggcaacaacaccgaaccatcgcatcacgaaccgccgtgaagaccgaagaagaaacagggagacagggtagagataggagaggaggggatgacacgtggggcctattcttgtaaaacttttgtgatgactaggctgccgcgaggataccaagtactccgtaaatcaaaaccgccatctaacaatgaggtagttttgaacgattttaacaggggaacggctaatgggcgatcgatctgaacgatcgatccccatccctgtacactcctctccccgcttcctccctccccttctttttcttgctacaccataaatttttaaaaaaattaaaaaataaagttggaaaaatctatgtataaaaatattatatatataaaaaaaatttgaatttaaattcaaatttgaaacgggtatgtaaacttttgacttataaactttgggtctataaactttaagtgtgtaaactcttagatg

SEQ ID NO: 41506 - DNA, 18249 bp, Oryza sativa
cccccattggcagggcgatcgatcgcccattaggactgcccttcttctcttcctactacagtgcaccacacaatttttttttaaaaaataaaaggttagaaaaatttatgtatagaaatactatataaaaaaatttgaattcaaattcaaatttgaatcagttattttaacttttggcttataaaattcaaattcaaatttgaatcaggtatgtaaacttttgccttataaactttagatctataaactttaggtgtataaactttagatgcataaaaatattatatatagaaaatatttgaattcaaattcaaatttgaatcaaatataattcaaattcaaatttgaaacgggtatgtaaacttttgacttataaactttgggtctatatactttaggtgtataaactttagatgtatagaaatactatatataaaaaaatttttgaatcggatatataaacttttgactaataaactttgggtctctaaactttagatgtgtaaacttgaggtgtatggcaatgtttggctaatgggaaatagaaatgatttcccacccacaaaaatacatctttaaatcctaaccattcattctccatctttcatttaatcctaacccttcattcatttcccaattccaatcccaccctccatttcccattatccaaacacaccttataaactttaggtgcataaatttgctaagatagaaaagtaatgcggtgccaaaaaaggaaaccagttggagggagagagagggggaggggggaggagatctgatcgctacccgatgggtcgggcgatcgatcacccattagagcaggtacaataacgtgattaagctggctcaaattttctctcaccttcccaatcctagattaagctagcaaaattgaagagagagaaacgagcaggcgcttaacttggcgccgggcgctagcgcttcatccgacgccgtatcgctcgcatgcagcccacgaaggcttttaacgctcgcatgcaactcactacagctggtatattcctacacgtatttaatgcttctgtgctttaaccaaggcagcttatagccaacttatagctagcttgttgtatgagttggctcttaagttagctctacctcagttgacaaaattttggagatatctgctagctacactattgactttcgctgattgatagataaaaatcagatcaagggagtcttactagactttttccttgagaaaccagcaaaactaattcctcagtccaccacgctgcatccttttaagactcccgtggtagccagctatgggtcataaaacgctcaacaatgtccagctatgggtctgtaagcgggctctaaattaatgtggaatatgtaggtatgcacgaatccacttgggtgttaaataagggtcctcgaaaacggaacagtccattagcacgtgattaattaagtattagctgttttttaaataaattaatcaatatgatttaatatgattttttttaaataactttcgtacagaaactttaaaaaaacgcagcatttagtagtttgaaaggcgtgcgcgtggaaaacgagggagatgagttgggaaaattgtgataagaacacaacctaagtgggtaacccgtagtcctcatgtcgtgatttggcttgccacatttagggatacaagtgggtcaacccgtaaacttatttataggagcatctatccatttgtcgggtgattactaataacccgtaggataccaactaattttacttatatgtgggttcgcgggttggtccacttacatcccttggaatacggcccatctatcggcttgcgtgaagattatactatctccgtcccaaaaataagtgcaaccgtagaaatccgtgtccaacgtttgatcgtccgtcttatttgaaaaatttatgaattttttttaaaaaatagtcacacataaagtactattcatgttttatcatctaataacaataaaaatagtaatcataatttttttaaataagacaaacggtcaaatgttggagatgaatagtgcaaaacttcacttattttgggacggagggagtagtacacatgtcctccactctaaaataagttcattatttatccagcatctcacaagaaatagatcataatactcttagtttcttaaataatgtaattagtttcctctttatttatttttaatatatttatttttcatttttataaatctcaatacaataattacttagataaatttattttgggataaccggttaaacggttagagctaaaagtgaacttattagtgtacgtgattctcctgtgaacacgagcaccagtataaatgtgtttagttcacgttaaaattaaaagtttgattaaaattggaacgatgtgacggaaaagttagaagtttgtgtgtgtaggaagttttgatgtgatgaaaaagttgaaagtttgaagaaaaagttaataactaattaaaccagtccttcgaattaggtacgacagaatcagtggcgaattggcggcgttttacgctgcccgattggcctgggggttcgagtacaaatatgtacctgacaagtttacaataacgaaccacaagtccaaccgcgatcgcacgtacaatgcaaaacgcatgtaacccttgcacgcgtattaattagtgcattttgcttctttaaacaggaggcaccgccacgccacaaaaaggtgatataacctgacgaaaattccatcacggacgccgtgcgatggccgtggttccgtccaaacaccggagccccaaaacgtcaaaacctgcgtctgattgccatgacccggaagccttttaattttctgtactctcgtcggccaacgcagccagttagacccacgtcagcgccattcaagtccattcctccgtcaccatgtttgcacctgctagctgagattaacaaacgtgaaacgtgtacagtgtactcgagtctatggcaaatcgtgcacaattttttaaggtgagtgatgcatgcgtcgtcagttttaatttgagcatttgaaacacaagctgctgacctgatccctaaacctgaatactcaactctcaacttttcagtgaacagattattcggcgatgatgactcctggtatttgtctgaccacgtgcataatgcattagtaattcggaacgtcactaatactttgaccaccaattctagatgtcatccagttctgataatgcacgcgcgaaccatccaggtaatatcaaatgtgataacacaagacttttccaagtagtttcagctgaccattagtcacaaacaaagtgaaattaaacaagcaagagaatctttccatcgttcaaactaccactaattcaagctactgcgttctagtcttctagacgttcaacgtacaccacatccctttcccgttaacttgggccatgcagcgatgcagtagacggcgccgtgggcgagacaacgaccaccacgccacagcgcgaactcgcttacgtgcccttctccacgacgcgacgcgacacgagcgaacgaatccccacctcgtcgcgctcgtctcgttactgcgcgctcctactccccaccaaccacgcccccactcctctccgctgcataaaaaccaagcccgcctcgccgtttcaccaaccaaacccaaaaacccaaaccaaacgcgcgacgcctcagctttctcctgctcctcctgccactcaccaacccaacgcaaagcatcgcggccgcgaggtcgtcgacctcgtcgtcgtcgtcgatggaggtggaggcgttcccgatacggttcacgaggggaatacggtcgcactgggggaggcgcaagtaccagcggctggaggcggcgaacggcggcgggaagacgagggcgacgcagcagctgggcggcgcgcgccgcggcggtgcggggtgggggctgcggctgcggcggctgctccgcgtccgcgtgcgcgtggcgagggcgtggctgtcgtccccggcgcggctgctggcgcggatccgcgacgcgtacgtgggcggcatgctcgccgtgtcgaggaaggcgtcgggcatgtcgctgccgaacgcgcccgaggggctgtggcccaggcgcgtgccgcgccggaagcagctcccggcggcgcggccaggccagctcaccgacttcgagcagaggctcgtcgtcgagatatacaagtccatcgtcgcctccaaggagctcaccaccatgctccaccactccaccgcgcacctgccgcagcagcacaacacggcggcgccggcgtccagtggccagctgctagtcaattagcgtgctgtctgtatccaccatcgacatggaaactgaaccgcgagagctcctgcaagttcgtttgctcgatcgctgctcatgttgatgattattactactgctgtttcttccttgtaatttgtaagaagtattagttaggacaagatgatgatgtacacttcaatttctacctggtgcaaatcaccatgccgccgcgagtatgtttaatttcgtaaccaagaaatcgatcaagcaaagttcgtgcctccgcgcaccttgttcttgttcttcttgcatcttgtgtgcttgttacttaaacccaatcctcggccatctcagagggttgatcaccatagtggaaaaaaaagagagataatgtcactgtcattgtaaaccctaccagtatcactggtttcgtcgctgcagcctctgcggtcaaacttcaacacatcaaaaaatcatgtgttttgaaaaaaatgagacgtggaaattacagacgaaaattctctgtgaccaaaacatgctattggaaaattttggagcaaatgcttacctgttggctcatgatcttttttttttaatctaaagtttcttcaccgtcaacgcatgcacgtgggattcctcatgttctaatgttacaagtaaaatatggccgctcgcttgttcatctagaagctttaatcaagacttgactcaactgaggctagacaattattctatcatgcgtcacgcagttcgtcaggcctttgtttatttgatcggtgcagttcgttaggctggtttgcctccatccgtttttcaatagattagctgaagatgctaatcgaaacgtcaggtctacctagagcaacatagattgattcttttgtcctgtcaggcgaggcaatctgctttcaccatacggtcagcctctaatttgtcgttcctccaactattgctcacggaattactgctaaaatcttacttcctccctcccaaaatataagcatatgtggactctgacacggtctccgagatattactttgaccaataatacatataaaagtaagatgttttaaataaagagagttacatattatgataatctgtttaatgataagtctaataacatcaattttatacgattgatcttttttttttttgctattaatagtcaaagttgaaaatgtttgacttgtcactatgctaaaaatacttatattttgggacggagggagtagtgtaaaatcacagcgttttaaacgggtggcacataaattttgcagcattttggttgcaatgccctgaataataccctaaggttataagtttaaattttcacagatgcgaatttcagattgagttatttgcggggctaaattctcaatttaaatggctgcatatatccgctttgatgtaaaggctaggtaacaaatacttttctataaaaaaaacgaatttggcagcattttgacacaaatccttagctttggaggtctggtctagtcatagaagaacatggctacatttgctacggcccatttgtcttctgtcatgggccctgataattgagaaacaaagccgagtctgaattccaacccgtccaatttacccacaaggcgaatttttttcatttttcattttaattttttaatatttacataaatattataccatctaaaatatttacacaaatagcccctgccgcccaagtggagagaggcaaggtgtgcgtattttgcatttaggtcccttgccgcactctacaaggctgaagggggtaaatgcaatttttgctctgccaaaaatgcatttttctattttttttcaacttgtccgtccctcaagtcaccctgccgccctcccagggtctacttctgtaaatatttttaccggtacaatatttctgtaaatattaaaaaataaaaatttaaaaatgaaaaaaaaatccccacaaggctacgacgtcaagtagtcaacactggctgctatcgcctatcggggaccattaacgtggaagaaagaaggaagtgagctcatcggtcaatccccatcaaagctgggagctcaagctgccttgctgggacagtgtcacagtgaacacgatgggcggcgaggcggcgcagctcacaccggccaggatcgacttctccggcgtggacccggcggcgccggggaccgggcggtgggcggaggtgcgcgccgaggtgatgggcgcgctcaccacccacggctggttcgacgcgcactacccgcagctcacgccggagctccgcgccggcctgttcgacgccgccgtccggccgctcttcgcgctccccgtcgacgccaagcgccgcaactaccacggccccgagaagcccttccacggctacctcggcggcctcccgggcctcgactcctacgagagcctcgccatcgttgacggcctcaagcccgagagcgtccgcgccttcgccgacctcgtgttgcccccggcgccaacgacgacgacggcttctggtaataatcaaaccaatatatccccatcccattctcctcaaatcttgatttaatttggtcgatttgctctgcgacgacacacacacagcgagatcgtcaatggcgcggcgaagcgcatcgcggatctggaggggatggtgcggcggatgatcctggaagggctcggcgtggcggagcaccacgaggcgcagggcgagtccttctggcacctgttccggatgtccgagtacagggcgcccaattccgacgagaaggtgaccgggtacatcgcccatcagggggggaattgcatatgtaccattgcaaaagaatgacttcactagaatgctatccttaaaacagtttcagtaaaataccacgttcaacgaagacggcttcgccgaaatgccatcctggatgatattacccttggctccacttcttcctcctccatgagccggaggagctcaccggcgacgactatgtgccatggccaacactagctgtagcattggagaggagatgcagccacgacggtaaaccacgatggtcagcagccaattcattgaggacaagcagagccaattcgtccttctcaaccagcaagcaaacaagcagaacaagcagcctcaaacagccacaggtcaaccacgacgccatcgacggctccgccgcctcgtcgtccatcacggcaatttttcgctgtcttccacagtggctccaagtctgggtccccgcatcaccagctactaccgctcgccgccgtctcattgtcctccatcgtcaattgcagcgctgcccttccgtcgtggtcatcagctgccgctcatcctcacccgccagcaccagatctggtagcatgcctcgacggtgatggcagcggtggtcgttgtcatcgcgcccgcggctggcgagagcacgtggtgggcgtgcatgcacaacgcgactgcgcacggcctcgtctcctccgcttcccgagtccgaccttgccccgagccggagtcgcctcctcctcgcgcgcagcgcacggccggtgccaagcaggttttggaccgagggcggacggacgcgggcacggaacttgctccctccactagcatatgtacctgctgctgcaataggcgggtgccatggccgccggtgagctacaggaagatggaagaggtgccgaagggtggaagaagatgcccaagggcaaattagtccagtagggcattcgggcgaagccatcttcgttgaacgtggtattttaccgaagcctgttttaaggatggtattctagcgaatccattcttttgcaatggtacatatgcaattttctccccatcaggacaccaactggctcagcatcgtgtgccagaacgaggtgaatgggaacgagatgcagaccagggacggcgagtgggtcctcgtcgagccgtcgccgacgtcgctcatcgtcaacgtcggcaatgccctccgggtaagcatcagtgtaaattctaccatgtgacactgataatgctgtacaaaaaaaaagtttgtttccccatcattttggatcgaggatttggtggattggcggtcacagatagtagctaagtgagacgatgttgtggatatcgaatgtgtaagcaacattcttagtccgtagttaatgttgcttacacattgttagcccggcgaagaatgtgtaagcaatattaattatggactaattgaattcctgaaattcagcaaaatgactagagcaaacattctgaaaaaaaaacattgtaaaacaccgtagtagatgtcaattggcccgttcctaacaaattacagaatgtgactcttctgctgctagctgcaacctttttgagtttcaggcatttcatgtttgatagacaagaaatgtagggatagtttgtacgagtattcatatacacacttcaacactcacctgataattgatgcttgtccttaattgttcaagagaagcaaatcgcacacttaattttcgaattttcgcaatcttcaggcatggacaaacgaccgtctgcacgcgccatttcatcggataatggtgagcgggcatgccacgaggtacacctgcatgctcttctcctcccccaatttcatgatccaggtacctaacgagctcgtcgacgagtgccaccctccccgtttcaagacgcatgacaacgacgatttcattcgcttctgcgtttctgaagaaggagctcgccacgaggataaactcaaggccttctgtggcttatagcctataggcaacatcagaatctgcagctggttgatccccaataaggtgcactatcaaacaaagtaaccctggacatcttgcacaggccaaataggatatcggttttgtgctgcgttttgtacttcgggaagagttcattaccgtggcgtgctgtatgtgaactttgttcggctatacttgtacttcatcgtcaggtcaaacaaacaccttgcttccccaaccatcttgcagcatagcagcagccttgtgatgaacatgaccacagcattgtctatttcgtccaacacctggctggcatgtccaatgaggcccatcatatatagaagtatagatcgatcaactagctctggctgctgacaaaaacaaccccaagtcgcagtacctgaaataaaggggagttgggattttgtccccttttattactcattttgatatatttttatctttacatttttttcaataaacttgtacttgtgtgtcttatgacataaagccagatatataatctattttcattatctaaaaagtcgtagtacctgacagcagggttaactggtttgtaaagccgatcggtattaactggttttcgtacaacgttgattgaaagttgtcagtttttaccgactttcagtttttacttaaaaaacgaaaaaggtaaaccctgcctggcagcgcgcctgcctgcccagaaccagaaggcggtcaccggcgcgaccatgaccgtgccggagcgagttatccggcttggcctgacgctcttctcctggagcaagcaacgcgcggtaagcctcgccgcccggcagaacaactgtccagggtccacccatcacaatactcatcgaaaattcacaaggcaccaaatctccgaagtttacgcattgccagtatcacaagctttgtccgcagaaagcaacgaaaaatactcccattgcaatgcatttatacacaggtacaggcataaagtagaaagtagaaacagaatggcatcaggcaccgaagcttcacatcatcttcagtagtgtagcactgaagagtgaagacatctgaacaaatgtcataagacgcaggatgcaaataacaacaaagtgcatacttaactatccatcatagacagcaagatcttaagtccttgtctgccttagttaaagacgacagacaaatcaccaggcagcacacacaccaggcaatgcagtcatacactgacaggcttcaattcaagttcatcaaatcaaaagtatataattcattacatgaatgagcatagacaaaatggcaccaatgcttcaattcaagttcaccaaaaagtataattcattacttcaactgctcataaaacattacaactgaagaatgaagatgcctgaacagtgaaccctcaccatacaagtgttccaacacatcaatcaaattgcaaataacagccttcaggcactttcatagcgtacaagtgttccatacataattcagatatccaaataacagccttacttacatgagtccaacaatttgtcacccggtttgcttaaaacgaaacaaggaaacaagatcataataacctatataacaatatgaaccataggacaaataacccccaatgtaataactcacatatctgaccacaacttaatagctataactctctagtattcacatttcgcctgtgtgctaattgtataattcagttctcatttgctttgtgcaactaaatagtataccttatttacggcctcttctttttttccccctcttttcatgtcattatcaaagagagaggagattaggagggagtgagagagtggcgatcggtgatggactgacacgtatgatcaatggccgaaggagaagcggtcggcgggggtgatggagtggcggaagtggcagcggtggccgtaggggcagacgccgccggcgagcaccatgcggcagacctgggtcttgtagcgagggtggcggatgacggggcggagctccgcgacgccgtgggcgaactggcactggtcgccgtaggggcaagccccggtctcctcccacttgttgcacagctccgtcttgaacatgccctggttgtacacctcgaactccagcccacccatgggcggctcctccttcttcacaccaactttgtgctcgcctccctccgcgccgtcaatgcccacgaacacgcgctgctgcttgcattgtcgcatcaagaacatcgtactagttaggattgggattttggattcagcacaggagtcagtgcgctgcaagagtgggagccagacacaacacaatggaggaattgggggatttggtctcaccgagccgacgttcaccggcttcgacacgcgatgcttgccgccctggttcagcttctggtatccggtcgaacggatggagatgctcttcggaagaacagcctgcttctcggggacggcgacgggattcatcagtgcggccggcggagactgcggcggaggaggaagagctggcacggtctgctccttggggaggcggaggcggcggaggtcaccggcgagggcgatggcggagctctgccttccgccgaacttggcgatgcggcatgcgaggtcgttgttggcgacgcggagctcggcgttctcctgacggagcgcggccgcctcgtccgcggcatcggcgaggtgggagaggcagagctcgaagcggttggccatctcctggtactggagcgcgaggtgggcgaggtggaggcggtgctcggtcgctgccgctgcccccgcaccatctccgtcgtcgacgacggagtcggaggaggacgagcagtgggagaacgaggcggcgcgccgcggcggcggcggcgagagcacgcgggtagggctgaagggggagtagcagccgtagaagagatctccaccgttggtcagcaggttgggcgaggagagccgttgatctccgctgccgaacggcttcgggccaaagtccgagtagaagcggcctggatgagccggaggtagaagagcttcctgcatagcggcgatctccgcgaacaactaatccctgcaagtaaacggatcaaaatgtcaatgaaaattccaacaaaaatcacactaaattctccacacgaagcgaaccaaaataaaaaaaaagtagagatgctttccacagaatctagctctgagaacaggaaaatcgtatcatggaagcaatcaaaaatcgcattcgaagacgcgatctcatccactgtaacagtgagaacaagtaatcaactagtttctaaatcgagaaccagactgattccacaccaaaaaacgggacaaaaacgctaagaaaaaacggaaccggacgcctgatcgcgaagaaaacgctgaatccacgaacaaaaactagtttctcaccaatgcagcacgagaaacagcaagcttaaaaaataaaaaagcaaaatcgatcaaactcgcatcccaagtggagcagaacagcacgcccaacccccaactatccactgattaactaactagtggcgcaagcgcaactaaatcaccaagcggttaaccccaagtgtagattggatcaagcagcacacctctcgattagcgctcaccacccggagcctttgattttgagaaggatgatttgggggagaaggggatagggagaggaggaggagggtgtcgtggggctcgcggctctgcctctgaatctctctggcaatctgaagaatgcaagtgctctgcacctgcgcatatataggccgccattccgtgcggtggattcggtggggccggtacgcagtacacacgctccgcgaaatggaagtacgtactgtgttgtacgagaaatggatcgcgcgcggcgaactgtttcttgccgcgcgtgggcgtggcggacgacggtgtttgggatttgggaattgggcgctgtgaccgcgggtgtttttgcacccctctcatcccgctacgcgtacgcgcacaccagcgaatacacctcttaacacacgctcaaatagagatgaaggccaacagtacttgttaatatcctattgaaaacacacccatcggcttgtgtattatatttatgagtaaattttactttcagtcacttttattatcggtatgtctatctgaatcactctttaaccaatatttttgttttagatcggataatcttatctttgttgtattttggaccaccctaactttcttatatatgaacaatctcagctatacttactcttacccgtcaatgaattcccaacctattttcttgacatatgagatgtagatcaatagatggataatataaaggatgtaagagtggtccaaagtgtcacaaagttacgattattggttaaaaggtgatctaatatgaaacaccagtaataaaagatgactcaaagtaagattcactctatattttggatatatcctagtgggtgaagttctgtacccaagatttcacctcagcatcgttggtgctttccattattcctaactattttcagtacgttaatgcaatatatcattattacaaggtccatggtcaattctcaacttgaaaaaaaataaacaagcagcatgcctaacatattcttaactcgatgcttcataacaaacaaatcgtcgagggtccactctgcaaacaaataatccaggtagctgagctactagcaaaatatatcccttgcacgttagacacacgacacacaacaacggtatgctaatatgctactcctatctagtgcggttcttgatgcaagggatcattacaaagcttcgcttgcttgctttgcttttacgggtccgtccctctctcggactccgattgatcaagcgagctaaccaacgccgtctcgggaaagatagttaaccaacacatgtacagaaaaaagaattaagccgtcaccttcccttttaacgttgcttccttgatacagctttaactaacttgccccacccatctcaagccatgccatgccatgcacacgtacgaacgaactacacacatcaccaaccccgacctccagctgctaaaaaaatactggggatttttttttttttggctcctgctgcctcgcgatatgatctcccgtggccgcgacgcccaaacgaattcgtgaggctttttaggtgcgtcgtctctgctttcgtttggcggcgacggcaaccgggatcaggtcggctagcttacacacatgtgctcggcgatccaaatcaatcagattagttatggacttgtttgttggtacgtgcgggtgaagacatgcacgcacgcgatggcgagcgcactgatgtgcaggttggacctgaaattaattcaaggggatatgcattagtatttcttttcaatgttattttgtttttcaagttccctggattggtagtgtactattgtccctctgctcaaattaagcatggttatttggacatcgatttcgtgccgaagatttcaaatcatgcacttgaaacgggtaattatgtgccggtacgatgtacggatatgtccatgagaaacttgttggagctgaaccatcattgtagcgagcttacaggctttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcgttttacatccttcggtggttttcacccggttttattcgacgtggcgggtgagtcagcatgggacccatgtgggtcccacatgtcaggacgccacgtcatcaggctctctcttccccctcctctcccttcctctctctctctcactcatctccctaggcaggctggtcggcagaaatctttacaaaaatagaccctgcggccctccatttaggcggcaagctgacgtggcacacggcgtcgtgacgtgccgtgtgcgcattttgagcttagacccttggggctaaatgtaatttttttccatgctaaaaaaacaattgactagttctttttgcatctgggctccttgccgcccttgcgaattttgcacggaggctccttgccgcccagacagagggcggcaagggggccacgtgtcgtagccccccaaaacgaccgtcctgcaccgtgtgccacgtcagcttttcgctgatataatatttttgtaaatattaaaaaataaatctaaaaatgaaaaaaatcagtgttcaacagctactctgaaacagagccaaatatttcctgtagtgccaaatatttcctgcatccttcgtacggcccacagctaaatatattttctccactacaaaatgttggtacctagaatgaaatttagacaacgaatctggataaacttttatccagattcgttgtcgaatctgtacataatttctatccaggttagttgttctagtatggattaaatctcattttatattacaacattttaagacgatggtaccttcagaatagacaaaatgccaggtaaaacctcaataatataaaactcgaaaatgtaaatgaagtctgctctgccttgtgaggctacgctgttcagggaagcaggaaccaagtcaagcatggactgtaacatatccatcgtggcatccaaaaagcatgaatgaacaggacaatctgcagagtgcagttatcaaagatacagggtatctcaactccccaacgttgagatgcattgcaactctgcaagttcagtaaaatttaaaagaagcttagcatgaagatttattatcacatattggcagaaaaggtgtcaactgtaaggccttagttgtatttctgcataatctgacctttaaggctgtcataaatagaacagtatctcagtgccttataattaatggagagtcataagataatcaccctcacaatccatgcacgtaaactcggttcatacaagtgaaactctcatccatcagaaatgtctaaaactattatcccatttacaagtggtcctatttattattattattattattattattattattattattattattattattattattattattattattattattattattattattattattattattagtagtagtagtgattgttctttcgtgtaaacaccatatagtatgaagactaggttaatgtaccacatgagtaaataccaaccttagtactgttccgtgagtctttttaccgggtttaaccgttgagagagtcgttatacccaattttttttacgattgaggcgaacgatgatcgtacagagtcaaactagactttatttaaagcttttatcgatcgtagtaggccagggcaaaatcacttctctatcattgcccagctcttgatccgcaagtacgttcggcccaattcctagcaactttgattgtttaggcccatatttcttgcaggatactggatttcgctctcggtctatcccgtcttcgtcttcacgcgcggggactcggggaggctcaaaatttgccgttgcgaagtgtccctccttgtcgccggcgccggcataggcgaacaccatatttgtcttgagacccagactgtgcctgtgacgtcgttgcgttgaggacaagaaaacaacatgggccatgtcctgatcgatcgatccagaaataagttcactttaggttccttactttgatggtgtttgaatcttctgaagatgaagattaagcgttaaacgaggtagaaataacgtttgaataattaagttttaattattataaacttgaaaaatggattaatctgatattttagaacaactttcctatagaaagtttttacacgaaacgcaccatttagcagtttgaaaagcgtgccactttgatccaaaatttaatccactatttttagtggattcgaacagggcctttatcaacgagtatgaaatttatccctaaaccaaaataccaaatataacgagtcttccaattcacaaaaccgaatcactcgaggttctagacagtattatgggcatgttcactttgatgcaaaaaaaaaaaccttaccaaattttggcattgtcaaaattttggcaagatttcttatacagttaccaaaatttggtagcaaactaaatgtagtcacttttttgataattttaccaaaatttggtaaggttgaaaatggcatcaaagtgaacaggccctatgtctggttttaattgacatggcaagctgagtctgcgtgggatccacacgggccccacatgttaattgaaacactttcttccacctctcacttctctcccctcccttcctcatcctcaccgcggatcttctcaccggcttcttcccagccacacccctcccctcctaggtggtcgtgcggccgtgtgccgctgttgccctcaaaaccattgtcccacctacgtcggtgataaaatagtagagagaaacggagagagggaggagaggatgggtcactaatgtgtagggttcgccaaatgctattttttttatttagactgaattgccctgacacgtggatctcacactgactcagcttgttacgtcagctaaaaccggatataatactacctaagacctcgggtgatccaattttacaaattgaggaacccgttatatctaatattgcggttcatggacgaatttcggatttgccgataaattaagggacctaaagtgaacttattccatcgatcgagcatgagcagcaaggaaggccctggccggctgctcctcgttgggccttgttcttcttcgaaggtctctccaatccaacccgtgtcagctccttccctcccattcgaatgcgcctgcaagtgccagctatataacacaccaccttcttcttccttccgctccatctccgccttgctcccaatccctcctcttcctcgtcctcttcctcctcctcttgcagtgcgagctctcccaccgccccatcccctatccatggcgaccaaagcggcgctccgatcgttgtggtcggccttcgacaagcaagcgtcatccatcattgacaagctcgtgtggccttggctgatgccagcggacgataccgaggagggcgcgaagaggcgcgcggaggagattactgaggagctcgcgcagctggagaagaccaggatgacgacgtgggcgcgatcggtggtggagagcttcgacacggcgcctcctcctttccctccgccgctgagcgctactacgcctcatcctcctcctccgtcgcctgcgaccagcagcagcaggacggcgacggcgacggcgacggcgacgccgacctcaccgacaccgacacc

SEQ ID NO: 41507 - DNA, 3607 bp, Oryza sativa
  unsure (1)..(3607): unsure at all n locations
tttagggggagtggcaccaacttaaaaggggaggggtcccttacctcatgagctagcttttggggtgtagaaaggctttctcccggttgggccaacgtctaccggttttgggccaacaagtggtatcagagctcaggtgccatgtctggagatggtgtgtacacgccgccaccgccgccaccgatccgtcgcagcagcggtggcggtggcagcagcagcggcaatggagatggtgtgtacacgccgccaccgatccgtcgcggcagcggtggcggtggcagcagcagcggcaacggcggggatggcagcctaggcggccatgagctcgtcgtgcagcaagtgaaggaggcgggggtgacgttacgctaccccatgctcggggagaacaactacggcgtttgggcggtgaaaatgaaaatttttatgcgtgcacaaggtgtgtgggctgccgtggagggcaacgcagccgatgagaagatggatcaaatggctctcgccgccattgtccaagctgtgcctgaggccatggtgatggccatatccgagaaggaaacggcgagggaggcgtgggacgccctcaagcagatgaacatgggtgaagagcgtgtcaagaaggcccgagtacaaactctcaagagagtgcttcatggtatgtacatgggtaatagtgagaaaattaatgattttgctttgaaggttaccacgatcgtgaacgagattcattctctcggcacgaaagtggaggagaccaccgtcgtggagaagctcttgcattccgttcccgacaagttccaatccctcataagcaccatcgagcagtggggggatgtgtcggagatgacggtgacggagacaattagacgtttgcgggcgttcgaggagtcctccaaggggcgacgtcgtgaaaacgcaggggaggagcagctgcttattgcaggggctgagcaacggctcacacgcactgagtgggaggccattgttgctaaagagaagaagagtgatgaggcctctggcaatggtgagaagaagttccgcggcaagttcaacaaatcgaagattgagtgccgcaggtgtggcaagttcggacacttcgctgacgagtgtgatgagccgcggaagatggccaaggcagtgacgcagcttgtcatcgcggacgcggatgatgagccaacgttgctgtgaaaccggttgtggaggtggagaataaaatccaacaagattagagggtgattgttagagttaatcttgttgtttatgttttcattatattcagtcatgtatacgtagtggtctgagtccaaattagctagtgtgttgcgtggcatggtgagctgatcagccgttagtgaaagcacaaagtggtgcagcactacactggccaaggtcacctgtgacgggcccaaaccctcatctttgacgacttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttggggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcgatcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacatttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggcctcaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatagcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactcctcgaccttccccttgccgcgttcacgcttctggcccttgacaagtggtggggagctatcggcctttcttgtggtctttattggagcnnnnnnnnnnnnnnnnnnnnnnnnnnnnnnnnnnnnnnnnnnnnnnnnnnnnnnnnnnnnnnnnnnnnnn

SEQ ID NO: 41508 - DNA, 3313 bp, Oryza sativa
aaaattttacatatcatagatagaaacaacacttcaagattcccataggctccaccaatcgattgcaaggaaaacaaagtcctggtggaaagggatgggtcggaagaagagctaaggtgaaggagaaggtggctgaagtggttggctttatgggagggtgctgagagttatacatggatgcactttatttccgggggaatgacccgttagtgaaatggttcaatattttctttcttcaataaattctcctaaatctgggaggtgatagatatcgtttggttggtttggattaatattatttacttgttttataatgacaattttaagttgaacaatcaatgcctaaaggtgaaccacatgcaagtatgtttatgtgaatgccattattcttcagtgaaataaaagtgtgggttattttttagtagaatggtagtaattactgacttattaatatgtaatttgtttggttagtacccaaacctagccaagccaaaattttagaaatgcaaaaaaaatatagtcatgtgtgatttgtagcaaagaatttggccatgcaaagcaagtgaatatctagccaactttttggtagcaaagcaagtaaatgtctagccaacttttgtaaaaaatggcaagtgaatatctagccaatttttggttaaaaaaattcaatggtcaattattgccatttccaacaaattggaaaggcggaatggttatgaaacaaacatgccctaattgtgcctagaaatagaggataaaacgaacaagctcttaaacggctttcccgggccacgcgtggaaaacccaaaggttaatgggccgcaccaaacctatgtcacactttcacgctgtgatagatcgcgattagcgacctgccgctaggggtggaaaaaaagctcaggctcgtgagctcagctcgggcttggctcgagcttggttggcttggctcggctcgtaagccaaacgagccaagcccaagcctccttttcagctcattgctgaaatgagccaagccgagctagctcgcgagccgcttgttttggctcgcgagcctaagccattatgtgtttatatcgattattttattttatatggcgttattatttgtcaacttcaaatttaccattaagattttgaaggcttgaatatataaagttaatttaattttacatgttaataatttgttcttgttttttttaataattacaaaatatatatgaagaggtatttcaacaggaaggcttgcaagccagctcgagctggctcgagccaagaaacgagccgagccgagctcaagttttagcttgttttcctaaccaagccgagccaagccaagccaagtttgttgcgagccactacaagccgagccgagctaggcttggctcggctcgtttccaccactacctgccactgagccaatccttgcgacgacacgcatcccgtgacatctcctccgccgccgacccacgagtcactcaccaacgagacttttgtggttggcgatttgccgtcgtctcaaactccaaatctccaatgcggtgggacaacttagcaaacataacataggataggctgtgtttagtgggtacacctaatgggtgggtgatcgctccctcctctccccccttcctcctcccctttttctcttcctactacaccataaatatttaaatttaaattcagaattgaaacgggtatgtgaacttttgacttataaactttgggtcaataaactaatatttgaattcaaattcaaatttgaatcgggtaggtaaacttttgacttataaactttgggtctacaaactttaggtgtataaactttagatgtatagaaatactatatataaaaaatatttgaattcaaatttaaatttgaatcggatataattcaaattcaaatttgaatcgggtatgtaaacttttgacttataaactctgggtctataaactttagggtataaactttagatgtatctaaatactatatataaaaaatatttgaattcaaattcaaatttgaatcgtatatatttcaaattcaaatttgaattgggtatataaacttttgatttataaactttgggtctataaattttagatgtataaattttaaacgtatagaaatactatatatatcaaaaatatttgaattcaaatttaaatttaaatcggatatataaacttttgatttataaactttgggtctctaaactttagatgtgtaaacttgaggtgtacaaactttaagtgcataaatttactaaaataggaaagtaatgcggtgccaaaaaaggaaactaggtggagggagggaattgaatcggatcgcccctagcactcaatcgctaggtagcattcccggtgtttagttcgtgtgctaatttttttttgaagtatacagacacacatttgaagtattaaacgtagactaataacaaaacaaattacaggttccgcatgtaaactgcaagacgaatttattaagcctaattaatccgtcattagcaaatatttaccgtaccatcacattgtcaaatcatggcgtaattaggctcaaaaggttcgtctcgcgatttacatgcaaactgtgcaattgatttttttttccttccacatttactgctctatgcatgtgtccaaacatttgatgtgacggaaaagttgaaagtttgaagaaaaaattttgaatctaaacacggccatacatgtaaaaactgggatgtattatctctttgtattgactgcaaaattttagaatatatcatagaaacagtgtatgattctgtcatcaaaagaaaggaaattttacaggatcggtgattgtcccatcgaggaaaagacgaggaactaaccagtcagttagacagttgtttgctgtcaaaacacaaaactgaagggggaaaaatttacagtacaacagaggttaccaaaacaacttgtggtattattagttgtagactctttatcatggttaagaccgtcctgatctgggattctcgtcttctggggaagggcatctatacacatgctgttgtactaactccgatcgattctgtgaccttgacgggaatcatcaggttttcagttgagcaaccttttctgagacctcatcagctgtttcgtccatgctctctgtaagggaatcctcctgctgagaaatagactatcttatgtcaaaattttattttaaatcttacgtaaataaaaaattagatagactagaacatatattgtttccttcctcgacaacaggaaccgtcctgacatgtgtggtgcaggaatgagatactacacttacatctctgtcttg

SEQ ID NO: 41509 - DNA, 32233 bp, Oryza sativa
tgttcacctttaggcactgattttttacttaaaaacttcattataaaatgagtaaataatattaatccaagccaaacaagatatatctatcacctcccaagtttaggagaattaattgaagaatgaaaatagtgaaccataacgtcaacggataatttcttacctagaaataaagtgcatccacgtataactctcagcaccctcccataaaaccaacccctccagccaccttctccttcaccaatgcgcctagccgtcttccttagctcctctttggactcatccgtttccaccagatccccacgttccttgcaatcgattgatggagcctatgggaatcctgaagtgcccttccagcttgaagctctccgttgctgttcctggtcatgccctcaaccccttctctggtaagttcataatgcaaccaaacacgcgcaaaacattaatttcattttatcgccatgccaccaaaattgttgtatgggtgaatttttgcatgtgtatatgcagatggcggtagtggtagtggtagtggtagtggtagtgggtgcaacaacaataacacaagagaactgggtatccacttggacttggaccgcccgtatgcaagagaagagctaccgcagcaaggtggcagcatggaggtgcagaaaggggaggagagaggcggtgttaggcacaatagctccaaccataggcggctttctagggtgcaatccaagcaacttgatgaattttatcgtgtaaatcacacagttgattccgtaagcatgtttcttttttcaatatttaaaatcaccacagcctttcgagttattagttcattaatatttgaaatatagtagattaggaattagatctatatgtgaagaatggatttagaaaccattagatcaagcaagttaaactttatcactagtattttgtacaaccatatgcatgtgcttgaatttttcatcgaatatttgttttgatagatcacacgttactacacactagtcaccaatatatgtaaagcagaggttattattgtgaatattataaatattaaaaaataataatacaccaaatattggttatttgaattttgttaatatatatattttttttcaaagttctaagtattttttatttatagttcaaaagaaattagttgcaatatgatatataaggtccatcctaaataagaaatcttatgttattttccattttcttaagttgagaatttaagtttctattcagtattgtattaatctttactcgtataaaaggactccaatggatagccatatataaccattgtaacttttagatattaagctatgaactttctaatattagataacaactaatcggatagccatatataaaattaaatcaagatgagtcttctctatatgaaaatgtgaataacataagtcttctctacacgaaaatgtgaataacataagtcctatctatatgagaatgtgaataacatatttcatgaaaaatatgcttttatttattttagaaaataatatggtattttttttccttttacctatagcaaagcatgggtatttagctagtttaacagagattcagaattgataagcatcaaactgcatatgttaagagatttcaattgtagatttttcacgatttaaaataattcaagactttataaataacttatatcaacttatactttgttttgagtctctatatatcatttttatgattagaattatgaaattagaaattgataaggaagatgtttatcaatttatagccccaattatatcttttcagtaatctaataagaaattagaattaagcaatattgaatcgtacatggtttgggagcctcgattataacttatacatgattctactcagtttttgagagttatagctttttcatgatttaataattttaaaagttcacagttaattaatatcgagttgtgttcgctttggagtcttaattatagcgtgcttttccataagtttgattgactgccatgataattcaatccaccccacccaatcaccatttttttcctagttaagatcaaagctctctcaaagtctccaattaaaacaagtatagacagatttagttaacttcttattttgcaatacaaggatacaactggtgtttgtctttgtattgctacaatgctatactagagttcatgatgcttgcttgtactgaactaaacacaggtcgagcagttcgtacttgccttgaccgttttttttttttcaaataattagtagctcgattgttcattgtcaatggagaccagtcacttacgctctaggaaattaatggaacattttcagaaacaaaagaaggagttggcagatcgactgaatcttcggataagtcaggtggatgcttggttccgcaaccgcaggttaaggtaattagaagttttttcaatgctctcactaattagaatgttcagtcatactcattctttcttacatatatgcgtaattctagttctggttttctcttgttctgaaggttaagcttatatcacctttaacaaaaagagagataaatctctttgtttttctttaacgtgataaatctagattgagccgtgcaatggtctagacttccattctaaactctgaaccttttattttaaaaactcatgtctgaaccattgcacagctctacgccgtgtaatccttagatcctctaccataatgttactatctttacagtcattattatgtgggtctcacctttctattaccccacatgtcggtgtctgtagaggatgtgaacccaatgattccagtaagaaagcccttactagttttcacaaacagcagtacaaatcagttagcagtgtagaacaagttcagagttcatcatccgccccagtgactgttatgctattactagtaatacctttcagattaatcttcacaaacctacagtaagtgtgatgttgctactacctgctcaggtcgaagcagaaatccacggagatggagtgcgcctatctgaaggaatgcttcaacaaactgaaagaggagaaccaccgcctccagctccaggttgagcagctcaggtcaacgagcttgcagctgcagctgcagctgcaactccacagcgagcgagtcgccacagctcccactggacagcaagccggcacttctgcggctgctcgcatcttcactttgcctttgtccggatacaacccttccagggggacttggttctcgccaaatgcacactgatcatgtgctcatgccaagaacacaagagggatgctacaagattcgtcgctgtcatgatcaactgataaaaaaaacctgataagtcacagccatcttgtaggacattgatgaagaatgagcttgggaagattagcgtcgatgggaattggatactgtttacctttttttttttcaccgggccggcgtggccaagaatttagtgctttatttcttttgaaacctgtcgttcttcgtcgttgatcatgagggctgactattgctagatcagcttcagtttagcctgtcattgtttttgctttgaacaatcattagccagtcatgtttttgttttatctctctcttgaccgacagattttgtggttctgcttgcctcggaaaagaacaaacatttttggttaatctctgaacaactgaacgttcagtactacgagtcaacttttatatactctgctggagtatctatactttctataaagttataacccactatctctaaagcttaacatgcaaccatgccacatcatcacccactaacaataattacatattcaacctcatgcaagcatgaaagagcatctgcaatctatttaattctacaaattaacatgcaaagcatattcaatcaccacctctcacatcatttccccaatagttttacaaatctctttatcatttttatattatttaatatatacttatcaacatgttctacattaaagtgcgaatatcatttgtttcatggtaaatattgataagccctaagatttgattatttttttttctttttactcctagctgaattgtaacgaaaaaataatattgaaaattacttagtaattcccgaagcaaagcgcggggaatccctagttacaaaaatcctctgttgagagtcgagactacaaatggccaaaaaaaaaaaaaggtctgcaaggatcgaatcagaagaacacggaaagagatatgtgcagtgaacaactaaaacattgattcagctcagtcaaaaaaaaaacattgattcagctgttgttttcgcttaagttattccattggtccagcagtcggcaacaatcagatggtaagctcttcaaatctaccgctctcagccaaggagttccattgagcaatgctaagttagcagctgcaactgcacgaacagttcacacatgatcagaaatgatttacagtcatctaagaaaaaagtgaattacaatttgtttagactaatcaagcgtaagcgtaggtacatacgttagaacatgtgtcgtccatccacggttctgcaccatccggatctttgccatgtgtaagattttgtactaccgttcctgatcagttcatagtagcccaagaataatatagtagaccaaggtgatggggagagctattagcatgccaaatatgaccctgaaagcgatgaaaatgttgatacattcagaatcttgaaggcttgaacagtttgcagtcatgtaatacttgcaattttcagggtaactctgctgacttacaaagtgcaaaggatggtagcgtggaggttgtattccttagcgaacacaaatggcacaattccttgtggcagggcggcctaacaaacattcagtgcattcgtaatcagcgtcttgatttggctcaccgtttaaacccaaccaaaaatacaaggcagtttcagagatcatcgagacatcgactcacctgaacaatggcgatacgcaagagcgtgcctcggatgccgacggcggcggacgcggcggccatgatggcggggccgaagaagaagcggacgcccatgctggccgccgcgacggagtagccgcaggcgatgatcttcggctgcgtggccatgaacaatcctgaacggaaggttcagtttagagatctgcacttctctgaaccaaatacagtactagaacagatggtgatggaactgaactcacctaagctaaacatggccatgcctaaccctgcatcggagagaatggagattgatttggctactatgattggcatcgtgatgtggaacctgcaccaatgcgaaattgcccattacagcatcaacgctgaactgacaaacaatcagaaattctgaatccaatttccagcgaactgatcgaccaggtgagcttgctttaccggaacgcgatgagcgaccaggtgaggccgatgaggctggcgtacgtgttggggttccggatcagccggcgccaaaccgtagtgaggatgagccgcagcatcacgccggccggcgcgttctgctgccctctcgcccgctccgcgcccgctgcgccgccgcccttcgtcgtcgtagtcaccgccgtcgtctgctgctccgtcttggcgccggcctccagcttcgctagctcgtcctgcccgcccacggccttgttgaagctcgccgcgcgctccccgcccgtcgctcccggcggcggtcggataactgaggaacataatgtaaggtgtttgttggattgatcaagaggaggttggagactgacctctcgacgaggcaatggatggcgcgtcggaggggacaagccggcgcgtctcccggccgctgcggaacaccggcaggccggtgacctccgacgcggcggaagcgccggagctccactcgatcatgtgcgtgtccttgaggtcattggtgggagccacggtcgcggatgctctggcccgcgccgccgcgtgctcgtcgaagctggacggcctcggggtgtgctgcctcgacgaagagtgcagcgagaagaggtccgcggcgccgaagctggacgcgcgcagcgcgctgttgggcggctggtgaccagggatgtcggcgagggtgaaggtggagcccctcggggtggcgttccgcgacgagctgatcgagtagatctccacgccggtcaggttcgacgcgcgcggcgtggcggcggcggcggcggaccgcctcgacaccgacgagcggcacacgaccatgcgcagcctcccgtcgggcgccacctcggcgtgcgcctccgcctggctgccctcgagcgacaccacgtccgggtcgacgtgcacggcggcgatggacgccgcggtgtccgggaactgcgccgcgatgagcacccgcgcggcgcggaactcgaagaggaagagcaggagcgtgtaccagacgatggactggagcacgacgatctggaccatgaggtcgccggagtaagggccgtacatggagacgaggagcgggatccccatgacgagcgtgttggggagggtggagacggagaagagcgtgatggagcagtcgaacggcggccacgccggggggacgaagcgcgcggggaagcgcgaccacgcggcgagcgcggcgaggacgagcaccttctgcagggtgtcggcggcgacgaagcggaggttcatggcgtaggggtcgctggaggagatgaagtggaaggagaggagcgggacggcgatgacggcgacgaagcggttgatgccggagcactgctccggcgtgaggacgccccaccaccgcacggagccgtacgccaccatcatcgccacgtacagcggcaccaccgccgacagcaccatgtacagctcgtgccacgatatcatggcggcggcggccgatcgccggtctgggagcagctgatcgatctgtttcctgcgatgcgatcgagaggagcagcgtgcgattagtgtgttgctgttacatgcagagagtgagtattgcggcgcgcgatgccgcgatgggatataaaagtacgctgtcccgggctcccggcctcctgcgcgctttgactggttctcttcgaggtatgtccgtatgtgacacaaattttgctctggtggagaactccacggagcaactgaacctcgtggcactgcttcaaaaaaaaaaaaaaactcgtggcacagatatggctacgtagccaaatctagtaatctcgaaataagtttatttttttattcttttttgtctttaaataatttgtttttagcaattattatatcgaagtttataaaagtatgacataattaattgtattgtatgtagatgaagaaattaataattatattgaaatttgataaattagatgtattataggtttttattagtacgtgcgagatagatgaaaatgaaatttattttaaggctgtgtttagtttacacttaagtttggaagttaagttaaaattggtacgatgtgatagaaaagttacgtgtgtataaaaaatttgatgtgatgaaaagttgaaagtttgaaaaaaaaaactttgaaactaaacagggccttagacggagggattggcagtagacacggctagtgtacacattttgcaatgaatttttccgaagaaaaaccactgtagatgtgtcagtccagtcgtctgtagatggtctagtggccgttatgtgtgctgtcacgtcaggccggcggggtgcacctcgaaatgccgtgcaattttggatggactcatggcatgcgaggcattgtcagtgtggctggtacagcccgtgcagatgcagctgatccgatggcctcgcaggctggcaggctcttttcaggcagcagtgcagcaccggcctagtatgcagtctccaaatcccacgaggccgcaagaaggcagcccgcaaactcggcccatacaaatgctgaactagttatcggcccaagagcagtaaaacgcttctttcagcgcttccggcccaggagcctcaaatcacacctcagactcgaacatgaattgggtcgcgctaccaactgcgctttgctctacacttactcctatcaaagcaagaccctcactttggcatcgcagatttgcggcgtcacatggctgccgcggcttggcttctctccgttgtgtcgcacacgaagagtgccgctccgtactttctacttgcagtagaaatcaatctgatccgtagatctagttatatccaaaggctcagatctttttatactccacctcaatttatagtactagaagtgtggagggtcattattgtccaaagaaaaataagcgctcatgggtaaaatagtactttcatccttttcttttaaccctacccccctctacgttgccggccgctcgccctcccctcgatcaaccggcgtcgcgccgccgcctcgcttccgccgccaccgccactgcctctgccgcttcacttctcgtctggacgacgccggcctcctcccccaatcgcagccgccgccgctcgcttctcctctggagtctggacaaactcctcgttcccacgtgtccccatcgttccccgtccctgctgcctcctctcgtccccgatcccagtccccagaggcgtcaatcggaaggagctcgagggcggcgccgactccgcgtgcaagacctgcacgatccaccagcgcccaagcttcgtcctctcagtctcctgcgccgttcgtccttccgtccccgccatcgctgcctcaggtcatccctgccgtggccgagcggcggtggttgggcaaaatggtggcagatccgcgactagatgccggtgaggaggttgcggatcagccttctttcatcccatcacacaggaggtaacgacgtaacgtcctgttctttcatttactctcatgcagatcagtttttgccccattccgtgttgaatggtgtggttgaatgttttgttctcaattatcagaaattagaggcaaaccagatgcaaagcgaggtccaaggagtgcaaagcaaggtccaaaggagtgctgtcccatattacctttgtgcgttctttgatgttggcttgaaatctgggataaagttgtaatctttgtacataagttgggaccttgaattatattgtgcaattttagaagtcatgattttatctgacttcaaccgtgctttacatgcttgctcatgccttctttgatgtttggctcgaaattgggataaaattgtactttataagtcaaggggcatccggctgggcagagacagataaccatggagcgggaatcaaacaaacacaattttccatactgaagatttttcacataaattgcaaattatactttaatttagttataccataacaattgataagtcaaggggcaccagcagcatcgacagttcacgatgaacagcaacatagctgaagccatcatcaataataaagaccaccgccaataaatctgacaccctattattttactgaggactcagagagagacgttaattagtgccagtcaggggctctgggctaccggcggaactacaagggcatatgaatcggagaaaaagaaatcgcgtcaaaacatgatatatagatcgaaaaaggattaatagatggaaaaaaaaactacagtggaacgcgttgaaaaaaagaaatctcgtgaaaacatgataatatatggaaacgggataatagatcggcctaagatgtggtggccgcgtcgtgcctgatgcaatcaagccaaaattacccctaatcagtccctgccaaaattatccttaatatgtattagaagattactaatctacccttcaaaataaacggtcaagattaattctagttgtagtataatactacaagtaaattgcaccggagcattggtcgcacacgaaaggaaatctcgcaaagcaatttaacgggacgagtagacgagcgaggcgagaccgcgagagcaacgggacgagacggagagagacctcctcatcagacactcgcatcgcggcccaggcagcggctgtgcacggctgctctttatcgaggaccgtgaaaagggggcgaaagctgtatgtatctaggagtagcgtagtggaggcgattggcgatgataatacaatgatggggttcatcccaaagtatacaatctacgactagtacaccgtagtctacgtactggagtactagtatactactacaactaccaggagcaaaaacagcagaaaatttctgagggggtgtttagatggggctaaaactttttagcccatgtcacatcggatgtttggacgctaatttagagtattaaatatggactaataaaaaaactaatttcataaatgagagctaatccgcaagacggattttttaagcctaattaatccataattatcaaaagtttactgtagcatcacattgtcaaaatcatagcgtaattagactcaaaagattcgtcacgcgaattagtctaagcttatagaatatgttttataattagtgtatatttaatactctaaattagtgtccaaacatccgatgtgacagggacttaagaataagtccctggaaaccaaacagccactcagagctggggtctgtacgtgttgccgtgttgtaagcaaaattgttgctttccggcgtttccgcattgatttgcagctgccgccgctgcttctgcggatctactggcaccggtgcagatggctggagtagcctgtactagggtgttggggatagctgtagagaaatgcatgggaggcaaggctctgcaatctgtgccatcggttgcctcgggatgacaaataaaatgcgactagccattgcgtgcctagcctacctcctcccctctcgtcttccccacaagcccacaagagagggaccgcatctcatctcatgtccttgctcgtttttcagactttcaatcactgcatactccaacctcaatctactccttcactagtgtcattcactcactgattactgctttgcaaaaacactttgattagtagcagtactgctagtactagtgttgtacacttgtactgtgctcctttgcctttgcattccggagtgaaatgttaaagtgttcaccaaggtttctcgtgaattttttccaccgttttcttgcattcgtttcagttttgactacgcacatctgctagtaggagtagtagtacggaagtaactagccctacactgactaatgtgtcggtgacttcatgatccacaatccacatcatatcatttgatggaactgaaattaatctaagtactctcgagagagacagcatcaaagattcaagaacatgacaccacgccagtgtggtctggatcctcgatgcctctggtcgggtgctaattaatcactgcggaaataaaaacctgaagcatgtctgttccatccctttttcatcaccgtctttgggcgtggtttagttctcaaatttttcttcaaactttcaatttttccatcacattaaaaattctgtacacacgtaaactttcaacttttccgtcacattgttacaatttcaattaaacttttaattttgacgtgaactaaacacacccttgatagagtgacaaatagtaaattctcccattgcattacacagctgaatggagtatgccagcatctcgtttgcagtttgcttcggtctcgtttagttccaaacttccttcaaacttttaacttttccatcacatcaaaacttttctacacacataaacttctaattttttcgttacatcgttcaaatttcaaccaaacttctaattcattgtttttctcaacatcctagtgaccttaattcaggcctttggcacgatgactgtgcaccggtattgctgaatagatgtacttccgtccgattgtatattccgtattgctatattttggatggagtatcgtaccaaaagaaaactctagtacagggcccacagtaaagcatttgcgagtcttttgagagaggggaaaaaaaactagaaaactgtcattctgctgtgtttagaattcgtcattggttccataccatttgtttagtttttttctccaaatttgtagttacatacaaatgttagccttttgattaaaaaaaagagaaagaaatgagagtcgtgtaaattttggtgttgttggtagaaaagaacggtaaaccaacacttagcctatgctcagttaaacaacgatggataagctgaagccagatgaactaagtaatcaagaataatttacgaataaaacgtttatatcttaaaatccaaaggcaagaaaatagcgcgccaattaactaacacacacgtatttgatcacccccacaccattttataatacggatcataccagaataattttattttattttttatttgatgtggcataatttaggtcttcttttttttttctcgcacattagatgccacacatgattcttcctgcactctaaacgtcatggcaaaggacaaaaactactgggaaagaaaattaaagagtttctttattgattattacaataaacgcagtaatgtaccactattctaccacttgcatttagaaaccacaccagagagtacttgatttgccagagcactaatccttcatctatagagtcattacagtctgacagcagcatgactctcttatcaccacgagtccatgacctaacactatgcataatcaacactaaaccaccatgaacattcatctaaagtctaaacagcaacttcctaatccatttccagtgatgatgagatgacatgggcaaagaacaaggaacagagagagaaaaaaaaatcagacatggctccgttaaacccggaggaggtagacactgagctcaggaccgccactgttgctgttgctgctggtgcttgtgctgtccgggttcatcatgtagaatgcctccgagtcgcgcgagcccaccacccgctcgaaccgcgcgcgcatgtacatgacgtcgccctcgccgccgccgcagctggcggcgggtatgacgccggcgcccatggacaccggctccagcgcgcgcagcacgcgccagtcggcggcgccgcactcgcggcgcaccgcgtagccgcagctcttgccgttgcagtacgcgcgccacaccgtctcctcgagcagcctcttcccgccgcccgtcgcggtgggcagggcgggggcggggccgcccttggcgcgctcgcactcgagcgcgatgcgcacaaggcccgaggccatctcgcgcaccagcgcggcggtgggcgcggcgagctccagcagcagcgccgggcacgcgcgcgggtcgagctggaacgcgaggtgcacgtggccgcgccggtggccgtagagcgtgccggtgagccgcgcgccgaggccgacctgccggtgccgccccgtcacggccgccgccagcgccgagcgcaggcgcgacacggccgtgcggaccttcctacgctgcggcggatgctgctgctgaggatgctgctgccgcggcggcttcttgggaggagaaacgaagtcctcagaatggaaactcggacagacagaggagaacgccattgtcgcctcatcctcctcctcttcagcttccgagctcttcatgtaatcctcctcccctctcgtggcgccatggctgtagctcttgccaagaaccggccacttgaaatgcctcctagagaaggagagggaatcatgggggtttcttgctgtgatggttctcatagcttgagttagccaagcctagcttcttagcagcaagcaaagcaaagcaaagaggcaaagagcacactgctccttcactgagctagcgttgtgcttgtgcagctgggttgtgtgagaagaggttgtattcagaaaatgtgtgtgcagctgaactgtgcttgtatatgtgtgtagtatgctttacttctagtgttatctgtccctgcagaagcaggcttttgtagtgaaggagtggctggtgagcagaacacaccaaaaccgagcgaacaaaaagaagagagagagctagcgatggagagtgtgctgctggggttgggttcttgtgaactttctctttgtttttttctaatgaggaaatggtaggcaggaatgcaggctgcggcggtgggacaaggctagagagatttatggcagataagataattgagaactgagaagagagtgacaggagagaaggcgtacctggttttgatggtttggcttttatcagtggtggggaactggggattaattagtgtgctagtgattatctgagtggatgatgatgcactgatgaggttgcagtgaagtgtagtaattatatttcgatgttatggttaacagacgaattgggtatgatctctgaaaaacagagaacaggttagaaaaagctacctaacaatcatgattcttaatgtatatgatactttggaaatggccattagttcccaacaaacttagacgacatgagtgcagcaccgcaccacatttgcattccctgtgatgtcaacggcttctgcaattggattgggctccgttcctaatcagcaatctttcaatactcgtcatgaatgacatatagctcaaaactataattaggaatctttcatcttttctttgcacaagctgaaatgatacaacccacaagtaagattcttccttaaaatacacaaaacacatggacatgcagctttgtctaaccgtactgcctcaagcaacgaacacgatcacaaagctacaagtaaactcgaatgccgaatggtagtatagtacattgatattcatcagagaatgttaaatgtaccaaccatttcagagtttcagagttctttttcttaagccctgtttagatcctccaaaatggcaaaagttttgccattttgaagtactttttgccattttggatctaaacactagtaacaaaacttggcaatttggcaattggcatttgctagtccatagtagcaaattgtgccaaaaagtgctttgggaccgctccctctttctttctctctctcactttagtgctagaatggaaaaagtttaggatgcatctaaataccaactagtacttttgcaataccaaaacttttgccatttgccatttgttatttcaaatggatctaaacagggccttaatcttcagagaatgcacattttacctctctcacaaaccggttcattccgatcatgcaacacattgcttttctgtgtttggttctttctttcaaatcgatcgctgcacagatccaaactaaagcgcgaaggctgcagggttcagaggagaaagacgagaggaggcaaagaaaagaggagaggagaggctggctgctgaaccagcacagtttttgctttcctcgggatcggtggcaatgcaaagcggggcccaaaggggggtaaaatccaaagcgaaagctgcagctttgaccgcggagggggccgaccgaccggtgccgacggcgacggtgcgtggcgacggaagcagcgccctgcagcgccggagtggccgggtccaggtgacgacgcgacacaccgtactagcgacctcatcgtcgtcgtcgtcgtccccggctagtgccagtgctacaacatgctaccgctaggagagagagagagacacacacacaggccacagctactctacatctgtctcctctcgagcttagtactgttgctggtctggtcttatggcctctgcctctcttgagaagatcaaatcacgcttaaattcacctcttctccttcgttcctagctgtagcatgttgctgttcctgtggtctccacagcagggtttctcaaatcgccggggctagggttaccgcaccccagcggtaagcacggttaccgcgcgataaccgtaaaaaccatgcaaaattcatcaaaaattcaaattattttttaagtttatttgaatttaagaaggttatcgtggtttttctactaccgtatcctgggataagaccggtaaccgtgctggtaatgtaaaccctgctccacagctcgcaggcgcagctcagggctcaggagagacgagggagggggaaaggaattttcaacgtgttccaaaggcatgttcattgttcaaacctagtttgtccggttcagcattaacaaatcttctgaagcgcagcttaattgtgcatgcacatttagcaacaggtcaatgtggcctggaacctatccgtatgcagccctatcacaagtagatactatcacattaggatgcaagatcaataataagatgcccgtgagcaccaaagctaaacgaagaaatttatttgactgcacggcagatcaaatacgttaaacaacttctgtgaaaaaaaggtaaacaactgatacctcttcagaagggactaattcggtgtgccagctttatttgccactcagaaaccagccggcctgggataggtgccaatgcatccttctcacgtgcatctgcatcatcagcatggataacagaaataacgtcttcaaccagtttgtccctgccaccccttagtggatcctacaacggaacgatatgttagggttccccagcaaatttgtgcacagagggccatcctgaatcctggtgtaactattccagccttcatattcaaaatgactaacctgtaaaaatacatcagtatgtgttttcccttcatagagtagtaacttggctttagcaccagcttgtttaaggacacccgcaaaagtttcactgcatatgtgatatacggagttaaagagttcttagcagcttgaacatacaacatgaatggattaacttgtatagaaagatggatcaaataacggtgtaacacctaggtagtgtttggttgcaaggatgggatggggcaaacccacttttaggggtgtttggtttagtggtgagtgaggggtaggtccatggagaggaatattcctcttagatccgggaccaagccatccagcaaaatcggtcggacgagcttgtcccacctgggacgagcgcacagcgtgagttgcgccacttcaccgcgcgtcgtgtgcatcgccgtcgggagcagctatagctggcggcgatggcgggctgtcaccacgcgccctgacctcctcctctgcctggaggccggtccaagccacgcaccccccccccccgacctcctcgccgcatccgcgctgccgaatcaggttgcctagaggtcgggggccaccggatctggcctccttgaggtcggggcttgccggaaccagccgcgcctccgacctcgtcgccgtggaccgatgcctctagctccggccaccacgtccacatcgtcattgtctccgatgtcgcgccgctcctccttccgcccgcgccgccgatcaccgctccttcctctgcaagctgcgagctgcgagaccttttctcgctgggagtaacgtggtgcaaacgctgttcatcacatccctaccccatcccttctaccaaacaaaaaattgggatcattccatcctataaaccaaacaagcaagtaggatcactccatccctaaaatcagggattgtgtcatcccatcccacatagtcccaaaaccaaacacgcgcctacagaatgtagaagcatataaaaatagaagtgagaaattaataagtaataggcagtgtttgcctacaataatatgtccagaaagacagcttgtatggaacttgacgttttaatttgacgcatatatcttgtaaaagagaggaaccccaaaacaacataacagaaaagataatcaaacctagtagagaattattaattcccctggaaataaaatataattatacctagcagaaaatggtatagaataatcatccgttccatgcaaaagcacaatctgaggaagaagagctattgtttcaggacataatttcttggcaacagtttctggagagaaatgtggcaatgatttctttccctccattatgctgaaaaggcatttcataagttcctgagttttgtatagttctaattaagaattaaggaaagtagaagcaacacttccatatcaaaagtacagttacactgttacctgagaaatattgaacggtaaagaccacgttcatggaaatgatcaaccaaattttcaatgttgtatctgcaaacagcaatttgagcaatgagaatatatgtcatgtaaacatagaatcactagctctgattatttagtatctcattacacattctgttgcatccaaatgccaaagtgagactgcagaagttggttcaaaattctaaaaggcaccatatgttttctcagctactaaaacacttcatgaggtacaaatctaaaacaagcactcaaaacaccaaatggtagatatctattgctttttagcaggactagccccagtttcacaacatcggagtttataagtcaatcatcatgtaaactaaacaattgccaaaatccgactttcttcacaatcaaaatcagactaacacaggagtagaatcaatagaagatcacttaaatgaacacataaagaaatcatgcgatgttgccatgatagcaggtttagtgttttatattagaccaaaacgtgcatggtatagaaaactaatcaagactcaggagaagcaattctttaataatgatgataaccatacagacatataatcaatcaaaattagatgataaagctatcccaccctccagacaaaccaaagtatgcttttatttgagtaacactccatgaaatctgctctcccctagattctttagccgcttgttccaaaagagcgcatgctgcgatatgtgctcctgctgattgacccattaagtatatcctgcaggatttaacacgatgaatggtaagtctttcactaaaatcatcagtaaaaaaatacaaagcaagaataatggaaaactacgaaattattaggatgcatgggaataatacagtcatcagttccagaaatgaatgtggttaagtctagatgcaagtataacatatactgtgcattttagctttccattcaataagacacatatttctatatcttacacaatttatgtcggaacagaagcatgcccagaaaaccttttaaaaaaacttctatgtgcttgtcctcattcaataaccaccagcatggacttcaaatataatcattcaaatcatgtacattgttcattcaagaaaaccgtttagaaaaacttcatgtatacatgaaactttttttcagtagtaactttattagggtgttgtgatttgataaagtatcacttactgattaggatctcctccataggcaccaacagtctcacaaacaaatgaaatcccatcagaagcatcgctaaccatgtcacttattgttccttgaggaaaattcctgcaaaacatatgcttttatatatcatcaagcaagcaaaaagaaatcgatcaatcagtaaattcttatcagtaaaaaaaaatctaccaaaaaagaattataagaatcatatatgaggaatccatgcaaagtatgagcacctgtaatcaatgcatgcaactataattcctcgctctgctaacctccttccaagaagagcaccccacgccttgtaactagatataactgaggtcatcaaaagggcaaatcatggcagaagacccttataatacatcatcagaagaattttactcacccaatgatccatgcaccaccagtaacaaatgcaacaactggactgggttttttggggtctcttggtatgtaaagatccaacctgtatagtgtgaaattgagtctctagcaaagtccaaaatcagattcttccgtttatatagcagatagtttctatacctatttcttggttgatccccatagatcacgctcctcaaaacttgtcttgaaaagaaataataatacccaactggcaatcaataaataataaattagttggtagatgtacaatcatggccatgctttcaattccgtaaaaagggaaccaagaagagctaatttgccagaacacttattggtacaatcataacattgactaaccatcatgttcaacatagaaatctgtaataaaaggtaaggtcaacgaggccaaaggtaaacatgattttcttttttttatctacctcttatgaaaccgggcataagtaaaattgcatatattatgagggcagcgagctgagaaatccaccggtagcctaccctggaaaaatagaaagaacatcagggacatctatacagcaaagatgaaaatatattgtatatgcatttggattttttttttttggagattttggtgggaagataacgcaatgtatattaggcgttttgaagcatgacttcacaagataataaaattcagttcatcagtgctagagttagcttgccatccaagtgaattagttgaaaatgcaaggtgctttgatgcaacaatctgttttaacaatggggatttcctaatttcttataggtcattattggtatgtccgtgaggaggagtgagaccaaagacgacgagggcgtgttgccgaatggcgatcggtacagtatcagattacgttacccgaggtatcggaggaggatgaaggcgaggcgcgtgacgaggtacgtctcggcggcggcatggctgacgtcctcccggaacgtggacctcctctcgccgcccccgcggctgccgggggcgagcggagagtcgggggagaagggcacggaacgccggcgcacgaggacctggggggcaccgcgtggaggtaccgcctccgccacggggcccgcgtcaccggagaccggactcgcgggctgcattgcggggcggacgacgacgacgatgctagctcctggtggcgagggatttggggttgccgcattggtggggtgggtggagatggagggggcgtggaggccattggaggggaggggagcggagacgccggagaggtcgcccaaattaggaggaggcggagcgcgcgcggcgcgacggcgagcggaggaggtggaattggaggaggccatggggacgcgtgcgtggccggcgaactcgtcaattcaagcgggctgttgttgggctgagaggccacggcccatcacgagatggcctgacgaggccactgtaagtagtgggccgggcaacgcgcaatggctcgacaatgtttcagcttcgcaagtggtacagtgagccgaacgatagataagttaatatattttttttaagaaacactacaactacacgcgcgcgtaacatgggtactctcgtctcgttcctataaactataagcatcttaaaaaaactagatcgatatatcttaaaattaatagagtcatcatagacgtctcgctgtcgatgtgtacgtatggatacttagtcataaacataagcagctgtatcaagtttagaacttaaaattggttgggttatttccaccataagtaacataaccagttgagatacacaacttcacaaattaatcaaaaattgtattatctccgttctaaaatataacaatttttatatatgtatatggacatatgcttgtcttttttaagggaaaaccagcatgagagtgtgccttttaattaaatatagcgggagaaaaatacacccctaagagcaaagaaaaggcaagtgcccaaaaaaacaggggggctgctatataacggaatcccattttcgaacgggatgatcccgagtaggtatcaggtgtgatacctatcaggtatcagacgattctacacaacaggatgatcccgagtaggtatcaggtgtgatacctatcaggtatcaaacaattctacacacgtttcaggtgatacctacaagtatcatgtgatacttatcaggtatcatgcgattttctaccacgtatcgcgtgatactcgcaaggtatcatgtgaaacctgtcaggtatcaaatgatttcaaccacgtatcgtgtgatacttacgaggtatcatgcgatgtctgtcatgtatcagacgatttctaccacgtatcgtgtgatactcgcgaggtatcaaacgatttctaccatgtatcacgtgatacttgtgaggtatcggatgatacctaccaggtattaggtgattccctactagatatagctgggcatcccgtttggggaggagcaacccgacacgcgcggtcgccccctgcagccatcccttgtagacgaggacggcgacggcggcggcagaggacgggcgcggtgacggcggcggtagcgggggacgggcgcggcggcggtgggggatgggcgcggcggcgacgtgtcacgccccgaactagtcctgagcggaactagcccgtgacgctccaaattaacctgttaaccgataccagtcccaggaaacagtgctagtatcacaggaagacagaatatcacagcaacagaggtctctttattatagagtaggagtacagtcatgttgggctgcggacagatctcgagctcacaactgcattacaaaagggaacggaagccagacttggaccaaacatcacaagcgcgacttgggaactaggccgaaaccctaaaactcatcgtagccggcttgctcctggaagaactcctcgtcagcgggatccgcttcatctttttcagcaactgggggggattatttatatagagcaagggtgagtactttcgtactcagcaagccagggaaacttaggtggttaatgcaggcttcaagggaaggctgttgtttttgcaattgattttatttgagctcttttctgaaacaactaagggagtgcttctcaaacgacacgggtgagacagtgcgtctcgtccggtcggagtatgtgcaatgtatcagtcttttgaattgattaagattggctcccggccaacagcttttaaacggcctcccggacctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacccacacgacattactaacccggatcatccagttcgtgcagaatggccacgactagagaccttaaggctttcatgacaaggcatttcgaaagccgacacaggttcgccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggcgaccatcgatacccgtgcagagtgcacgattaccgaggcgcgactaggtgggtacaagggagcatggtataacaattacaatgggagggtcaaatacaacaaattaggtaggtctgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccaaaactacacgcgaaacggaacaactcagcaaacggtgaaaataaagccctattattgacctctaagcgtgccattagatagatctcgagatttgaggaattttggaagttgaacggagtcaaacggacttacggttgggaagatattgaatttctaagattattggattttggtctaaaggaaaagggtttatttaaatcctttttgaaaaagaaaagaaaagaaaataaggagggagggaaattagactttcctcgggcggctagggcacggcccgagagaaaggggcggctcggccgagcttaatgggccggccggcccaagaaggtggcccaaagcgcgcgcgcgggcggggaggggagagagagggccggtgggccgtgtccatcccgcgtggtcccgagtgggacccgcttgtcggcgactcggctcaccgtgagcgaggtgcacgcggggcgtgctagggtttggggagggaggcgcggcgcatgcgcgcggttcgcggaggacgcggtgcggtgggcccacgcgcagcctcacggctcgcggtggaccgcgcgcgcgagggggcagagggaagcggcggaccggggtctgcttgacccggtcgcggccaaggtggcgccgacgtggcgcctacgtggctgccacgcgggtcggcgggaggtagacgacgacgccggccggaacggacggcggacgacagcggcgagcggcggagcgaaccacggcgatacaggcgaaagcgagcacaccgggaagttgcacaggacgaggggagacgagccaacggctcggattcgccgggggatgctcgacggcggtggattgcggtggcggcaaccggcggcgggagaagggggaaacggcgatggcgcgacgggagaccgattcgggtgagctagagcatctacgcgactccgggagtccgttgctagcgtcggattgggcggagctacgccgagcgaggccggcgacgagcgggtgctacggagcacgggcggcgacggcggcaacggtcggggcggcgccagctagctacggggaggctactcgtgctactacccgagtctaaggggaggagatggaacgaggagggagaacggagggaggcactaccgtgcgggggtgatggggcgcagtgacgagaggccgacggcgcgggagtgatctctccggcctcgggccggggaagaggaagaagacgagtgcccggagtccccttccgcgtccacgaatgcaccggctctcccggtgcttggcgatgaacggcggaggcgagacagaggggcggcaatggcgcggtggcggcaagcgaaacgggaggaggaatcgatgggagggcgccttggtttataggacgacgatgtcggtttggaaaccgaccttgggcggtcaaggcgcgagctggcgctcggagctcgcggccaaaacggcgacagaggcggaggatgacgccggcgggaggaaaaagggaaaaagagggagagaaaaggggggcttgcccccttgccactttggggaaaaggaggagggagagagggcgatgcggcagagggggggaagctctgcctccatcccttggaagcacgcgcgaggaggggcggggccaaggcgatgacgacgacgatgacggccgggcgatttggagcggggcgacgacacgggcggcaggcgcggcaggcgctgacggcggcggcgactggccggtcggccaccatggcgcgcgcgcgcgggaagcaacgggcggcgcggcggttctggcgacgtcggcgggaaacgacagcgagggcggagggcgctcggctcggcgcggctcacgcgcacgcgtgcgcagcgcacgggcagagcgagagagagagagagagccggggagggaggggaagatgggccgagagggattcggcccatcgaacccgagggaggcgaaatagacttttgcggagggatttgatttgggaaggatttggattcgggattgaactcaacgatagatcggggatttgagatctgagatggcacagacactagacaacaagcaaataaacggatttcgcaaatagggtttttaagagatagttttcccgctaggcgccacgacggaacgggcgctacatgacggcggcggcgtcgacgggggatgggcgcgacggcggcggcggcggaggcgacgggggacgggcgccgcagcggcgggggacggtggcggcggcgagtgagtgtttggataagaatcgcgttgcgaagaggagctatcccgttgggggacggtatcccgttgggggacggtatcccgtcccctagcattcccgaaaaaacaatacactatacaaggtgtggtataagctcacgcaggcctgccaaagcccacacactgccttcttcctttattttcacgagaagatacgacgttatggtctccttgtgctaaaaatatccatcggtttcactcctaccatattttccaaatgataaggaggatcaacgtatgcaattccttcttagggttgccagtcgttgtggctagtttcttccaccggttttaaacaactaaacggtctcttggtgtcgaggctcaagctactggtaacccacccaagcagttataaggctctaaattcttttagcgtactgcacttggtgataccgataaggtgtaaggccgcttcatcccctctctagtgaagagggtatcatctattgttctggcagttcctggtcgtaagtctatcagagatccatatcatacagtaagaaattattatattttgagaaagagcgagtacacatttaggtgtatggtcgtagctcgccacgctagaacaacatttatcctaaaaatgggagaagaatcatcagctagctaggtgacgcgaagtgtttatatttggtcgcggcaaggcaacggcatccgccgccgtgggcgggctggcttaatttgcgccgttgcgcgtgcgcgtacgtgtaatccgtcgtgagtgcgcccatctcgaacggttgacacctagcctggcgagtgcccccgcgcacggcacggcgcgacaaaaaccgaggtgatatgcatggcgacgaaggctgtcacgggctggaaattgcgatgcgcgcgcggcgcgtcggcgaggccggtgcgcgcatcgaccgagttgctagcatcagcagcacaaaaggcggatcgcgacttcgcgatcgagctagcatgcgtgtaccctatccatttctcgatgagatcgacaaaacataatgcaattaacctgcgcacgtacacgcaacaccagctgatcaaaatttgtttcagatttacaaatggtgaaacgtacgaacaagatggtgaagaaattaattcatcaaaatttgtacacatttaggcgttacacatggtcatagctacgctagaaaaacttagtcgttgtgtcctaaaaatggaagaagaatcaacagctaagctagagacgcgggcaaggttggttgcgtggttaggtcggtcaggcgacgccgaggaagtcaagcgcggacttggccatgacggcggcgaactccttgaagctgatgaccccgtcgccgtcggtgtcggcgtcgcgcatcatccgcgtgagctcctcgaaggtgagcggctggccgaggcgcgccatggagcgggcgagctcggcggcggagatgaagccgttgccgtcgcggtcgaacgcccggaacacctcgagcagctgcgcctggtccaccaggtgcgtctgcgtggtgagcaccggcgcgatcgccgccgccagctcgtcgaactccaccgacccgttgccgttggcgtccatcccggcgagcagcgcgtgcacctcgtcgcccgtggggcgcagccccagcgaccgcagcagcgccgccagctccagctgcgtcaggctgccgtcgccgttcatgtcgaaccgccggaacagctcccggagctgcttcagctggctcccccgcagctgctgcggagccggtgctgcttctgacctcctcgccgccattgttgtcatatctcgatgtacgtgtgttttcttttctcttgtggatctgtgacctctcgcggtggtggttgtggtggaggagacgagagggaggcgactttttatttatcgaggggaagacgcgttggagagttgggactgactgggtcggtgcgtgcatgcatggaaggaggcaaatgccggggtgggtgcgcataaaaaacggaggatttgtgggttttttccctttgtgttttcggttgcacctgtgaggttagctgcagccggtactgcgaggatttttaccgtacgtgttcagttacaagtgagatctatgcgcgttaaattggttacgtcttcacccgccctgcacactgtagaatctagtaatagttttgcatcaacacaccacatgtaccggtgttctcgttgtaaaaatcatccatgcatacagtacgcacctttgataaaatgttgcgtgatctgtatatgtggcattgaatttggactgaacccaatgcattgtttgtgttatggaatattatcttctggaatataagatctattttgttttttaccaatccaaatcgtaatagagacaaatctcctcctatgacccatatttatagaggcagggtaaaacatataagattgacctgtactgacatatcagatctatgataaagagagagtttgtaatgtccttgagatcaaagagaatgacgcatgtgttttatatctctcatgtcttaatactgcgggagggatagggaatggtgatctgctaatagacatgttagtttataacagtttgtacccatcatatcctgatatccatataccgcgtccgcgtgacaagttgacagccctgaacttgaagacttgtaacgccattcgtcttttgactacctttgtagtaggaaggatgatccacactccacaggaagtcaaagatttccggtcagttgttacactgtctaactatctgcaccagctccagctacaactaggctacattagctaggaagatgcgaggaatctatcactcccatgcccaaaggttgcttgtatgattgtgtccaaaatgataaagttagcagcagagcaagatgtactcatacagaatcttacagctgccctgtaacataaacaattgtgggtaatcactaatcagctatcacacaccgtaccaggagggtttggtgatgtataatgttggcagtatttcacaaaatgattgcatcaggctgtgatggcttgatgttcacaagcccctttctctcttttttttttttgattctgtcaggtcaacttactggtgggtgggttgcattctgtcaatggcaagacagtttcatgtacagtactgttttgaatactcttcacttcctacatgtcatagcaactatcatggggagcatatcagataccgaaaatagtttttttttctaaatgtagtttacttaaatcttttaagcctgcaggtggaaaaaaagccatagaaatacatgacaaacaaagaagaaaaaagagcgaagcaagccaaaacaggtcaatcatcatatctttttgggggtctcttcattgctactactcgtcgatactggtgaaatatttacatcagggaacatcaaacatggatgaacgagccgagctggttcttcattgataaacagaagggatgaacagggaatttacatcagagggctacacaaaccaaaggtcttaagcatgctagctccataaccagtttgcttacgtaccttaaaacaaatgtaatcgaattacacgagatgtagccgtcaatctgcagatacaactccagcgtgctccatccgtcacggacccctgtactgcctgaagcatgaaaggcatccttgtcgctgatctacagggatcatgcctccacccttcgaagtatcgatcgcctccaacatagacaccacctcggccatctcaggtcgcttgtcagggttcgcatcccagcagcgtttcatcacgtttgccagagaacttggacagcagcgtggcatctcaggccttaaattctaatcaaacaaggattgtagcacacattaaatcaaatcagcagctagacagaaagcagaaaataagccagctagaaaagagggttttacctgacgaacaacagcagacgtgacctctgagaagctcaaatctggatatggcatatcacagcagtatatctcccataaacaaatcccaaagctataaacatcgcatttcctgttgtatggactgccgttgagaacctgcatatcacatgccaatataaggcatataacatgcaaggtagtaacttacatacacaataaatatcaaatacccttcctaggcccgaggtacacacaactgtttgatgcaaaaaaaattgacattttttcttaattaattatgtgctgcaattagacaagtagtggcaaagaggaaatgaagaaactgaggaaaaaacaatgagcagtccatgtcaaagatcggatacctcaggagccatgtaaccaagggtgcctgtttcccctgtcatatcactgggatttgaagcctcaagccgagcaacaccaaaatcagcaattttcacagttcttgtcttgtcaagaagcatattttcagtctttacatcacggtgcacgatcttctttgagtgaagataacttaacctattgaatagttaaatgtcaaaactattccaatcaattagagcttttttttttgagggacaatcaattagagttttgaaggataaagagtgagtgaaatagttaaaagccccagaagaaaaactggcaaatgatcaaattgatgcttaccccctggcaaggtcaagagctatctgaaccacaactttaaaagctaacttctttctcctattctttatcagaaatccttttagtgaacccccagcaaggtactccacaacaacacagcagatattacttggcatggcaagatgtccgctttctgtttgaatatctagatccctggcgcccattatagcccctataaactgtatatagaatttcaacctgttgttagggtacatgacaaatagatagacaacagaagaaatatgaaaagacatatactttgacattataagctatgcttcaagcactgcgaatgctaggtcatttgattttggtgcaacaaatccaaacctcgatacatgtaaggacttcgtttttttgctgaacaatttaacagctgctatgaattatataccacaggtagcagagtagataagacgataaggctgttatccagttggtaatgccactacacagacatcactttcaatatttagttaaggacgctagtgttactcacattgacacatagacactgatcaaatatatgattctaatgcacttgatatggcatttaagcatttaggcatttagaaatttagtcagatataagtatgccagttatgtataaatctgttctgatttcatgcattttatggtcgagggaactgtaattaacccaaaataattgaaagaagcatgacttgttgaaataaatagtacctttgtaacatttggatggtccagcttatgccagacagagacctcttgtgaaaaagctgctcttagtgctgcgatgtcttgttcggacctatgcccatcctctccccagtcaagtaatttcactggagaataatatgaatcaatgaattattttgaaaagaggtgtttgtaatgagaacatacaatttcccattggaaactgtcaaataaaaacaagatttgagaattgatctaagcaaaggtgccaaggttgggagaggagcagggggtaccaccattacaccatcaaattgtcccttctcttttggtaagggcacacaaagacaatttcggtcttaggaagatccactttttgtaggggaattaaattgatgggcttttccaaaaaaaaaaatgcaaaatgatggaatccatgctgatatgggggaatggacgaaagatagctaacaatccctggggaatatgtttctcaaaaatagaatgtgaacatcctataaactatgcatgtacaacaactaatcatcaaccaattgcttatagacatgctcaggtccgatagatgaatcatcaaaagggattctttttgtgctgttgccgtgtcatgagtttgcatcgatggataatctcaatctggtgaaaaagtacacaaacttataggttgcacatccctccatactaaaaggtcgacattttcggctttctttggaaccgcaaagcaactttaccatgaaattcctagccagggatcacaagaaccatggccaagtgaactgctgatgagcgagggcacgtcaaaagccgcccaatccaaccgatgtcacggggaacaccatgaaaagccaaaaggggcagcggcatcaactcccgcaatttactaaaaggggtaaagaaaaggagcacccaagaggccaagacagtgaccggcggttccactcgccgtcagcgccgcattggcagcgcgatttcgtcgaacaccgtacgggcgcaagcgagtgcatggatatcgcggtggttggtatcaagtaaaaaaactgggagaaatggcgcgcgcgggcgggcgcacctgcgacgtcgtggccgtcgt

SEQ ID NO: 41510 - DNA, 7146 bp, Oryza sativa
ccacgatggacggcggccgcctcctccttgagcttctccatggtccacgcgcggctcaggtggcgctccagctgctcgtccaggctcttgaggtcgatctggtctgcccgcacgaaccctccatcgccgccgccctccttcatccccccgtgtggtggtggtggtggtggtgagcaacagagcaagtgagcaagcgagcgagcagtggctaggctaggctaggagaggaggaggggggaagagagtggcgaggcggagtggcatgtgagcacatgggctgccgaggcaggcagcggccggggagggggagggggagggagacgggagggagacggggtgggctcgtgccgtcgtgtcgtgtcgtgtcgtgtcgcgtcgcgcgcgaggggcccagcccagcgcgcgcccagcggcgcgtggttttccgcggtttttccccctcgtcttcttcttcttcgacgttcgtttctcgctgctgctgcgtcgtgtggtggccggtgttgtttgggcgggggatcgatcgccgtctcggctcgcggtggtgtatttataccggcgtgagggcgggattgaggcgtatggatttcatttcgagggcagctctacttgcggttttaaatactttttgatccttaaaaaatactatataaattatggattgaggcgtatggaattgatttctgcacttaaaaaattaaaaccaattattatataaattatggtaaaatgtatacgaattataaaattgcggcttgattaaaagcaataaaactgcttagagtaccagcctgagggctaaggcaatttccaacataggacagctagagcacgggatactgtgatatgaatccagctaattaaatttctcccagtaaaataggtctttcccaccgtgcactaggctccctgtctgatacaagattcctccttggtatcgtgtatcccgcatcctagccgaagcaattgtggtagcttccacgcatatgtgacacgcagttgtgctcactgactcctctcgtggatcacatcaacagtaggaaaaggaggaagtgtgtcgaggggaggaacgggggacaagagaggagccagaggtaaatggctcacccaccggccaggcgggtgacaacctacgctctctcctcatggtatgacacctgatatatatgggtatcggatggtacctgggtaccaagcctgataccacgagatatcatggacgctctctcctcatggcatgacacctgatacatatgggtatcggatggtacctgggtaccaagcctgataccacgagatatcatggatgatacccgaggtattaggcttgatacttggtatcagttgcagatgtgtacctgcagacaacacagacgagcagtgaagagctagctaggagcacgacgcgacaacctcgagaccttgtcgctggtgccctgggcctcgtcccctcatctttgcatcttcccttttctccctccccagcgatcacaatgccgaccttgttgtcgtagttgccttcgtctttgctgacctcaccgattccgacggtctcatgatctcaccggtctccacactctcactgatgccctccaatctagtttaggaagggcgacaacgccgattagttctctggcaactggagatgggatcgcaggacgggagggaggacgacgacgacgactatggggcagaggagtcgaggaagggagggaggaggaggactgtgactggctcagagaaagtgggggagggggggagaaaatggatcttgaaaacaattgggttgtatatttgtcccgtagcctgcaagagacattgtttcgtagtttttcactttccaatactagtatattgttttctttgaagttgggtatcgatatgggttacaaggtcatgttctttatacacgactacagtttttgtccctagatttgctcgaggatctgaaccgtctattctaacctgaccgatcctatggctccgaaagaacagccatgttgggtcacctggacggctagatcctgagattgaacggacctcaatagcctgaactgaaacacaattaaccagagataaggggagtttctaaaaatattgatgaggtggcaagctaatctttcaccgatcctacggtgtttagggagatctatattataggcatttatatggatggtttaaacattagatagtataattatccacgatagtttagaataagatatccaagcaatatcgatgtaaaaagtttttaaagaagttatagttgaagaaccgtggtatacataattcataacttcgtaaactaaaaaaaaaagacatgatctaaatggtttttgactcttaaatacgggatatgcacgaacttgatacaagtactacgtactactatattagctttaatccgctgaagaattatgtttatataagggacctatatgtacatgtatgaggaccaagataattacatgtttgctcgaaggatgtttctcgtaaatgatcacgactgatgcaaagttcaacaaagaaaaagaaaagaaaaggagtattgaaaccaccaatcactagtgaggaggcaagtcaaagataagcactactgagcaattagaaacagctaggagtatgttggaaaacatgagccacattattatcatccttgacgacaaaaatgaacaaaaacaaaaaaaaaagagattaaataccactctccccgtccagcttgcttttgcctgatgggcagggagatcgtcgattttccagtagctcccatccatcctgctcacgggttggatttggctactgctgtggataacgtttcttgtgatccttagctttgctttgtcgtttgacatctacatcacttttcattaatatggtttattatatgctagtagtagctttcttgcctacgtaattgacgctctctctcggtccacggcacggtgcgtacgtgttttgtcgccattgagaaatcggcgacgtttgggccgtgcgcccgtggcgttttcaagcctaataatcagtgaggtgttgaagtttcgttcaaaaaaataagtgaagtgttgaagaaactggcaatggcaactctccgtatctcgtgcggctactacttgaccagtgctattttggctgtatgagatatcctggtactatgataccgtatgaatctaccaaacagtgagatctatcgagataaatctcttatattttaagatggatagagcatataccactggatctttcaaaaatcatatgctactgatataccctctccatctcaggatacagcagactttggaagatgatatctgctacgaagaaaggtggaaggacatagtaaaaaagaaaacatttttaccttctcaaagatgagtaaggtgtatgccagttgttgattggcaaatattacctcccacgttattatatttaaaataaaatttaaactctataacttgctatattatgcatatgttgagatgaaagtattatgcatgtatgatctactccctccgttccaaaatataatattttttttggtatctaagtaaaatttgctatattttaggatgaagggtgtatactgtatcgttatcatcccaagactgcctcgcttacacgatgggctacgcttttgtctctttcgtcgtgcttctactaataaaagataaacaatttaagaagataaaagatcatgctactttcaaagatgtgacacgtgattggtttgtgattttgtacacgctcagcaattaaactgtttgtgcattgataaatctattttatttaaattaccttgttccggatggaggtactataggcttcctaggtgccatgctatggatctatggtcaccaactcacaaaggacttctcttttgccccctactgactgctgcataagattttttttcccaactgaaatgaaagtgacatcagacaacaaaatcatcaactggatggagaaactatcaatcccggcaaagtaacagttggagaccgatagtaagtaaacttttcaccgcaaaacatgtaataaaacaggcaacatgttgcagacaccattgtccaaaaaatgaaatgcaaattgattacgtacctcaaatagacttggatagttctggtccgtgtttgtgaagtgcagaagagtagaccgaaccatatggtctattaattaattcaacacgctcaataataacttcaacttgattgcccacattcttctataatctacggagttgatggctacacttccaaggtgagatatcactaagtttcaacctagacattcttcacgacaaaacttgtacatcataatggaccaactgtcttgcaaagttgaaacagacctacgtttgatgatgcctttcagatgtaccgggtgaagttcttttgagcaaaggattgaccaaaaacggccactgctagaatatcttgctgataggcttcaactctgtaggtaaatgatcatagttgcccgaatcaacctctgcctggaacatgggccgcttcccgtactctcgcaaaacacctgtgccaagtgctccttgcttggtgttagcattacatagtttggatcagccctttggtaactgcattttgttaagaacaacgaacaaagtgtactcgattaatagccaatgcaccgtttctaataactagaatagatgaacataaatctcgaacagacataatacaaatacaagaaacaaataatagaaccttggctgtctaagatcctcaacacgaattccaaatccatatgatcttgtccccttcaaatgatcgttcacagctgcaagcgcaaattgatgtcaatgcagtcagtgaacaactaaggctgagttatttccccaaggttccccaactcccctctctcgttttccacgcgcacgcttttcaaactgttaaacagtgcattttttgcaaaaagtttctatatgaaagttgctttaaaaaaatcaaattaatccatttttgaaaaaaaaaatgctaatactcaattaatcacgcgttaatggaccgccgttttccgtgcgtgagagaagtgttcccaaccggaactagcgaacacaccctaaatgtccttttaaaacaaattattgatagtttggagcaatctcactagtaactttctccatgttctatgggttcaattattctacttcaccagaatacaaatttaacaatggaccaagcactgcagaatcagttggtctcaataatcaatatttgacttttttttccatagggaaaaagtggatacatcctttttccagatataatagctggcctagttttgttatttgtatgcagaagtatttgcaaggtacacacctgtgacactaaatgtgaaggatggtctccaccatgacttgaatgccaaagctacagaagacttggaaggacctagctttccctattaagaagaagagagcaatcaatattaaaaacaagtaaagtaatgttgtatcctaaactctaaagatacgggcactgcatatgctcaatgtgttcccatcttttcttgcatcatattcatattcacaatgattgcttctacaaggcgcaaaataatccaacataaaatggcaaaattccatccatggagcaacgtacagaaaagggcaaaactattctgtaggttgggttgaattcttgcactaggtagaacccctcatggcctcatcgtcctatttaatacatctccatagtttcttaaatcattaagatgggatatgcaaattgtatggtacaaggtgtgcatgctatggttgtacatcctctctaaaagactagagacctaattgatgaaaatgaatggatctacttaaccttgaataggaagttcttattagcttgccaacttgctgcaaactgaaacaaggaattgttggcactctctgatggtttatctttatcaatcctatcaacggtgtgaaatggagttagttagctgatatgtgaataacatagtgatagttatttaaggattaccttgtagccaattcaagcccaaaatcaatgtagtttgtgattccaacaatctgatcatcttcaaaagggtttttaacctggtagatacaatcagcacaaagtctcaacaagcttcaagtttaaaaacttgtggcgtaccataaacgactcaacagtggatgagtgaagatatcatgactgtaagtattttttctgttaattgataaaagataggcttttctgcctttatacaaacctggactagcacatatttatccaacctattataaaatttatgccatgcaacctataccagtaaactatgaaactgacgaatcaaggatccacataaattaatagattctgaactaatactagaaaattttgattaagctaaaaaattgatgttcttaatagttttcagcatcaagaagatttcatgaactatagtgaaagagaaccactcttacccttctttgaacaaccatgtgttgatagaacgatgcaatgaactgcacatcaaggaaaacaaaatgttgttacacacgagtctcgatgaaggtcacactagctagagatgtcaccaatcaatgattatttcatatgtgctagtgttgtacttcctccatctacttttgatagtcatatttcatcttggcacacagaccaaggataagtaattctacctatcattcatttaaacatgctactagtcattcctcgtaaacaagcgattcattaatatttacatttctcgatgcccatgtagccaacctttgtggaagaatggagagtcacacattaaatcagagaaagttattaagataataggttgttggattgaaatatgcccatcaaattttttttttttagatttggaaatatgcctatcaaaagtagatggagggagtacttccttattcttttatccactaataataaaataaaataaaataataataatacccaaaagaaagaaacacataagcatccagcttgtttcttgacacagttcatgtgattaattataaaattcttgaatatatgaaggatttcttttattacaagaaacacatactgtaagagctgcaacatttcaagtactccatttaaaattactagtccaactctaattataatatgcacctagatcaagggagaagtaattggataaaga

SEQ ID NO: 41511 - DNA, 2541 bp, Oryza sativa
atggtaaattgtctatactctgtaccattgttaagagatcatagcaaatacaagctaattaactgggtgaagcttcctaaatgagaaaagagaacaattgccacaaacctctgtacttctggcaagctctagagaaaaaatgaaggaagcactgagtgggcttgttaatcctacaccataactgattgcacaattccagttcttccaatctgtatatggcataagatgtttgtttccacctattgcagaattcgcataatgtagaattagtatagcaccataattaaaaaaaactcaaaaggtgcaaataaataactcaatattcatgttaattctctaaatgcatgaaaatgcagatgaacgccaagatagcagatacctattgcacaagtcataacaaaaacagcattccagtccagtaatattaaaaccaacatacaataaacttcagccttttagtatctttatctgaatttagaagaacattcatccatagttatttggatataagacaaagatgcagtccataggcctctatctgaatgaaaaatttcaggtttcccatgacatgcatgtatattcttctgatggtgaatagaatgattgaaatcctggtaaaaaaaaaaaagaatgattgaaatgaaaagcgccgaactgacattttaagggaaaactatgtccatatacattaaaaaacttttgttaaaaaaattactagaagagaaaaggaacaccaagtgctgcaactatttattgtgttcccaactttgcatgctccacacctccaacaaataggcccctcaaaaccagcataaaatttcaaagtccaactcagctaacataatacaaagatgctattcaaaattcacgattgaacttttttcatcttctgttgattaacttaggtgctggagttgaaattttaccagttgataaactaatcaacatctatttactgaagactaatgtgattggaagtaatttgggcttcagactagaaaaactttactaagtggcttgtattgcactcctgcacttaagctcccttttctcccgaccaaccatgctccagagggtagttcagcagatcctgtcaaaaaagagagagagagaaggtaatatcagcacatgtgaccttaggaaaaagtgaactgcatatagacattattaggggcctcttcgaggacattgtaaagattggatattgtggtatgtttataaacagtcacatatcatctttagtcataacaataaatcgcatgagaatcataaatgattacataccaggaaatggcacaaaggaagacccaaatgatagattctctgaaccgtatcttactcccatgacaccataatcctcagaacgcaccctgaaaaaacttatctctctgatctgatggtttataaattataagcatattgattgaaattattcagatgaacattatttgcaatcatttatctatgatgtcaacaaacatagttgtggaaagctctaacaactccatgcatgatttgcaactgcaaacaagatggggtaatctacctgtttcccattagtaaagggaatgtcccaaacgcaccaacacggtacttaggatggtaagcacatgacctaacctgcaacattctggataacaagttatgagccaaaccagcatcatccacataattttcataagtaaataataactgcattgatgatattatccacataacaagaaagtacttacgggtttgaagttgacacaagaaggtccacaaaggtatggggatcatctaaatctctaaaaaattagtaaagcatttttatgttaaattataaagtatagtacataaaaatcaaggactggtaatatatatggaatagtaagtacttctgccagcgaaatagagcatctccctttacttgtgttccgtctattttatcagcagctgcagacacctagtaatattaaggtaggcaattttttttctttcaaaaactagaattcaagtccataaaaagcatatttattgcaccaagaaaaagtcactgaatctgacttcccagaaagtatcatcttaaaataatttcttgtaccaaagatgaacaaatgcaaacgatgttaacaatctaagttaatttatcagtcatgagtcatgcaataacattgatcctatcaggcctcccagtagacataaatttgtgccaaaatttaacatataattggcaccagtagatcataatcaccagaacaagcaaaaatggtagagggcagaccttttcaacacagacttgcttttccagattttggttataaataacagcaacaatgtcattaagtggtataaaaaccatggcatggtaacgaaagggagagatgatctaaccttctttgagcaaagagttatgaacagaggcaatggtaattgctagcaaaatgaagcaacagaaaatgacaactataagaagggtaaaaaaaatggtgatccgcttatcctcatttcctcatttcctattaagcttagacagaaaccatagtaccagaagaacctgaa

SEQ ID NO: 41512 - DNA, 3602 bp, Oryza sativa
gtccttttaggagcattacaattaatcacaaggcacacagattatcagtatatcttatcaaaatgcttgcgtccgtccagtgtctcagccagagatgtgcattcccagcaaaaattatcagaatcggaactacaaccataagcagccggtgtgaatgccattgtacatttgcaccgacctacagcttcggttcagttcagaatgtagagaacggccaagcgcgagataccactaaacactaatcacgattattcagcctagcgagtgggggaacctgcaactacaaggctctagttactgaagcgaatcgcgcattcatgtagaagtagaacacgtttgaatcaaccgagagtgtaataaggcgagcactaccagtgacactagctcctgacgcaaacgagcgagttcgacggatttcgtttagggagggaaggtgagaagggagaagaggggggagaccggcggcggcgaaggcggaggcggcggacctggtgcgggcggcgatgggtgggtagtcgaagagcggcgggacgagcaccatcggcggcggcggctccgccttgctccagaagatccccatctctgacgaagccgagtgcgcacgctgcctcttcttctccctctccttccttcctgaaccctcctcctctcagtcggtcactttgaactctgaaatcgaaagagcggtggctgaaatatttctgctcccatgtcacacaactgcgcgctacggaatttcgtttcgttttagattggaatttaaaagctgcatatgcatatacttactccgttttttaatagatataaccatttattttatttatttatttttcaaatatataaaatataaatcatgcttaagtacattgactgataaaacaactcacaacaaaataaattataattacataattaagtaagatgaatgatcaaatgtgccataaattttttaataagataaatgatcaaatgtgtgaaaagataacgacgtcatctatttataattacataattttttttaaagtaagatgaatgatcaaatgtgccataaatttttttaataagatgaatgtttaaatatgtgaaaaaaataacgacgtcatctatttaaaaaacaaatgtggtatagagctatgttcgttacgggaggttcacaaccggaacacagtgcgcatggaaaacagagcagtccattagcgcgtgattaattaagttctagctaattttttttcccaaaaatagattaatatgatttttttaagcaactttcgtatagaaactttttacaaaagctgcactctttagcaatttgaaaagcatgtgcgtgaaaaacgatagggggagttgggaaggggaaaggaacctcagtctctctacttgcgtgttgcttcaagacattataataatcaatctataatcaatcaactaaataagtgctgatgtttgttacttaccaaatcgcagatatggctaactttcccaccatatcgtagagaatgtctcattttgtatcattgtgtatacatactcatagaaaaatgccacaatattcactatgagaaaaaaatgcaggtattttttttaaaaaaaaagtaaaacgagacattaagctatattgaagttcctacaccaaagaatggaaattatatgattacaatatcttgtctattggaatatagttacaatatcttgtctattggcttcaaccctgtaggcaaattgtcataattgcctgaatcaatgtccggctgaaatatgtacttcttccctagcttctttaaaaaccggggttccacatcctctttgttttgtgtgacaatcacatagttcgaataagccatttgataactgcatcccaataagatagcaaatattattatcaatattgtaacatattagcaatattatcttgtggtagataaaaaaaaacctgggctctttaagatcctcaatggaaatcccaaatccatatgatcctgtccccttcaaatgatcatacatagctgcaaaaagaaatattatggagccattatgaacaatttaaacaacatcatttcctattataacgagccacatataatatatgagcatctcaaacccccaaatatgaggttttacttattgagaaaaaacttgaatactatagcacttgatgtaagagaaacaaaagggggggtatgtggggatatttagattacgaatcttcgattgttaatctttcaaatataaattgctaatattaaaagagaatttctatctccctattgggaaacataaaattctcattgaaaccaaaatagaggggaacaaaaagagatatttaagtgagggtaaaaaaaacacagaacttttaaagcgtaatttaatgttgaagtgtccatgaatcttgttgtgataactttccccttgcaaataaaattgttgctagctaaaattagaaggtctacaaacctgtgaagctaaatgtaaagaatggtctccaccaagatttcattgccaaagccatggaagatttggagggacctaactttccctgttgagaaaatagaaatagtgtcaccacaaataaatgaaaataccaacctaagcataagggttaatttcatctttactctcaatacaccttgtgagttgtgaaccattcaataatccttataaaatgagtagtgggggtaccaccaccacctaactatcaactctcaaatttttttaagaaaaagagatgacatatgggggttagaggacccatatgtcaactacttccaccaactctctactttttgtgagagagtgtgaagctaaaaagatccacacgtgagtaacaaatatgtacaataattaagagatggtaataacacattaatgataacttaataattaaaatctcattgcaacgcacgagtaatatgctagtttattataaatttaaaagaaaattttaaaatatgtttagcagagaagtcctacaaaactttgccaccaagtagcatgtgagccgcctcttttctttttaatagattttttgaaatttccttcatccattaaggtattctctaataaattttattttattaatgcataaatgatatgaaaaataactgacctttactagaaagttcttactagcctgccaacttgcagctacctggaatgagggattgctagcattttctttcgccttgtctttatccaagctaaggctcaaaaaaaagggattagttaatataattgatgcgtaattcagaaaattatcttaatttttatgtttaccttgtggctaactcaagcccaaagtcaacaaagttcgtggttccgataatgtgttcttcttcacggggattcattacctaatagacaattagacatacacaatgcagattgttgtcaagattcaatatgtcctagttacattaaaatgattaataaataaaataacttagcgtttcaactcatgaatcttcataacttagtgtcctatatcctataatatcagttttgtatagtttttagttgtatcataatggcacaatgcaattttttttttgaaaagagtgcacaatgcaatggcttcctagaggtgcaaagataatgaaagcaaaaaa

SEQ ID NO: 41513 - DNA, 7007 bp, Oryza sativa
gatgacatgaatagtcacatttttagtgcggcagaactaaaactaaaagatgccttaataacatgcacaaggtatccatcaaaaacatgctatttcgataatcttgtcaaaatatcctaacaactgcaatatagtacaaactatgtgaagctctgttatcaaataatgagaacaataatggcaaacctgtgtatttctgacaagctctagagaaaaattgaatgaagggctgagtgggctagttgagcccataccataactaattgcacaattccagttcttcaagtctgtcaaaggcacaggatgcatgctttcacctgctagagtatttatgaatgaaaaagagagaatcaaatacaacaacataatgccataaacttttaaaagtttataaaaggggaaatcaacatctaattatttgaaggccttatttgaatgcaaggaaaggacaactttttaacatataagcatatgtaatgcctcaaaactcatgagagataagggggaaaattcttaagtttcattaggctactcttcctatgatccgttaaggtttagtaactcgcactcacagagtggcttgtattgtatccctgcgcttatattccctttcctgccaactaaccatgcaccgtagggtacttgaccagatactgcaaagaaaatattatgttgtgacaatatgtaagaatatcattagagcttgacttaaacatattgatttaaaattgagacagctgatctacttggctgcatattattttcattctccaagtccaaataagttagaattagaactatgagtaattacatacaagcaaacggcagaaaggatgccccaatagacagattctctgaaccatatcttaaacccataataccataatctccttctgaacagtccctacaaataaataaataaataaatttaaccatgtcatttttatgggttcaatgcatattgatagaaatcaataatgagaatatcagaattattggtagcatatagtggaaaagtataacacctatgcatgatctgcgaccataaacaagatatggcctacctgtttgccttaagtaaagggaatgttccaaatgcaccaattcgatacttaggatagtaagcacacgacctcagctgcaccatgctggataaaaaagttataagcgaaatcaacattatctatgcaccatttaggatataagtttcaacataaatgtcaatccaacaagaaaatgcttacggttttggtgttgacaaatgaaggtccataaaggtatttggatcatccaaatatctgtaaagtaattcagttgagccattttttgtttagagtaaatgcttagaatagtaacaaagtggcatagaaatctggaaataatgaagctttagtaaactatgcaataataaccacctctgccagcgaaacagagcctcaccacccgttgtagtcatctagtaaagccgagttaagaaaaaaaaatacattgcaataacgtaggaggaaaaaaaaaccggtaaaaacatcataacaaacagagaagaaaaaaacgttattgataatccacgtttcgcacaaaatttcaccgaaataaaaaggaaccagatcaaagatcatcacaatgctaacaaaacgaaaaaaagtcaatgttcgaatggatactttggcggtcaaatcaacatgagaatcaaccagtggcctcaacataatcatccctgaggttatgctcccaacttgatcgaagtaatcgtcaaacaggctccgccgctggagcttcccgaacatgacctcgtacgccggcaccgccatcctgcccaaacaatgccaaccacacttcagctccataaaaaagacaaccaaattcgtcgatgaatgcaagcaatctgagtagtagaagatcgcggagatgttggtgacctggtgcgggcggcggcggcgggaaatgtgaagggcggcggcaccagcaccatcgccggcggcatctcgtcgtaccgccgcatcgtgctcctcctcccctgcaaatcgatctcgcttccaaactaaccaagcggccgccgctgctgataagtcctttttccttttccttttcgccttcgttttcgcgctcgcggttgatctctcccggccttgtacgccacccgcgtcctcccccatcctttcttgccaaacaagcctggcctgcaaccatgggcccggcccatgtaggcccacaaatgtgggcctgcggctatgggccaggcctgtctgagcccacataaatgggcccacatgtcaggctcctctcctcggttcgtctagtcgtcttcctactctcctccgatctccaattcttatccaacccatggtgcttggctccccggaagtcgggatggaggattcgtcggcgactcacctctccgacgaggtgcaggatccaggttcgatccataatcttacttgctttcgtcgccacttggtagtgaagctctagttagtctgtagttagggttgtgatttgtgaagggaagcaaaatcagtagctcgatacctaatcgatgaactccatgcttgccatggctctaggtcgaggaagctcagatgcttctgttcgtacttctttgcgagattcgacaggaaaggaggctgttgcggccgttgaaccggtgagggaggagctggttcagagcgcggtcggttttctgaaacacccaaaggtagtggcctcttctgatgtccagaggcgttctttccttgagaagaaagggctcaccgtggatgaaatcgatgaggcatttcgacgtttacttgtaagatttgttcttttcgctgccttgtcggctcttctttttttcagagcaggggtgaatcactggtggttctgacttgattaatttctctaacttagtttctgcaattttcagagcccatcttcaaactccatgagtccaaattattgcacatatcaaggtatgctgtggtcacctgtcaagattgttgattaggtgatggtgttgttctgtgtgattggtcactccaaatgaacttcccctctttaggtttatatatgcacaacggtgctctaaagtgtaaatggcttcatcaagacatgtctaatgacatcgccttgtgttttccttcatttttcaggggtatctgatcattcttcaaaaatcacacaggtcagctaaaaagtacagaaaaatgtttttttcagtccacacttggtatcgatcatgcattatgatgtttatgttgcaagctttaagttatccctttctctttgccacaggagaatccttcaacagttacaaaatgtatggatgatgattcaggtttgctcatgctgcctttccatgagtcatgttgactaatttatccatgttttctaattctgttgttccttcttgcttttatagggagacctgagcctgaaactgaatctgtggatcctgtggtgcctcgccacccaaaatcatatatggaggtcagctatattgagcatcaccttttttttttcctgtcactctagcatgagcgtagaatcgatgtgtttttctttactcctaagcatgctacttgaatatttaccaatgaagtttagagtgtacagttgttactgactgtatcgtgttgcacgatctatgattctagtagtctgtaagtgaacgcaagttacatttgcttgtgctggtgaaaggtcattcaagagtcaagactaccttgctaggaagtgcgctttcttaatagttttagatataaacttgagcactccttcatccactttaatcgctaagtgcagctcaatgctttgctggcatgcacagtagatttttcttccttcttttgatgtaccatatactggacattggagggcaactcatcaacatgttttatatattttggggattatctattgtatgatggtgcaagtaattttagtgtgctcttattaaagtattaggacaaaaacaacttatcagccagaaagttttattatttttttggatttaatgttgtgatgatgagtaaggaatattaaagtatgcagattctgttgctgaaccaaaaattagctcttaactgtcatactggatttgacacttgacagatcatggaaatgatacaaaggggagagcggccagatgatatacaggtatatctgagtttatgcttgtcaagttgactttgtgaccttatcgtttctgtttcaatataggacattaatgatgaccctccaaacccttatcaaccaatctcggaatcccgcatggcaccaaagcccaaggtttgtagttttacatttccagctaaacaaacctttagtagtataggatgtagttcttttgttagcatgatagaaagtatgtacatgtacgtagggactacaaccagcattttatgctgaaattagagtaacttcatgctaggctgttttcggacaacacagttcactcacgtttattttgtcggtaaacagccatgggaaaagcagggtcaagaaagttccatctgggagttgaaatctcagtcaatggacaccatcgaatcgagatcagaaattcaacttgacagcgccaaccaatttactgaaacggagaatagatcaaatcaaggggactcactattgctggaagaaacggttgcaggttctgaagctcacacagatgatgctgcctcgacaaagtcgtaaatgcaaaagcacgtgatgatggaattgaacatgctgggaaactatttcaacatatacttagccaaaaagctcgaatttctagtgcaacagttttctgaaattctctgaacctgctttctctgagctcactgatctgcgtacttccctattgttggaatcagatttagcaggcacaaaagacctcccaattttcgttagctggaacagttatacaatctgtataatgtaatcatgaaaaatatacaaacaacaacatgaaatgttgtgacttgtgaggctcatgtcatgtctgaagtctgaacccttgcatctgtaacagacaagcaaagattgcttgattggctagaaatagaattgttgaatctgaggaaaccattaggaacagagtaccgacactgatcccagtgtgaacccggctaggtgtgaaagtctccccaatagtgtgtaaccccatctgctctttttcgtggcgtcgaatatgcttcagcgtgcgtgtcgctagcaacgaacagcaaccggagaagaaatgaattcggccttgctttgatacgcatctgactgcctactatgccgatgggtcttgacgcgacgttgatacaccacacagtgacacacacaactcctcatcttttccaagttttccaacgccaactacctcgaccagcaatcaacctaacctagacgatgcaagagacgatcgagacacaaagctacatgcctaaccagtccaaaataccactgctcttacccggtcttgcttgcagaattaacgacatgtttggtgccttcttggttgggcaaaagcaagtgccattttgacttgactagtgagtagtattactacatagtaggagtacatactattctttgctcataatgcagagttgtgtttgactgggtactaatgctcgtcaatgcactcttactagctcaggagaatgttctttttaacgtctttgatacgtcaagatgacgttgtgaagttgcggtgcagaagagagttttgatggcaatgattcagattaggtgctgtaactggagatgacgtcagggaaataggagagggccaaaacttgaaagctagagcagcgtcagcaatgagcctaagtttaggtagtattaggcagctcaaattggtcatcatgtcaatgacaaccctggtcctaacaccttgtatgacaacacacgcaaacaaaagcatttccattttctgtaaacatttgcaatgatgcaaactaaaacagatgtcaatttgccattacatgtagaaataggactttgaacccatgacctttgcggtagtcaaccaattttctatgtgagtagtccaccctgtaccatcgaattacattttccatcatttcaatcgtcccctgttttttagcctttttagcctgtaattatatttgtaggaagagcgattttactgcctttgaggtaacaggagatatcaaatttgatacatctcggtacctttgatattgtcgagggaagaccctcaatagcggggagtcgtgagacccccctttcgtgagttcggctgggggcggaggcccgtctcttgaaagtcgcttgctcatccctaggactatcggtgagtttgcacgtagtcggattatacaggttcgggccactatagagcgtaacaccctacttctgtgtttgggattatggatgagttttacaagggtttcttcactccggagagtgcacttgctttctctcttctggagttcaggtattctgggcgtcatcccctttctcagtgggcagggtcctccttttatagcttaaggggataccacatgtgccgcctctacctaccctctatgggggggaaccccactccacttttttgggcttcaaactgtgtcttctcccggaagctaagcaatagccgtttcttgagcagaattcggcgtcgtcccccgtctgacacgggggacagccctgtcattccctcataaatgaacggtgacatgcaacagcccttcctcaagtgacgcccggatgtgacgggtcatacccacccccactccgccggggacaagggcgacgtgaggacacgactgccctatccatcggatgtgacggagacgggccgatcacagaccggtcacatccgatggacaggggttagctaggcgcgccgcacgtctgccctgaccgcattaaatgcggtgagggacagttggggcgttgcacatttatggctgttcagcctgcactccccttttgctctctccctctgccgcgtggcggccgggtgagggcctcggggcgaagccgtgagagagcccgagggggtgacgtcatgccctgagcccccgcccccc

SEQ ID NO: 41514 - DNA, 6337 bp, Oryza sativa
atggctgatgctgatggcactggtgtgagctagtaacaatccagagaacaagttgacgggaacagatgactataaacgggctattggtgtgcgtcgagatcaaatggataattcctctcaccggcgccggattctcctgggcaaaaatgtggagtttgctcggccaagtggtcagcagctcaggcacgcacagtctctttttcacagttttaataggagtacgagactgactgcgacgcaatgccttctggctcttttgttttgttccttttgttctgtttcgttttactcccccgaaaacaacatcacgctagccgatcaagcttcctcctgcgagaatgcgacgcgaaaactaaatggaaatggttgaaggtttgagcccgatcaggcacgtttcccagctcaagcaaaggatctcacccaatgttactgactttctgctacctgaaatgaatgcagtttctgggcacaggttttggtctctgaatatgaaactctgaaaaagtaattctgaacatggagaagaagttcagacaggaggaaatattggaatgcaggaaattcagtaaaggtgtgtagacaagtagaattagacagagaaatagattatgggcttcagctagaagttaccgcatctcatctcagattagaagtttgaaaaaccaaacaagcagatgagagataattaacctctccatccaaatccatcactccagttatatgttctaactgcatgtgcttttcttttcatgtaactatcgttgagcacgtgataatcagctgctctcatgtatgaatgctctgctacagtcgcggagaattgacacgaaagatacacaaaatggatcgaacaccagcatttcaaatcgatagaacaggagagccattttcatcatggtgtccagttaatttagcaatcgtcggtcgatcggtggtgcccatttcagattggccattccgtacgtttgtccctatgctgtcatgatcccaattatgaacgagcgaactgcatatatcttaccggacgtctccagcaatcttaagcaacaagcaccgaatcaatcacgaagcactgctacacattctggatctgatttttttttcaaggcaaatattttgtatctgattttttaatttttttttaccatttataagaaagtatcactgtatttttctataaaactcgatacctttatatgccttttttctagtgtagaattcactgaaaattttgatatttactacaaatactttttaaaatttctccttgttaattaaccataacataaattaggcatcatgaatatgagttagaatgtgcagaattgttgaaatctcaatgctacaattgtaggttaggtctcgttggaaaaatctctcgattactaaaaaagaaagacatgaaggcctttttctggatcacaaattttacaggatttttgcaccgtccagttctattcctttaaaactatcctccatttcaacgaggtcaaaaattccacctatatgcacgcaccgcctgggcgagcaccgatcgaatcgtcggagtccggccggccacctggcgccgccgccgccgctcgtgatggcggcgcatccacggcacctcggccggccggcgccgcacacgtgtcgcgctttgtgctaattaatctcgttcgtttccagccctaaagctagtcgtaattagctgttactacctttcctttaaagtagcaggacgcaccgtgctcaaagtatgtatcatgtgtgtctacacagtgatccaacagtactatcaccacgtgtgcatcatccatcagaaataatttattaaagaatatagtaaaaacaggtaaatattaatttacggaaaataaaaaaatgtcactctcacaaaattaatgaatttgctattgcacatgtacaaactcgggtgtacaaaaccttgtctaatggaggtttttctcgcgccacccgtaggcgttcacactctgtccgagaaagacaaaggccagttaagtcactgacttcacactgttcatagtccacattaagccgtaattaattaacctaatcacgtgattaattgactatcaatatatgcagaaccaaacactgtaaaattaattagaacggatgcgggtggctgcggctgatgccgttcacgttggcgaagaggccgacgagctcttcccggtaaggcaagaacgtccgccgcggcgtgcccccgccggcgctggtgccggtggcgccaccgcccttagcgccgtaagctatcctgtggatggcggcgaccgtgtcgatctctgcggcggcggcctgtgccgtcttgcggccgcttgccggcgtcggcttgggtggtttgggtttgggcttgaagtgttcgacgtcgttctccttgctactgggcggcgggatggggaggaacaggaacttctccttgccgtcgctgtggctgcggccgacgacgagctcgctgatgcggcgccaccgcgccatggaccccgttgagccgctcttcctgggcgggcgcggggaggccgatgccgaggcggagccggcgccggcgccgggcgtccagagacagtagctctccggcggcgcgccgtccaggccgccctcgtcggacgccggcgcggaagacgacgacgacgacgacgtggacgtggaccacctgtcgaacgaaccacgggactcctcgaggaagagccgcccgagcgggcccctcgtccgcggcggcaccgtcgccgcagcgtcgtccttggccagatgctgctggcgatcgcctcctcctccggcgccggcgcggccgaaaaccgggtagaacggcttgatgcggccgtcggcgaacaggtcgtcggccacggcggcggtgcccgcgggggagtccctgctgacgaaggggaactcgaactcgaactccccatcggaatcagattcctcctccactcccgtcgtcgtcacgtcgctggaagaagcctccgccggcagcacgtcagcggcgacgtcggcggtgggatcttgcggctctggaatcctctcctccatggtggcaggagagggggaaggaatgagaattgagagataggaggaggagtagacgagaggcgacgacgcgggtggataagaaatggagtcagagagcggcgtttataaagggggtgttgcaccggtgcacgtcttccagaagctcgtgctgagctggtgcagaccgtggaccctgcctgaagagaccctccccaagcatttctgaattctgatcaatggcgtggaattttcaaccaaacgtgactcctttgaaagttactgcatccatctcaaaatataaaaatctaaaattaaatgagatattttctaatactacgaatctggacagtcgtaatagaaaatgtcttatccgattctaagttcttatattttgagacggagatagtaaatactccctccgtttcaaaatgtttgacaccgttgcgtgtttgaccattcatcttatttaaaaaatttaagtaattatttattcttttcatatcatttgattcattgttaaatatactttcatgtacacatatagttttacatatttcacaaatttttttaatatgacgaatggtcaaacatatgctaaaaagtcaacggtgtcaaatattttgaaacggagggagtatacaagatttacagggctattttattagaaattagtttgatttttaggagaaaaaaatatctaaattcctccattcaaagaaagccttaattacctcatttatgtttttttgtttcgacgatgcgcaaaagcattgtaaatctctgtatttattaagattttgtttgggaggggagagttactacaatttatgtgatgtgcttgatagtgcagcggtaagatgtgtagtttcaactctgagattatgtatttaataatttattcttaaaaaataaatatcataatttcatgcatttgcaccaccaaaagcatgaaggagctcgccgtggtagggaagcagtttggacgcctggtaacattaacgattagccatacaacgattcagggtaaggcatcaggatgatcaatagactcgtcatgtccaacaataaaaaaattaacttagatatgtttgcgggtgacatatttcatattgatctgtcgtatcaaattgtttttttatctttgagtcttttttttaaaaaaataaagtttgataaccatttgaaaggtataaaaaaatgaggaaatgttctcttcaacgatgaaaacactttttcccattaggttgcatgatcgtgtttattgtccagtatacgatgcatgatcgacagagaatatgaggtgttttaactaacgtaccgttagtgtgttactgttatagctaactttgcactgagcagcattaccatagcagtcatatcatccatcattagtgggcgcgagatggattaatcaatgacacgtaccgcatgaaaatgatatgattcgagtgcgcgctcccaccgcgagactttgtgtggactgcaactgcaatagtctaaagggaaccacttcccttggactccaagtctccctttgcgccacaaatcaaatccacaatcctagaaaatcctataagagcatgcatgcatcaacgaccatgagaaaaaagaaaagattagatatgaaatatacgacgacgcatgcatcatacagtcgctgtcttgccctgatctcatgacctcatgaattaaagcggagaggctggagatcggtctcatcatgtttgctgttgacatgctacttcaattcttccggatcaatcgatcggttaacgttcggttcgtgtgtctgtgtgcatgcacaattaatcgagagagaccaacatgccatatgcgttcccacgctggttacacacggcggcgaactcaaactcgtggagctaagctgagctagcgccaggagccagggagaaagaatcagggtgattaatcacctagctaattactccaagattggcaggaatggatggatggggtggctggctggattctctcgtttgtccgttggtccctagctcgcttccttgcttgatgcgcacgtcgaggtggagatctcgccggcgtttagcgttttcatggtttcttctcttctttcatacggcggctgccgctgctctgcgcgtgatgttgatggtgacgtagcggccggccacccggggggcgtgtacgcgtggcggtgcgcgtcggcggtaggcggtgcggtgcggatgggttgtcgtctcgtttcgtcgtccgtggaattcggcggtcacctcagctgccggcgccgcggcggccgtggccccgtgtggtcgtctgcgtccggcgggggtaacgcgaggatgggctagttcgtgtgagtgggccgagaaggtgcggcctgcctaacgctgacgagccagtacgacgttgatgtgggccgatagatacaccggcgctaggcctaactggatcgctctaccggttgcgcaacaaaacctgctcggccgttctagatggctacctaggaataagttcactttgggtgcctctatttgtcgtccaaatttcgtaccttgatagcaaaaccgggtacaacacgttctccaacttacgaaaccatttaaataaagtcccttgatagtatttgaccccggttttagctgaggtgtgcctacgtggcaaatttgactcaatcttcatctgacatgacattgacgtggcgcttacatggcaattcgatccgaaaaataataaaacctatggaaccacatgtcagttttacacacacaataataaaaaatggtggggcccacgtggacctcacctatcatcctccctacccttctctctatcccatccctctctatcctttctccttcctcttctctctatccctctctctctccccgagaatggcgagcggtggcgggcggcgacagagctaagagccggtaggcggcgggtggagcggtgccccggaccaagagtagcaccagagccagtagggccgccgtcccgccgcctacggcaatggccgcgaccgccacgccggacaacttctttttcttcttcttctcggccactggcatggaaccacctccgctgcctcgtccatccgtcggcgtgccatcaggagacggaaagaacggctcgcatgggcggctcaggggcttgccgctgagctggaggttgccgacgaaggactcaggcgggactgcttgttctgtttttctccggagattgttaagatattctgcttgactgcttgcctgacgaaatctagagcatgcatgcgcataactgtgatgagacaaccacatgaatattactacctccgttttttaatagatgacgccgttgacttttt

SEQ ID NO: 41515 - DNA, 22085 bp, Oryza sativa
  unsure (1)..(22085): unsure at all n locations
aaaaagtcagcggcgtcatctattaaaaaacggagggagtacttgacaacttgttggatcgatgtttccgcggagagcctcgggcaagatgtcgatcttgaggaacggcggtagtagcagcccgaggaacttggtcgtctcgccggacatcgtagggatgtgcaggcttgccacgtcgagaaggaggaggggatcccgccggccaggtcgtgggtgcggggccggtcgccgccgggtgcccgccccactccgtccaccgccgctccttgcccgccccacttcggccgctgccgctccttccacgcctcactctggccgccgccattcctccccaccgctccgccgccgtcaccgctccgccctgccgctccggctggagagagagaagggggatagagagaaggggtagcgaggatgacaggtggggtcccaccattttttattattgtttgtgtgaaactgacatgtgggtcccataggttttattatttttcggatataattgccacgtaagcgccacgtcaatgccatgtcagatgaagaccgagtcaaatttgccatataggcgccacctcagctaaaactggggtcaaatactgctgagggaccttatataaatggtttcgtaagttgaaggacctgtcgtacccagttttgcgatcaaggaacgaaaatcagactgggcgacaaataaagggacccaaagtgaacttattccggctaccgacgattgcggtcccgttggatcgctatccatgaatggaataagtcttactttgagtccctctatttgattcgtgcccctcaacaattgtaccagatatcctaaccccctctactattaaaaccggtataatttaacttccttgatggttttgtgagctatttttgctgaagtggttcattggctaatcaaataactgagtcagcacatgaggcttcgaacacaggtcgtctagtccaccaccttgtgaagcttagccggaagatctctgggcgtttcttaagggagttaaagtggacttattccatccaaaacatggttagcctatttgggtagtatcgatctctcccgttctttctttccttccttcccttcccttttttttcttttttttttgcgagaaccccttcctagttcttacatcatgattttctcttctgtagacaaactcaaaatccccacgcactatatatatacgagatacagaaaaacccctgatgaaattaagtacaggcttctaccnnnnnnnnnnnnnnnnnnnnnnnnnaaatgaacaattcccatataattggagattggaattgaatgagaatcctgctgagtccggtgattcatacaccaaaatctacggctcagtatcaaaccttcgatttgtgccgttaccgtggtagcaggcgtaggagcctttcggtctgtcaaacggtgtgcacaccaatggaggcccaaggatacagtcgtcacggtagtgccgcaaagctccgtcgatctggttctcttctgctgtttagtcgcatatggaagtttgtttccttagattggttaatctttacctcattaaagatggtgtttctgctacctttgtatccatctgtgatgtcctggggtgtatccctttaactctgtctttgttaataaagttgtttaagtttttttaaaaaaagagaatcctgcggatagaaagcatttcgacgtcaccagaatctggatagagtttaaattagctgaaacgaaagcaaagatccccatggtttagccccctggattcagtgattaggtctaatctaaaaccgatccttgccgcggaataaaggcggggcctatcgaccactccccatagaaaatttcagaaaaccgggcagagaaaattcagaaaaaccaggccacccccaccaagcgcaagcgcgcagaaaatgacatcgaatcgagccgatcgatggcgcggctgataaagttagccgaaagccgagccgccggagaacgggccgcgccgcgtgcatatgcaatccaaaccaagaggctgccgtgacgtgtatgcgtatagctccagcagccaagtgctaccaaaccccgcttccaacggccggccagagagcgacaccgtggtaaaacgacggaagagaaaaggagtagggaacaaggaagctgctagaatcaatttctttgtatattgcacgtttgcaaatatctagactgggtacacaacttgcatatataacagagtagcacatggattggactccggccgtactacctccgcccccctaaataaattaatttctgattacgaatttggatataacatagttaaaagttggttaattatttttcagtgataagcaaggtatatatggtatcttcgtcaaacttaaaatatgctggcttagtttcttgagagatgcttatataaattgtgtatatgtttatagggatgagtatgcgtatattataagcatctacatttatactatatatgattctaaaacaaattgtttttctttaagatagagggtgtagattgtaagttgtccatgcatacatgcatatgtcaatcttctcttcgcccatgcatatatacttgtcaagctcctaggtggtccaatggctgtcctagttttcaccgctagtgttaacactattgaagacggaaaacccttaaatataaataactacggtctaaggagtagtaggaaattttcagcctcatcttttggcttatgctagcttatacttatacttataagccaaattttaaattttcaatcttaaatttgaagttaattttggagtttttttcatcgtagcttatttttcagcttttgcttttagattgccaagaacacatatataaaatttttatttataaattattttctatttgtaaatatgttgtttcgcttatttcgatggagtccttttttgatggttcaatcactgtatgctaccttttactataaaagctagtagttcataaatatgcagatagtgaacactggtgttaatgtacaatagtgacatgtactaatagtatcctagtttgaaatttcaagctcacttgggtcaaaaagaattttggtagctgacaaattacgcatgttaaacgctcctattacatattcaactgttcaagaaaaggctcttaaaggttattcctaacaactccactatttctttggctcctaagcatgtgtaaagattaaccatcaagcaaacctctggaagaaacatcttggatggtagtatggtacgacctgtagcttttctcaggatgtttttctgtctctcacctgcttccttaattaactcctttccgtcctttgtacttgttgtaatggagtaccctagtttatgcatttacgcaccttctcgaaggatttgccttgcacaaacaggccgggtaggtaaaagaagagtaaattttataaaactatatggtttatggttaaagttgtataacgtcatatattttaatacttgtcatttaactatattttggtactaaaatttcacaaaactacattattaacaaatggatccacccattagatgacgtggttctttccctacatatatttaggatgcaggcatgaaatggtgaatgtttcacttaggataaagctcctgtgtctacattctaggtgaaatatccatatcattttgcggtggacccgttcgttgataatatagttttataaaatttcctaaaactgtaattaattaaatgctaagtttcaaagtgtgtatatttaattttaacttagatcataagatataaagttttgtgaaaaattgactttctttttttaaaagaaaaaagacttgcgagtccagccgagccgagccgagctgaaatccatagtagccaccctccgtggtatatatccacgtctcccttaaacgcaacccctcacccacccatcacacacgcaaaaccaccgtcgtatctattgctgtatcaaagcggagacgccaagccagagtcgacgattcgattaaacaaggaagaggaagaggagagagagagagagattggagtggcattagcgcgagggggaggcgggcatgggggtgctgcggagcacgcagagcatggaggcggaggtggaggagatgcgcgccgcgctagcgctcgcgccgctcggccgccacggcgcgtggaggtcgggggccgcggcgaagcgggaggccggggcggaggagggcgcggcgcccgaggcccgcaccgtgtgcgtcaccggcgggatatcgttcgtggggctcgccgtcgtcgaccgcctcctccggcacggctacgccgtcaggctcgccctcgagacgcaaggttagtcatcgcttgtctggcccgccccaccccgcccttagcagcagcagcagttgcgtgttcgtcgaatggggaattattgccgatgagttggatggtgtttgcttcgcatttgatttgacatcggatcatgccacccgggagttggtaccagtctctgtttgtgaaatctgttttggtacaccggcaaaatcgactgcttatttttaatgcctgcaaaatgcaatgcagttcgattcacgtacgtcttcaattttagtcagagaaaacaagttcaattttattactaatcccttgtcgggcagaagatatccagtaatttagtccaaacttgtaccaatccgattttcaaattttatagtatgcaaagtaccactaccaaattgcagtaataaacgaaacttagattagttagtatattcattttggatcatttatgcattaagtcattgtctctaacccctttgcaccccttgttttagttggtaaacctttgtctttttttgctcaaatcgtattttgtttccgcatgcttcggttcatgcttggtgcgttgtgctgtggtgaacctcacgcgatgagcgtgttgcactttgaatgcacgcaccaaagttccgttccctttttgctattcctttttttacgagtcgagggagagaaaattttttgagtgactgaaccattttgccattttggcacttttttgttggaaccattttcagtgaattttttagtgactgaagcaatttttgctattttggcaaaaagtccaatttttgttccaattcctggaaatttttttgagtgactgaaccattttgctattttggcaaaaagtccaagggagtgaatgaaattgctttggtctccaatttttgttgttgttatttttatttgagtgactgaaccgttttgctacttaatttggaatgggaacttttgcccattaagataatcaacttcgttctttgcagtatggagagcatatgacagtagttgatctcaattcattttgtttgtctagccacttctggtatttggaggttccacgcatgatgtttggtatctccagtcctctttatgatgtaaaaaatattaggattggtagcatgttgcatcaaaaatggtccgcaacgtatcgccatatatcaccttcagtaatgtatctttcacaatctaaccagccaagtcactccctttggaaaacaaggacctactaagtcatgcgtattaaaggagatgtgacatttttctcccctgctcgctcactccacttgtgtgacatagggtaatttggtcggcgaatagagcagaagcaaacttgtcaaaacaaaacagcacaaataaactgcaatttccacagcagcacacaaatgtatttgtttctagtggtgtttacagcctactttaccttgtaataacttacaaggcacacaggttacaatctcctttgacaactatgaacctttttgttttggacagtgggaacctggggattgcattagcacaaggataaggtcctctcttctttatcagtatgctgataggttcacctcatcttacaaccttctcaaatggattgtttggatgattaatccgacaccaaaaggactgctgatgcaccccttcttgtcccatagctgttgtcagttcaaaacgtgtaccatgccaatgaatgaggatgagaaaccgtgggcactaagttagattgtaattaatggtaaactgaagtgaattcttctgaatttttttttctttgaagctatcttctgaaacttttcttttctatggcagaggatctggacaagctgcgagagatggagatgtttggtgagaacggcagggacggtgtctggaccgtgatggcaaatgtaatggacccagagagcttgaaccaagcattcaatggttgtgttggtgtcttccacacatcatccctcattgatccagggggcatctctggctacacggtgagttgcttgacctgtgttagcgttcatacaatatgtcagataagttcccctgcttatttggttcatctgtggaacaagtatgcaatcttgatagtgtcatctctcctacatattaaaatgtatgagccacatccacaagcatcttgtctctattctctatgaatacaagagtgcacaatatgggataggtagatgtcatacctcatgaatcaggctaacacacagcatcacaaatcacaatcctattagactagtaggatatagtttttaattaaatgcatttatagttagagtacactttatgctggtaaatacacaaatcaaaggtaggccatgtgttctagagcagtagtgctatataactgctgaaattattgttggctattgacattatgaattgaccaatcatttcttctccgttaatgggcaagacttgaatatctttaacttaaggatgataagaaccaagtcagaaacaaaagtatctgttagccaaggcaactgactgatcttttggaaaaaatatcaacttttttgtggggcgaaaacattatcaacttaccatgctgaaatatcgaaaaccagagaaaagtcattactcattactggtctatatgtcccactaacacaatacaaaagtatacagagagttttatagaacttaaaatttgtaattagatgcgatgatccaactaggtgttgctctttagggctacacgaataaacagtgcctcggactaggtggtaggtatagcaccaaatataaacccataaataagtagcataatgcttttaagcgtggaccagtgtttgaaacttcaacaaacaaattgactgagagtggtaccacgtaatctttattatatcatatatgatgttgccatgtactttaggttcatctagattctaatcatagatatggtgtttggtttattggttctactcagcatatacagggaaacatcttttagtttttttctaataaagggggaaaatccagcttacatataaataacatacaagaaaaaaaaagagtgactcccttagggcatcagagtattgtctgcacaatcaacacaatagggagaaacagcacaatgacattgacacaatccctacggatattgcaaggaaattcagacgtcagtcaggaacagcaaagagattaaactcaacaacacttgtacagttgtacccactacataggcaatcgaagtgttataggagtcctgagtccatccttacgcctgacatcttttaggtctatcataccgtatatacagtgtgatttgcacctgcagcctataacattcatcctgtgatgcatatgtttcgaagatatgaaaggcagcccattactatctcggttgcagttgaaagctcagccacttgacgaacagtacgaatgtttgttcatcgcttctctcttttctcagttgtagtaactaacagcgcacttgtcagactttttggtcaagactcaagaatgacctgaacaaatcaaatggttgggtggtctattgccttgttccttttgacattccctgcaaaatccatactatttttgcaaccgcatgtttcactattcctcctgtttgcaaagctaatcatactagataaaaaaaaaaactaaccttttcatatatcagatatacttttgcctttattttacgatagctcattatgaggacttaagaggcagctgtggttctagaacaattgctttgctagatttttattagaataggcttgctagactttccagttttattatctatcacagaagtaatttaaaaattatactccctccatcccaagataaaccaacttcgcatgggatatgacatatccatagaggttggtttattttgagacggagtgagtatgttgcatgccatgattcattgttagttgggcagtcaaaatcccgttttagtgagcatggggcattgccatagccttaccaccagatgagccaaccaaagaatccgaaactgattgggcatctaatggtttcagtgcacttgcttattgacgtgatccactgattcctctatggtccactcatgtcaacatacatgttgtagtagtagtagttaagtttcttcaaatatatatttttttgggcaagttgtaatgggttctttaagtttgttgtaatctatattcaaagcctggaacgctgaaaaccgtatggtcttggccagcttcacagaaagaactcttgcaatttcaagtttgtgtgataaaagaaaatgagcaccgaattgaaatgcctttgctttcctaacttgtccacaccaatttcaacagaaacacatggcgattctggaagccagagcggccgagcaggttgttgaagcctgtgtcaggacagagtcagtgaggaagtgtgtgttcacctcatcgctactggcatgcgtgtggaggcaaagctaccctcatcaccgtcgtcgcttccccgccatcatcgacgagagctgttggagcgacgagagcttctgccgcgataacaaggtgagagaggacaaaccaatctcgaattctcaaatcaatattgctgcgtttaaaattaaaagaacataagaacagctaggaatcgaagcaagcattctgaatttctaatggctgggtcatgacgaacattttcagctgtggtttgcgctcgggaagacgatggcggagaaggcggcgtggagggcagcacggggcagagacctgaagctcgtgacgatttgcccggcgctggtcaccggcccaggattccgccggcgaaactccactccgtccatcgcctacctcaaaggtcagtcgatctcggcgaactatactactctctgaatcaatccgatcgaccggagctaagctctgacggacggcggcgcgcggcggcgaactgttcggtgcaggagcgcacgcgatgctggcggagggcctgcttgcgacggcggacgtggagagggtggccgaggcgcacgtccgcgtctacgaggcgatgagcggcggcggcgcggccggcggccggtacatctgctacgaccacgtcgtccggcgcggcgaggagttcgccgagctgcagcggcagctcggcctcccgatcaccggcgtggcagctgcctcgcggcccggctactccgacgacggcgacgtcggcggcgacgggcggttcgcgctctgcaacgggaagctggcgaggctggtgtcctcgcggaggaggtgcacctatgacgtctactaccccgcctcgtacgactaaaaattaaatgaaagcgtcgagttcgtgggtgttgcgattcatcttgtacagaattttggtgcgttaataaacctagctagatagaacttgtacagtacaaaacatgaatatggatagaaattagaagtagtagaagagcgatgagcaaacgccacagtgcggccggaagattgcggagaaagacagcgatctgcagaccatccaaagtcgatgactccaacgagccaaaccaaaattttgttcgtcacgtctcgtagaaaaagccaagaaagaatccgaagatcggagataaggccaaaattttgtcaaatgattttgaccaagtgtatttggatggaatactctcaaaatcaatggtctagtggttcagttcgtcttgggccttgaagaattggcagagtggagatacgtccgatttgggccgaaaacgccctttcgtgacggcccagtagaattcgagaaatcgtggcctcatgggccgagttaggtcgctgcaaaaccgagaccgtctccttcctccgcgcgcgttggcgcatttggtcgagcggctcacgggcgccactccttcggcggcggtcgtggcgacgacggcggagattttggccggacagcggccgtagcgcaaggcgtggagcggagcggggcagtggctgggagcctggggtcgatcgcgcctccgccattgccatctacttgaggactccgcctcccgcggcggctccaatgctccgtccctgttccgcacgggcttctgctactccggcgacaatgacttcgcagccggtttgcctcctcccccgctccaatgattctaccctatattcgccttgtggctgtttctactactgtgttgctagaatggaggggatccccgatttccccgtagtcaaatcaaaggggttagggattcgattgatcccccacctatagcaatgtctgaaattctgattagtgaagtagtatattttattatttcgtttctgttattttatctacctactgcgatgaacatgataatgattctgtttcatccatcttaatagtactttttttttgagaaagagaggaatggtcccatttcattaccgaaattgatagcagagtgactagtactacctcgtatgtatgcatgatgcatctagaacaatgcatgaacactatcccttacattatcaaattcctacatttcacttcaagagggaagctggtacatgtcctgataaccatatactatccttgcataaactgtatatatatacaccacacgatgattgtgcagaaagggggtcggaagaatcacgacgaccaccctaaccaatgaggaccaggagtatagtatttcctggatcacagcatttccactcattcagagagtttcaacatagatcataatctgacatcacgttgttcccagatggtttgccgatctgcaagcaggatatgggagggatggtgggggtggacaactctccaaaggcttgccagcagaatgggttgtacaggtgatactgtggcactatcaggggtttgagctgtattccagtaagagtgatctctgaacaaggcgagctatcactgcatgcaaaatgggcaggcttgattgtgaaggtccccctgatattctcgtactgaacacctaaaaccgccactgctgatgtttggtttctgcaagttgttctgtcacagtaaaattggtctattatgataggtgtttgaacttctgacacttgtatgtttgagaaccttatgccttgaaccaaccctgaacctccctgcataggaatgtcagtgttttttagctctgtgtatatggtggtcattgttggactagtcacatcatctaccagattatgcttacctgccaagttttgattctgacaccagtcattgttttgaacatgttgacatctcttacggtgacattggatacacatgcttttgtgttgtaccttcctagaccaccaatgctgatcccatgccctggtccacagttcacattatgtatgtttatgtcactgcagcctgtctggatggaaacacaatcatcgcctgcatcacagagagcaaatattacttcagatacttgtactagtgtttttagctttcccttagtcctgaatcctgtcggtttctacaagtgagcactgaacagatcaattggcatgtagtttatttattctatatgttacctaaagtaattaattggtagactttgtatgtttctgtttgatgccgatttctccccaccaagccttgccaaaatttggtaacagcttgaccaaacaatgccaaattatcaagaaatgatttatggagccaaattggaatggaattttgtcaatattatgaagcccaatgcttgtcgtttctggttagtgccatcaaaatttggtgggggcgaaagtttgcagctattgccatcaaatcaatcagcaccttctttctttattttggcaaaacctttttttttgaaaaaaaataaatcgagaatgcagcactatattcctatctaacatatcacatttgaaactatactggcttactgctttgattgagttaatgagagcattaccgcaagcgaggttagagtggtgaatgctgacttgtttggaattttgcaggtgtattccatcagtgttgggactgttctcaggcgatgagatggtcaggtcatgaaccattactccttgacagctatcaaacttgagatggcactgtgagctgttaacaatggtgataccagttactgtgacattggaactaccataaaacctcaatgcctgcatcaatgtatgtaaccactgttttaatttgttccagtaggcagttaccaatatgttcaagtatacaaatgcaaccaaattttgcttactgtaggtttaatctgtggcatcttctccagctccacattgtactgttggaaagcattcaaggtaagcaattaaatttgtctacttttgacttgctataagtgtgattgttatagatgatcaggccttacagcatcaacatcatcattgtcgtcgtcatttggatctgaataggtccaccattcttgccccctaccatttatgacaccacttccttgaattgatattccactaagttttgtgaattcaagccattgaagcaaaccagaaccccacactcttgtactggtttgagctaaaatagttccatctagctgcaaaatggaaacacgatatttaataacagcatctctacttcttcaatttgttctaaaatctggatgggtacactatagaaacattccttttgagctcacatctttcgacaaacaaagatacactcagttcctgatggtggttataatatggttattaaacactgcaggcactataataatattgggccaaaatgaaaaaaaaaaagcagcagtttttagtcagaaaactcccaagtaaatatctcagttgagttgaaactgatatatatattgaattggtcaagattgtaaggagtgaaatactacaaccatgtcatttgttgaataaagtattctggtatatatgttttatttcaagcaacggaagacacttattcctgtcaatgatatgccggaatacacattaggacaaggattagagttacctggaacagaatgtttggtttgcagtaaggcccagaaaatgagattgggccaacgacaaactcaagttcagatggtacaagaactgtagatgcctccaccttgcatgctgctgcccatgcttcttcaaaagcctgaatacatagacgataattaagttcaaccttgtttggaaagaacacttcactgattgaatatgaacccaagtatatgctcagataaagtgtagtcagcagtctgctatttcttttagtcatcgctagaacatctttgcagcacgtaactcccaggaggagaaaggaagcctttcttattttagaaaatacattcttatgctactggttgaattttaggataatttttcaactgataacgtggagtaattgaattcagtgttgattttcttgattcttttcaataacaattggacacagcatgaactgacaatgggaatcaatatagttctatactaaattcaaggatagttgtattctgtgataatcagaaaattgcatttgttagcccatgacatttctggtacagtaaagaaatccaacagataccacagaaatttgtactcttgtcaaccattcatctatatgataccaatttttaataatttaaccccaaatcaatgcaatatcgagtaggatttgtaaagacatgtttcttttcagggttgcacccaatcatgtgagaaaagaataatataaacataaaattcaaatcaagcttgttgtgtcatatacagtttttcatgcaagattcctactctgagtaacacatagtgtaatattttcaaaggccggtacgcttcaaagttcctgttaagctctttttaattttttaaaatagaatttcggccatcttatcactgcagcatgttaatgtgaaatgtattaccaaggcaaaataaacatattcttatgctataagaatgaattcttcacaattgagaagcaatcccaatggacttagaactttctttgaagttccaggaaacgcagcatgctatcaggtattgcagtctgaattatacattctgcacttgagcctaaagaatggctagctgattgtaactgacaatagaaactgaagcatatcctaatgttttaaaaaacaaatgaggaactcttaacccagaatgaatgatgcaggtggcacaattttttaagttgaaagcagaacactttgagaagcagtgcggcagttacctgcgtatcatctgtaactccatctccacgggccccaaaatcaaccacattgaagactgtgttctgtgattgggctgctggtggctgtggtggcggcagcaatggaggcagcggcggtggcggagatggcaatgtatgaccacttccactgcttggtggtggcattgttggagccggatgtcctttgccctggacaggtctttcgctcgggttgacgggcacattcgggcttgtactcgggcttggctggtatggatcctgattccctttgccatattgcttgtgggaattgttggtctttcctttcccttttcttcgcagcagagtgctggaggatgctctgttttgcctccagtgcttgccacttcttgcgtcagataaactgacattggaacacagaacaagcaagacaaggagaagcaggaaggtgagacctttaatcccaagccccatctttgcttttgtaactttgtatctctcttgttctgagagaacagtgtatgtacgtgtttggaaggaagataggtgggtgagggagagggatagagtttgtggctttgaggagggaaagagggggtttaaatagagacctccattgtcatctttgcttcctcaaggctggagcagagaaatcggaataaaaggagggcttttctttgggaccccaactcacgtgcatgcttgagaagcatgaattgcattcttgcagctgcacggagaattaaaggtgtatacttgtagtttgtgcttttgtgcatcaccatcacagttttatcccttgtggtttcctttatggtgttctttttgtgagaatcggttggagtaatcacacgccctcattcctcaaggcttggccctgcccacttgccatagttcagaaaaactagacaagacagcttatctgtacttatgtactaacggttcacggggtagggaagtggcatgtctttgtgcctacatggaatcatttgccactagtttattctttgggtagggcatgataaggcagccaggtgattaaactgacaacatgctttatataccagtttgtttaccattgtcaggctattcttgtcacaattttgtcccagactcccagtcatgagaatttacctatatgtgggtcttttttcatgcatgcttcttctctaggaaataacccgtgagtctcattaatacaactactactgttcaggtatccacctcatgatagacctcgctttgaatccaatcatgccctttacacgcaggaactcccaaatgcaggtaatactatgtactatgttgtaactttcttttacaattttcttaaccatattttttgtgaggaattttcttaaccatattattttaacagaatttatagaacaattttgcttcttgagtggctttacatgttcgtcattgcgcgcaacctcaatttttattattgcgggcagacacttgaatggatggctggctggccccaagagtcatgggatgtgggaagcatgctaagaagatccaacatatccctcttggcaagtggaaggtacacttggcatgaccattttctgattttcagcatacaatgtaatgtgcatttataagcttattagagttcgggttttcatcaggatcactggtttcctactgtatggctaaccaattgccgttcacatgctcgcagggatttgtcacgggaaggagtggccggaccaactgccgctaccggactagggagaagggccccccccatcccaagttgcccaacgccattacacccaaacataaacaaagccaccaacctctcctctctagtatgtaccatccacgtcgccctgctaaatctccaatctccaatcaatcatccattcatccatgcaaccacccggccgcgcgtgctggcacgcatcagcaccactcatttgccgtcttcaactctcacaagtaagtggatgcgtacgtgcgtgttcgtggctgccgaatgtggcaggtcatctgcagaaaaaaaatatccctgcatacaccaaaaacacatgttgcgttattggctagcttgccactcctgcatcgtgttgcattgtttgctagcatgcaattcctgcagcgtgcgccactacatgccactgtccatggattaacattggatggatccattaaacttacacaggcttaatgccttagcagcttgcatatgtgataatgtggcatttagcttacacggaaacaacatttgtaacattgtcatgcttcaggttttcgccattatgtatatggccaagatagtcgtcaccggacaggagctgttaagcaagcttactgtcagcagcttgggatggaaggtatgaatacttctttctgccacatttttccattcaaggccaaaaccgttaacatctatagcaagtccttccaaagctggactcgagctgacatggtcatcgtaagatcacagccaatctgctgtgtcctctgcgttagttgtaccagttgcaacaaacccttaaactatgagtagtaactactactagcacccataaaatagcagcagttacgtaccaataaacatatctgcattcaacttacataagttttcttctgtacctgaattgtttggacttgagtggattaacacatcaggcaggcaacagaggaggaggtgtcctagcttttgttggctcctgagacatgcgtgcagaggattggtggctgttcgtctctcgcgttcacgggctgctgcgtcctgccaaatcggcccgattcgcctgcgctgtaagtgtctgtctcttcccccttctgaacattattgaatgagacaccagccgcacatccaatccaccatcgtattattgcaacgccctcgctgaattttcagtagtctattactacctccatcctattgtaagtgtaaccatggttttccgcgtctaactttgatcatccgtcttatttgaaatttttttaaaaaaattaaaagcataagtcacgagtaaagtagtattcatgttttatcatctcataacaacgaaaatactaattataaaaaaatttcaaataagacgaacgatcaaagttggacgcagaaacttatggttgcacttataatgaaacggagggagtacattacaatctgcaatttgctggtcgagttagagataacacgagtttgttgtcagtacgggtagcaatctagcagagtcttgattgggatatgccaacaatttgctgatgcgctgcaagagtacactagagcaacgtccaaggccggccggccggccggcattagccggcacagcacgggccacggccaaagctcgtctctggcttactccggccaagttgcaccggcgattcatcgaatctgccgcacgggtgcatgtcgccgcagtagttcgctggtgcccgtgatagatgcggccgactggccgagcagccagctgcctcccaagttggtaagaattggtgggccgttattttgtttgggctggatttgcacgttggtgccgggcgcatctcaaatcctgcatgggccaggctgtattatctggtaggccatgatatgttccggccttgtggccttgtgggacagatttttggatcaaatttgttcacctgggtacctgctcttggtcaaagttggtggcagggcagcagcattttaacaaatgggaatgtgcagacactgacggtggtccccacccagtagaacatatatagggcctactgaccttactactccagctcaaccgtatctatggttctctatacctactctcgcatgaaaaaccacgacagctgagctacctcggacgttgagcttccctacactctacgtacgtacagtactcctatacagcaagagttctgctccagtacgtaaaactcctatacaacaagagtactggacctacggcttgtgtagtgtgtactcttccctttggcacgtactagtcgattactgttagggtggggtactgcctacgtgggccaatgccttctggccacctaggagatgatgttgacgtggcgaaggaggttgggtgtgggatgactggtggataaatcgctactgcgtgtggggcagtaagagcaggttcaatagtatcgccggtcgatatccatgtccatatcagctaacagttaatatattgagcaaattattcagtacatcacagctctcaagaaacattttttttcctgtgggacccaactgacaagcatcttttatagcattcatgtcactgcgtgtggacccatgaccatttttaaaagttgaaaattcctatcttgcaggcttttcactttgagctcacgtagagttggcgataaaatagtcgcccgttcatatcacctctcttcttctcagttttgctgagatggcggtactattgctggttattgtacctgttctaatgccgcttggctggcatgcagaaaacatcggtcactcggacaccaccaagggtcaaggaaagggagaatcagcatgtctcagttctcaagatgatttgcagagctcactgggatcctctgtgcctgccaggattttcgtcaaagagatgcaagtgctaagtatatcatggttatccctctaagaccaggtacaatagaagattattagccagctgcaaatatattttaataagataaaagacgagagagaagagcagcgggctacagatctgtaaccagctgcaggctgcagcacggacttaaagacgcaatgtgtgcatgacaggtgcgaccatatataaatagtatagtaagcaactattgtattaattgtctattagatcggctatagatgaattggaggtagtagtgggctatattattaaacttgctctaagagcgagtacaatagcaagctataagttaagctgtaagcatatgtggagaagagaagaaagaagagagaaggaaagcgggctacagatttgtagccagctgcagcacagactccaatacattatgtgtgtatgagatgtgggatcatatattaatggtgtagaacgagtataaatagcatgctacaagtcagctgtaagtacacgtggaggagagaagagaagaaagagaagtaaagcgggctacagatttgtagccaaatgtagcacggattccaatacgttgtgtgtgtatgagaggtgggaacatatattaatgatgtgtatatgcttataggtaactattgtatgaatgagctattaaattgactatagatgaatgagctattagattgggcaacatatcctatgcacacaggccctcacgtgtacacacgtgcacaccaactaaaaaatgtcaccaaaaaatctagaaaaaatcatacacatactttcaattgtattacacctagggttaaaatcttaacgtcaaattcattatattttagccgtaacaaaaaaaaacaaaaaatctgacagttttaaggttacaattttgtcagaattttatcttttttgttattctctatgtaaaatgaatttgaagatgcgactttgcacgtagatgtaatactattgaaagtatatgtatgaattttcctagaattttttgtgataatttttagttggtgtacacggtgtgtacacgtgagggcctgtgtgcataggatacgctcacattagattggctataaatgaattggagctagtagttagatatactattaaacttgttctaagagtaaggataatggtagagctcaattactaatattagctcatcttaaatctaaatatacagtaatagattagttataaggttggctacaattttcttctctcctctctctatctcttagagcaagtattgtcttataaatgtatattgtggtgcagattttaaatcctataaatgcttatatttataagagttttataaacaaaatgcttatgttttggaagagatgagtattttgggacggagggagtatataaggaaccaggagaattcctgcgggtgaggtagacagaaacaagaggagtacagaatttgcatgggtgaatgtcgttgtataccctagcaaatagcagcaatacatgaggtagggtacaaagaggtaactgcaaactgcgtacctctaactatctcaaaagatgctctccctgtatatctctcgtgcttaccgcataaaaccattcttaaagcaatctcgaggcctttttaggcgacagccttttgaacgacgatctccttggaacaaccaattgataattgtcctctgatgcattgtaaacaatgtgctcgcagttgtactacgctaatctactgctcgtacttaatcaattgatggtttagctgaatgttttgtgatcacacgtgcacatccatgtgagtttcaagtttgtctagtgcggactagaggttgggcttgataatgttgcattctctcctactggagtatagtacatttataattttattttcaccggttttttcaccatcacattttaggaatagatagcataatcattaattacaacttgcggttcatgactcctagggggtgtttgggaactagagactaaatttagtccctctcacaaaagtacaagtccctatggtagggacttatgtttttgtgagagggactaaagtttagccccactttagtccctccaactaaacaccaccctagagtcttgactttatactacgctattctttgaactttcttttttttgtaaggcatttgaattggaaatttcatactttatgaatttaatcaactgttaaccaagatataagtacatttaatttgcagtacaaactataccaataggtacatactccctcactcataaatattggtatgcataaattaggaataagagaaaaaagattctcttccagtcatcttattgattaagtgtttgtttactttgttgtcaatttcaacattaccaaattttagcaatgctttaatttttataagttttgacgttgtcaaattttgatagtgttggatgtagtttgatgcctttctaaaatttggtagtgtttttgtgagaaccaagttttgaaactactaaaatttagtaaaatgatattggtaaggtaatgtttagtttgttaccctaccaaaatttactaggatcgaaagtgataataaaatgaacgtaccctaaattttgagctttgaattgcatgtatacccctcttacacaattgattggctgaaaatgcttgacctcccgtgcattgaaatcattgtcttgaatgtattcgggaacagatgggggtattcaaattagttttgcatgatattggtttcaattattactcctgtactacttattctatgaaaagtccatgttaacgtttaattttgaagaaagttttaaaatatgtagttctgtaataacgttagcgttaaatctataattttgtgatataatatctttaatttttagttttgtgatagtttaatcaaagtatatgtggttttgtgaagtttactctaaaattaaagtttgtcatacaaagatataatccaaaagtagtataatttttttttgaagactcggatagcactagagactagagtccatgtgttcatctaaaacagacctcagggaggggaggaaggcaggaagcactgatcttctccgacacatgctattctttccatttgaagtgtcggaatccagtgcacaaatcaaagagctttgatcaagacagacgattagacgaacccttgaacgccatgaaaaagattgcgtg

SEQ ID NO: 41516 - DNA, 5916 bp, Oryza sativa
  unsure (1)..(5916): unsure at all n locations
tagtatcttaaaatcctgactactatctccatcccaaaatataaaggattttagctggatatgacacattctaatacaataaatctggataggtagtctgtctagattcattgtacttggatatatcacattcacccaaaatcatttatattttaagacggatagaatattataatccgagttgcacaaaatcatagtgattttagcacgtggcaagtaaaacggataatagggtagttttgtaaaattttagaaccataatattcggttacgtgacttgataaaatcactgtggttttgtacaatttggatcaataaaaaacttaataaactaggatgaaattttaaaatcaactttaaaattatattttaaaattcaaattgtagtcttataacccgaaaggcaaacggtggacgactaaaaaattgaaggcagcatatgtcacgagattagcctgtgatctcttcctccctttcgaaacgaaactgtgcattcgtacagcgggtggaatgtgctacgtacaggttcggttaagcagaaacagagagggggcagtagtagtatcatggagcggcgtgcgcgttaacaaggtacagcagcgtgtgggtgcatcacgagctgtaccccccgctacgtgttttttctttctttcacggcgagacgtgacactgctgctcgttttcccactggcgcgacgcaagcaaaagtttcccaaagccggcggccggaggcgcaggggaccagggacatccagccccgtgcccgcgcccgcgcgccacgcacgaaatcagcgtgtaccccccggtcccgtgacgttactggactagcagcagcggcaaggagtaaatctgttgcgatgccggtacacgaacacgaacgtactggtggtacggagtctacggactgcgtggtggtacacgggacgagtaatattctcatgcatgctgctgctggtggtggcgcgcgatggatcaatcacgttgcacgcgcctcgacgcgacgccagcggatacgtacgtctttccggtggcgcggcaggggcagcggcagcagcaacaatccggtgccgcgagcgcctcgtgatccgcgaggcaatacaagtattccttccctatactcgctcatcacaagtggaggaggggaggcggggcaatagctgctgctgatatcggagactgttccgcgggtcacatgccgcggcttttgaccggacgcgtcgtcgtcgtcgtcgtcgttgtcgatggtgtggtgtgttgttgatgggtgatgggtttgcgccgctgcatgccagtgcgaggcagagcggcagcgagcctgcgacgctgcggctagttccccctgcgacgctggatctccggtcatgttagcatgacgtagaaggcgcggaacagtcactagtcgggggtcgtcattgccatatatgacgcgcctgctcgctcgattcgacgcctgttccaaggaaggaccccggtcaccaacccactcggggccggggcatcttcctcatccccttgcctgcatccattcgtcatttgattcgcttctctgagggcacccacgatagttatctataggctctttataagagatatatatcagcatatttttctacttggaagagattaaatgaaaagagagagcaaagctagctactaatctgtagatagtttatagagaaaaacgagacaatagattagagagctatagatacccatatagatatactattaaggtggtttactattaatattgtctattaccgacatgtacatgttttatagagagcaccttattttaccattacgggtgctctgagtatctactactcatacaaaaaaatatatgaatatctactattttcatctcataaaaaaaataacctactagtgaatgtgaaacattttattaatataaaaacatatccaggtttatatagtattagaatatatcatatttgatactaagttgatttttatacaacagaggaagtacatatgtccaggacttaccaaatcgtttgggatagggttaccgtcacaccacggtttgaccgttaccgcgagttataccctggtttcaaaaattaaaaaaggttattgcacatcataaccatgatatatcagcacggttttgtaaatcctctctctatctctatggaatactactcttccaatttttccattacatcaaaactttcctatacatataaattttcaacttttccatcacatcgttccaatttcaaccaaacttttaattttggcgtgaactaaatgcaccctcaatctactatgggtcaagtagagacatgccctataaatatcaacatatttagaaatacgataattaccatattataagaaactgtaattttcacaagaatacggtaaatacggaaacgaacggtaaaacagtaaaactatttccgtttttattttcatatatttttttatcgattatcattttcatatagctcgactgatagaaagtcaaaaacggaccctccctacttgtactccgtacgttgtagtacgagtacactcctacgtctctctctttctccgtgtcttcgggcgtggatggtgtgcgctagctatagtagagctccgggataagtgcggcgtcgcagatggcagagacggggtgatatcgcagcggtctgcctcgaccagtcagtccatctagtcgagcctcagcctgaacctgccgccctgtcacacacagcgcttcgcaccagccgctcactcattggctactcgctgtactccacccctttgcatgccttcgcatctgttctcgtgcacacacgccctttccacccctatattcgttccatcatcatagcctagcttaaccagcatctcgttgcaatctcaggaggtgttttgattcaggagcttgaaattttaacgtgttacagtgcattggatatcggatattatgttcagatactaataaaaaattaattacagaattgattaataaaccacgaaacaaatttattaagtctaattaatctgttactcataaattattaaatcatggagtaattaggattaaaaattttgtctcgtaaatttagtcgttatatgtgtaatagatgtttttagcctatatttaatactttatatatgtgtttaaacgtttgatatgatagggtgaaaaattacgggcgggatcgcctcagattatctcagccatatcctatataacctatgctagctgctcttctagtccaactggtagagtgttgtgaatagccagttcagttcatcagttgataggagccatgcttcaccattactacagcggcggcgccggccatcatcaggacgtcgctgcagctggtagccccggcgacatggcttcctccaccttctcgctcttcttcccgatgtccaatgggcagtgttggccgccgtcgacggtggaggagtccgcggcctacgacgaccacagcaccgtcaccacctctccttcctcgccttcgtcgtcctccaccggctccgtcgactgcacgctctcgctcggcacgccgtcgtctcgccgcgccgagcccgtcgcggcggcggcgccagcggcaaaccatgggcgcccgtgccggcgcattatccgtcgctgtcagcggcgaccgtgtcctgggacgcgactgccgagtcgtactattgtggccagcaggggaggccggccaccggcgccgccaagtgcgccgccggcgccgggcacgacgcgctcctcgaccgccgctgcgccaactgcggcaccgcgtccacgccgctctggaggaacggccctcgcggacccaaggttcgtcgccggcgacgctcgctctcgccgtcgctgttctctatctctgcagttcacttcgcggtttcgccgacgtacgtcgtgtcgctgacattgccgccgtcgtacgtttctctgcagtcgctgtgcaacgcgtgcgggatcaggtacaagaaggaggagcggcgcgcggcggcgacgacgacgacggccgacggcgccgccggatgcggcttcatcaccgcgcagcgtggacgcgggtcgaccgcggccaaggcggcgcccgccgtgacgacgtgcggcgaggagacgtcaccgtacgtcgtcggcggcggcggcggcggcggcgaggtcgcggacgcggcgtatctcgcctggcggctcaacgtcgtcccaccggcggcgacggcgacggcgttctcggtgtggccggagcgagctagcctctaccactacaactagctataggcgattaactagtgtagcattagcgttggggagaagggaagctgcaccgtttttttggggaacattttgtacggtcgcacgctcccggattgatcgaactgtatgcatctgctgtgctgtgttgcacgctagctagctagatgactctgatcttgaaacgaaccgtgatcatttcattcatttggaatgaacatgtagctgtgcaaggtcatcttgctcggaaaattcataatcttccaatctcttgtgctgctactactgctgcatctcaattctgacgcgccaataagcaagtgaagagaaaaggaaaatgttttaaaccttttttggctactatacttggttttcaaggctaaatagattaggagaaaatggcccaattgggccggaaactccatcgagcccaatggttatgtgggctgcacagaatgggctgtcccagtagatcggaagtacggaacggctgaaatcttgtaaaccgaaggggttcgaagattaaaactcggaccctcctagccttgattttctttcgcggattgacacgccgagtgattagaattcaggattagcgagttggaggctgagtacaaaccctttttgcctcttggacagcgctaggaattttcagcatcgtgcaccgactattctaccctgaacttctgaagagcgacgagagcctgaacttcgaagcggtgttattttaaacccttttttttccttaagaccttcgaatttaagaccttattttttccttcacattttaaatttaagagtcttaagaccttcgaacttgcaaccagtagagaggaaaatcaaatgcacataatcagaactaacaaccctcagctatatatttgctcaaaattcatcatacggcatgacatattggcatcttcattgttccatccatccacatggcgtgcgtgacaacttgcaatggtccattatattgtctcttgctactgctccattctatatttctattgcacatacatgaacacatgatacaaaattacaaatgcaaccaatacacgcttgccttagatacacatgaactcaagaattcaaatcttgatgcctaatccgatagctcacggagccaaatctgttgccgactgacgtgcaccaggctgatcgccagacaacgttggcctgagcttcaccggaaagaaaatgcaatttcctcaagtgttcttcctttagtctccggcacccacaggcatacgaaaacgagggtcccggcacacacagcagcatagatagcaaatgttcctgaaaaaaaaaaaagagcatacatagtgacatgagcctggaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41517 - DNA, 796 bp, Oryza sativa
tagtccaccaccttgtgaagcttagccggaagatctctgggcgtttcttaagggagttaaagtggacttattccatccaaaacatggttagcctatttgggtagtatcgatctctcccgttctttctttccttccttcccttcccttttttttcttttttttttgcgagaaccccttcctagttcttacatcatgattttctcttctgtagacaaactcaaaatccccacgcactatatatatacgagatacagaaaaacccctgatgaaattaagtacaggcttctacccacagttagagaatgcagatattggaaatgaacaattcccatataattggagattggaattgaatgagaatcctgctgagtccggtgattcatacaccaaaatctacggctcagtatcaaaccttcgatttgtgccgttaccgtggtagcaggcgtaggagcctttcggtctgtcaaacggtgtgcacaccaatggaggcccaaggatacagtcgtcacggtagtgccgcaaagctccgtcgatctggttctcttctgctgtttagtcgcatatggaagtttgtttccttagattggttaatctttacctcattaaagatggtgtttctgctacctttgtatccatctgtgatgtcctggggtgtatccctttaactctgtctttgttaataaagttgtttaagtttttttaaaaaaagagaatcctgcggatagaaagcattttgacgtcaccagaatctggatagagtttaaattagctgaaacgaaagccagggctgcaggaa

SEQ ID NO: 41518 - DNA, 11189 bp, Oryza sativa
attctcaccagtatgacacttccctttcagctaaacttccttgagctcctccaaactccaaacccacggatctgatggctcccacagcaaatgagctgaagaacataacgcaagcaacatgatgtgcatctcattcccatctccaactcttagggccatgaagatggaacaaatttgataggcaataaagtttcgagaaaaaaaatgttaggtgatatgaatgtttgaattcaaaaggaactttccctacattataggtgtcacatactttcaggacatggacttttgctataaatttggagggaaaacaaaagatgaaaattaactatagaagttccagagttctatgtctattttccgctgctcagttgaagacagcaagcgttctccttactgttaaaagcaccaatgttccatacacctcttttgagcaaacactgcatttcctatagcattatattgggaatgccatcgagtttctatgttttttatttttcttcattcgagaaagcaaacatttgcatacaagtatcgcagatgctccaacatcatcgagcgacttagatctgaatgtgtttccttcatcttaccaaaagcaacctgattacatttacatctgaaccatcagtaaaagttaattgacacttctcttatgttcatgccaaaactctactatcaggagatgccaagaagagaaatcgtaaatataacacctggaagcaagaatactatccaactaagttcaagtttcagaggggaaaagccaagttggacaccatggaccgccgtgtactgcaagaggctccgccactagagtctctgtcaacaatggcgccactgtcccgtctctcatgttgtacacgccagagtccaaaaaaggatcttcaggcttcccattcttgatgtcctcatgcatgaagtagatgcagtcttcttcagctccggcactgagcgacttggagcagcccttgctaacaaagagagcatgccccatcaatgtatccaccttgatccaccttccacagccactgctcaggtctgcggcttcaaagacttcgaaccgccgtgttcgcttaacaatgccactgtcgcttggatagattggtggaagattgatccaccgtcgcaccatgagcagccgatcgttggacgcgacgagatatcgctccgtcgcgtacctttcggtggagcaagggccaaaccatgattcctcgcctatatctttcagggtgctgcttatgcatcttatgccaatctgcttagcattatcgactccaaagatatagagctcctcctgacgtttccttacgtcagatgttaggtagtagagcttcccttggaaggatgcaatgtcgacgatggagctagggaaatgtgcaagtggaggtgaaaatccaatagtgacaatgaccttccaagtgcggtttccgatcagcaaagcggtgaagttatcagacaccaccgccttgttgatcagcgggacaagtcgttgcctatcggcggcgaggtatttgtacctgatgtatttagggagcacggcggcgagggcggcgagaggggtcgttgccaaggaggacgggttcatcagggagagcatgccgtcgccgtgcacgatgaggaggccgcttcccgtggaagcgaggtgcgtggcatcgccggggacggcgggcaagcggtgggccgcgccgtcggggagggtgatgaaggcgccgccgcggaggaggagccacgggaggggcggcggaagaagatccagctccacccgcgcgctggagcgccatgggcggcagacggcgcggaggcggacgcggtcggcgtgggacggcaggcggaggagcacgaggcccaggagctccgacgggaggtccggccatgggcgtccactgcagggctctggtgtggccattattgcctgggttggcggaggctgatcgtcggcgtggagctctaccttccgtttcttcgagggcatagtctcgccgagttgtggggacaggtgcatcgccggtgggagccgccggcggcgaggccgcgataatcggcgatcgccggcgaggttggggaattggggtttctcgcgtaggaggaaatcgtatagctgctcctgcctctttttattattttttttttgagagagaggaaatcgtatagctttcttatatggagaaatcgagaaaggccgagtacgagtaggagtaggccgtaagccagtaaccggggctagtaggccctaataggcccatctatgggttggtttgtgtataatctctcccgtataccttaccagttgattgatcaatgtagcacatcatgatatggagctaccacgattctttggtacaaagaaacaaggagtaaactgtccagaatgccaaatagcagaagagcacaaaaccatatgagtaactaccgaaagataatcagatgaaaacacatcatgatacaactacaaaacacgattatagggtccagactgatgtcaacgtccaagccattgcttcaaagcaaattattttcttcctcaacagtatgaaagttcctttcagccaaaatatatgtgaatgttgattttcttttcagtttgctctgtagctgaacaattgtcgtttccagtaatggaaaaggggagcgctgtgctcttctgtttcaaaataaataaataaaaatatgcaattcataaaaatctgacagttcccatagcaaatgtgcaatgtcccgctgaataaaaaatcggtgcacttatacacactgcacacaagttggaatttatcttctcctatggtcatatagattgaaggaattttataggaaaaaggaggattaaattcaaaaggaacttccctacattagaggtgtttacattatgagattgcaccatcgagacccctacagggcaggaaattttgctatgaaatttgaagggaaaaaaatgaaaatcaattggaagtttcatagttctttgtctacttttccctgctcagttgaagacaccaaagcattctcctaaaattttgatgttaaaagcaccaatgttccaaacacctcttttgagctaatactgaaacactacacttttcctacaagcattatactggtaatggcattaagttcctacatttaccctgtatatgaattcgtgttcctgcatttgagaaagcaaacatttgcatacaagtactgcaaacacatagcaacaaaacagtatgctgcaacatatttcattaagggacctagatctgatcatctttttccctagtctttccagaactcacctgattacatctcaaccatcattaaaagtttaactgacactttgtccttatgttcatgccaaaactctagaacaggagatgccaatcgcaaattgataccttgaactccggaagaaagtatacagtccatcttagtttaagtttctgttggaaaaagccaagtcgaaaaccatggaccgtcatgtgcagcaagatgctctgtcactgcagtctctggcatcaatggcgcaaccatcccatctctcatgttgtacacgccagagtccgaaagaggatccttaggaatcctattcatgatgccatcattcatgaagtagatacagtcttcttcagctccggcagtgagtgactcggagcagctctcgctaacaaagagagaatgccccatcagtgtatcaacttttatccatcgtccatgttcgctgctcaggtccaccgcctcaaagacatcaaatcggcgagtccgcttgatgctgctatctctcggcagcatgggcggcagattaagattaatccaccgtgccaccatgagcaaccgatcgccatccgcgactagatatcgatggaacgtgtacctgtcggtggagtgagggttgaaccatgcttcgtcttcatcgcccacatctctaggagtgctgtgtatgcatttgacatcagacaccatgggctcctcatcgcggacttcaaggatgtagagctcctcctgacaattctctatatcaaatgttaggcagtagagcttcccttggaagagcgcaatgtcgaggatgtagctagaatcaggaggactccacttcaccactgtatgcggctgtccagaagtgatgatgaccttcgagctgttgaaatagaaagcaatgaagtgttcagacaccaccgccttgatgatcggggtgattctccgttgacccagttggaatgcggtgtcagggtatttgcacttgatctcgccatgaaagaccgcggcgaggtcggggagaggggtcgtcgccgaggaggacgggttcatcagggagaacatgccgtcgttgtgcgcgaggaggaggccgctccctgtgggcacaaggtgcgcgacatcgccggggatggccaagcggcggtgggctgcgccgtcggggagggtgaggaaggcgccgtcggggaggaagagccacgggagcggcggcggcagaagcttccgctccagccgcgcgctggagcgccatgggcggcagacggcgcggaggcggacgcggtcgccgtgggacggcaggcggaggagcacgaggcccaggagctccgacgggagatccggccacgagccaccattgcatggtcgctgtgcggccatcgcgccggtggaggagatgctgcagcggcggaggccacccgcagagtacacgtcgccggcgagcgatcgaattggggaattggggtttgggtttttttttctttttctttttcttttttctttttattttttatagagagagagggtggatttgcggaattattcacggcccatttgttgattttcatatgggcttggaagagcggccgtgcagtgtgggccggtagtgcaaacgtctcattttcttagaatttctcctctctctttttttttttagcttaggtcttctttaatgtttacaaactcagttcaatttatacatgattcagggcaaatacatgtcctatgttcaaaattccaaattaggcttagacctgtgactgttggttggcatgtctcttgccgtataccttaccagttgattgatcaatgtagcacatcatgacatggagctaccacaattctcaggtacaaagaaacatggagtagactagcaatgtcccactgaattccaacgataaattcgatctcagcaaacaaaacaaaggacagaccccgggtatcaagcatatacacggaataagatgatgaactctacactttctgaagcgacagccaaacatttcatcagaacagagtgattaacaagtaccacctctatattttaatgtatgacgccgttgaccttttgtccaacgtttgaccattcgtcttattcaaaaaatttatgtaattatcatttattttattgtgacttgatttatcatcaaatgttatttaagcatgacataaacattttcatattttcacaaaaaaaataaaacgaatagtcaaacattgctaaaaagtcaacggcgttatacattaaaatacggagggagtactaacattatttaagcatcatccatcagcctatctacatgtaatatgtccatataggatacttcaaaatacatcaacagccgcatgccacacagtacgacggattacattcagattacgtagcaacatcagcagggaagaaccatgcaggatccccccggcctgtaggatgcagcctcggcgctgtggcatcctgcaacaacggcgtgatcaccccgtttctcatgttgtagacgccagagtcacaaagaggatcaccagcataaggcctccaataatcacacatgaagtagatgcaatcctcctgaggtacaccacattctgcagcagggagagactaggaacaatgtgtgccgacaaatagtgctcgaccccccaaagatgtaacccttctccacatgcgagagccggtggtcaagtccgcttcaaagaccttgaatgaaagagtacgcgaatgtttgaaggagttgggctctgcaagagggagcacaatgccaacataccgtgtcaccatcaacaggccaccaccagactcaactagatagtacctccgcataatgagataatcttctggaaaggattggggttcagtcgtcgaatcatcctgggagtcaattatgcattcaatggatgagatctttgggttacctatgtggctctcatcaatctcgaggatgaagagtttattgaaattatttaacacatatagcttcccatccaagaaggtgaaatcctgcatgccctccattgtagaaccctcgactctgaatgactcagtggcaactggaggctggcatatgcacaatgccttttgatgagaacgattcatgatcagtgcaacaacgagggaagttggagaaaagtccaggggagagggcactgccaacttataaaagagaggaaacttgggcgcagcgtaccatagatgatgacaccaaatggtatcaagtttaggaagctgcaatgtggccttagagaacaggttcataagcgagaacccaccatcgtcgtggctaaggaagagccagttgtcaatggagcaatggcaggaagcatcatctggtaaaggcatgcagtgaatttcaccatctgaaatgctaaggaaggtcccgttgaggagagtgagccaagggagcggagggggaaggggctgcagccgagcattggagcgccatgggcgacaaactgctcttagtcgaacacggtcagctaaggagggaaggcgtgtgaggacaagacccaggagctctggctggaggtctgcccaggatgaagactggacagctgccatcatgcaagacttgaaatctaacaagaaaatacaaagagttcagaatttaacaaactactctgcacttaaaattactaagcacttacactatttacactatttctgtttttttttttttgcggggtacactatttctgtgtttgatgaggctagaacagaaaggatgattctttcaagtaatcagtatcatcaacagcacttctaaaactatcatcaatagcagcagcatcattaaatcctggcgcattcccattttcctttcattagggaaaggggcttcttgttccacaggaaaagaatgaaagcatatcatttcattctttcatacactggcggttttttttttttttgaatttgaagtacttagcacactaaaatgtgttctttgtagtggggtagtgaatggaatgctaagacctgtatacagatgcattgtggatgcacatatggaccaatgcattaaaatttctagtcttaaatctgacacgtttccccgcaaaataaataaataaataaataatctgacacgttccataccagaacactagaacagatcagttaaaaacaagcacgaattcggagagaaacctgtagcaatctgctcagctaggggaagggctggaggagattgaacatgcagaaaaccacagaaccactcctcgcacagactagcggcggccccccgtacccaccacccagctgcggtggggagaactgccgccggtagccggggagagaacgccgcagcggagcgaggtagacgaccgccggcgaggatgaggagggtgtcagctcatcgagggttcgccgtcctcggtgatgcacctcggtgcaggggggttttggccaagttgggccgcggcccacgagtcgatggaatctagaaattttacccctagttttctcgtaagctagtgaaggctcctttaaaatggagaaaattttacatttttacatgaaatgaattcaattcttataaaattgcaccaaaatttctccatttcaaaggtccaaaacttaggatgtgttcaccagttggagttgggaacacttccccattgcacgcaaaacgaaacaacgaaatcaagtattagctaaaaaaatgaaaatggaataatatgatttttgaaagcaacttttctatagatttttctttttgtaaaaacacaccgtttaacagctggaaaaatgtacacacgaaaaaaaacaagaaaggggaagttgggaaaatagactaaagaacacagtcttagccattagggctgcaaggccgtggacatcaccgtttagtcgctatctggcgcaacaacgattcatcaactaataccacctggagtagctcgaattacatagaaagcggacattgcaataatttactgaaaaggattgatcgagactcttaattagttccatgactataaaacgccagaattcgaaatgtatcctttttccagctctaacctctagtttggttgatcagtgactcagtatgaccacactatatgagttcttgtgacttgtaacatgcacatccgttgccttaaaaaaatgcatttctgtagtaattgtcaatctcaggaaaacataagaaaggatggataagtcaagtataaaatgagaaacatgaactcaatgctttctgaatccagagcaaatcattctagcataagagtagacatgacaagtagcaaaatattaagcaacatccgccggtttacatgttgcaagtgcaatgagaaaacccaaatcaaacagtcaacagagagtgccatgaaatggggctgattacatttacatagcaccatctgcagggaagaaccatgtcggatgcccctcgcctgtaggatgcagtcgcggcgctgtgttctcctgcaacaacggcgtgatcaccccgcttctcatgttgtagatgccagcgtcgcaaagaggatcttcatcagatcggaagtagtcatcacacatgaagtagatgcagtcctcctgagctccaacatattcagcagcagagagagacttggagtaatgtctgccaacgaagagtgcttggtctcccaaagattccacccttctccacatacgagagccggtgttcaagtctgcctcatagacctcaaatgaaaaggtaagtgaatctttgaagatatcatcatcatcttccggagggaatgggacaccaacaagtcgaatcacgttcaacagtctgccaccagatgcaactagatatggccatgtcacacagatatggttctcaggacaaggttgagaatgggattcagttggaaaatcttccactatgcattctacatgtggaacctttggcttttctatatgtacctcactcatctcaacggtgaagagcttcccacaactaagtgcatacagctttccaccacagaatgcgatatcatagaagttgttcttgattggacgatcatgaaatctgaatgagtcagtagaaattgatcgatgaacaatacaaactacactgtgacgaagagggtcattcatcagcacggcaacaagggaatctgatgataagtccaggggcaagggcactgccaacttatagaaaagtcgagtacatgcattgtacgcatttcccctctcatgatgccaaatgcgggctagcttaggaagctgtagtgtagccttggagaaagggttcatcagtgagcacccatcgtcactatccgtgaggaagagccagttatcaatagagccatagcaagaagcatcatctggtaaaggcatgcggtgaatttcaccatctgagatgctgaggaaggtcccgtcgaggagattgagccaagggaatggaggggggagggtcagcagctgagcattggagcgccatgggcgacacactgctcttagtcgaacacgatcagctaaggagggaaggcgcctgaggacaaggcccaggatatccatctggagatctgcccaagatgaagactgggtggctgccatcatgcaagacttcgaaactaacccaaccaaaaaagacaaagggttcagaattttacaaaaaaaaaaggacactaaacattacaacaccacttcaccaggtagtgtcatactatttaacatggcaaaaggaattgtacttagtcatttgctaaaaaaaaactcaaggtgcatgactaaataaaatggatgacctgacatcatgcaagactgcaagtctaacaagaagtgacaaggtgttcagattctgattaggtaaaaactgacatcatgtatgcaaagagcactgtatactttttttcacaaggcaaatgcaactcaactaagcttttgtcgaaatctcaaggtaaatgagtaaacataaacaatgattctttcaactaactattatcatcagcagcaacctaaacgggtaatgacgtactccctccgtcccaaaaaaaaggcaaaccctgggtttccgtgtccaattttgactgtctgtcttatatgaaatttttttataattcgtattttcattattgttagatgataaaacatgattaatattttatgtgtgacttgtctttttaatttttttcataattttttcaaataagacgaacggtcaaacgagttggacatggaaaccagggtttgtctttttgggacggagggagtagtgaattagacgatgcactgatggtatactaagtccaatattcagaaacgatgcgcactatatgatttcatatgacaaaaacactgaaacaaggggatatgctcatgatcatcggtaccgcgcattaaaaaaaatccgtggttctcttacacatcaaatgctccatgccatcttagatcaaccaaaagcgaacactaatttggctaggttaaggtatgaactaagcaccaatccggtcccttccggaaaggaaagtgtagcaaccgctcgagtaaaggggtgtacctgcggggcttactcgtgatcgcctacttgccgccggtcgccgagagctggaggagatgggactagtagggggtagcgcgcggcggagaagaggaagcggcgcggagtagcagcctccgaagtaggcgggggcgaggcagatctccggggagggggatgaggaggaggagcgcgtcagttcgctggggattcgccgcctccggcgaggggcatcgccggcgagcggttcaggaggcggagcgagtggtcgaattgggaattgaggtttcgtgttttttttaaataaaaaattgatgggaaggttttggggaatttgtgaagcgaggagatgaattttttgggccatttgttgccactgcagggtgggctggtgcctggtggcacaagccacagcccacaaggcctcctttacagtttttttcttttttgaaaaattaggcatcagtttttttcttttcttttttttgagaacgcatcggttcagttgattccatggagaaa

SEQ ID NO: 41519 - DNA, 6846 bp, Oryza sativa
aaaggccttaattacggctccctccattttttcaataaataacgcttttgattttagtataacgtataactattcgtcttatttaaaaagttatataaatgttgtttgttttgttgtgaattattttgtcattaacatgcattgtactctaacatatttacactaaatttttgaataagatgaatgattaaatgttatttcaaaatgaatgattaaatgttattccatgtctataaaatgccagaattttatatgtatccttcttccagctccagcctcctgtccgattgatcactgtgaataagtgaccccagcagatgagttctcgtgacttgtaatatgcatatccgttgccttaaaaagaatacatataggttattgttgatctcagtaaaacagatggttcaagtatgaaaataaagagaaatatatcctgtaatttctcactgacaaatgctcgatcctacggtttacaatcgacaagttctacaaattctgtaagttccacaaaatcccagcacaagtattttctttctatttgtccgtcatacataaatgcttatatttcggaatagggagcaggtgttttggaacagcaagccttgatgctcctatttttctttcgaatcatatacacgttgctgatgtgaaaaggtaaaaaagaaaaagtagtaaaactgcaaccattgtactgcaatcattttagcaacaaactgcatctcagcattggagcgccatgggcggcagactgctcttaatcgaacacggtcagcgtgcgaagggaggcgcctgaggacaagaccaagtagttctggctggaaatctgcccaacttgaggactgttgtttagataccataatctaagaagaaaatgcatcgaagtcagagtttaccaaagtaaatcatcatagtaaattgcacatgtttcttccatgtttagaaaaaaaaaatggtgcttattgttgtctacacagtaccaacattaatcagcatctcttgagaacagaagtgcgcttagcagaagggttggtcctttccgcgctaataataactatgtgatggaagaattagcatagtaagtgactatatgatctgttaaacctatcagcctatttatttttttcgacaaaattataaacaagggcatctttctcatcaatactaggtgccacagtggaaaatgttacgatctccgtcctaaaatataataatctagaatctaatggttctggtattacgaatctagacaggaaccatccgatcctagggagtagtagattcagggaaattgaactccagcactaagatcaaatcagctacaaagggcaacagaatctggcatttggagtatcgatttgtcgaaataaaattagggcttagtgtaagggagctcacctgcttagtggttaggacctgatgaacggtcggtgagaggggacgaagagcagggaaccaaccaagaaccaactccgtcgccggagatcgactagtagcagcagacgctcagtacgtacggccgtggaactcgtcgccggagatcgactagccggcaacagccgctcgtgtccaggcagtgcgccgtgcgcggtggctttctccaaagtaggtagcccggggaggagagggttgagggacggcgtccgcgcgccttggtgcgctccggcagggctccctcgccgtcgccggcgagcgcgcgatcgtgtcgcggcctcttggtgggaacagcgaagagcaggggaaaaagatggcgtacgaccctagcatagattggttttgatttgtgtttaaaaaaaataaatttcgtaaaacccacctattatatgctaaagtagtagtacaagtagagggcacttgatatagatttaaaaaaaatggataaatgcgtaaaaccacgctattgattattatccacattttctgcagcatattagagcaagtttaatagtatagccaactactagctctaattcatctatagccaatctaatatctcattcatacaatagttacatactacactattaatacatggccccacctttcatacacacaccgcgtcttggagtccgtgctatagctggctataaatctgtagcccgctgcccttctctctccttatttatcttcttaaaatatatttgtagctggcttatagcctgctattgtacctactcttatagccttagatattatagctattagtttttacaaaaccatgctattgattattttgattttaatctatcatacttctaagttctataataacattaaatttatgagtttttttatccatcatttaactgatacgtttgtcagagttatggataacacatatctaatagtagttaactaaatctcggcaggacccaccacatatcatgtcttatacggaaacaaccttcggatatagaaggagttccgcataaggaatgataatagagttctacatggaaacgacaagtactactcagattgtatccatattagttttcctagttctacttggataaggggacacctatgggtataaacataagacccctaggaggagaggggggacggaacaatagatcaagacacaaaatcaacatacaagccaacatacgccaagacaagacgccggatatcgaattcagagataagcatagctagtcccctacggtgtctacagattctgtcaggagagacatagcgccgtctgtgatctcgccgggcacggattcgaagaggaagactaccctattgtcgactacgtgatgatacttcagaccaccaagtcgataacagatagatatgctaccccaaatattgtattggtgtaattatggtgaataagagcaacgaccggcttcggccaacgggagtaggattattacctgacaatttagggacccgaacctgtataaaaatcctcgtccccatctgttttacctcagtctcgcatataccctgataccaacaatccccatactatgcaaataccggaatcgcgacatcaaacgtcgacaacgtttatgtaagcatttttttaaaaaagttctgaacttctgatatacgaatatatcaaattggttaatggtgtggtttatgaaactttaggatcgtaatacctgggttatataccacgtgtcaaaattcatatagttttgtgcaacttgaaaaaaaaatatgtgtggctttatgtaatatacttaaaaaggttacattgtatctcgttaaaaaaagggttgttaggaataatatttgaaaaaatttagtaagagatcctttgttctcaaaatgtacatattatttacaaatttgagtctaaaaatattttgagttcaggcttctagcagtagtaaggagcactcattactgaactatttgaagcatacaaaggataccattaataaaaatgaaaactaaggttaatagtcgttgtgtgagtgtcggggtttacccctgtcacgccccgaactagtaccgaccggaactagcccgtgacgctccaaattaacctgttaattgataccagtcccaggaaacagtgctggtatcacaggaagacagattatcacaacaacagaggtctctttattatagagtagaggtacagtcatgttgggctgcggacagaccccgagctcacaactacattataaaagaaaaacggaagccaagactaggaccaaacatcacaggcgcgacttgggaactaggtcgaaaccctaaaactcatcgtagccggcttgctcctggaagaactcctcatcaacaggatccgcttcatcttcttcagcaatgggggggattatttatatagaacaagggtgagtacgggagtactcagcaagccatgggaaataagtgtttaatgcaggcttcaaggaaaggttgttgtttttgcaattgattttatttgaactcttttctaaaaacaactaagtgagtgcttctcaaacgacgcggataagacagtgcgtctcgtccggtcggagtatgtgtaatgtatcagtctttagaattgattcaaggttggcacccggccaacagcttttcaaacggccactagggccaacaactttcaaacggccacccgggcctagctgatcccatcagctgcagatttttcaatcatcgaacccctttacacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccatccatgtggtcgtacttgtcttatgtttgaatgaaattccaaggaaacggtccttaagtgcgagagcgggaaaccgtacacccggtacgttccccggtccgcggttttggaaattcatttagttcgcaagcaccgacccaggtgtcgggttttccaagtcttttgtaaaacccaagttttacccaagaagtttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgctaatctgcattgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcgatctgccttgctcgagatctgggtcttcgggctccgaaactacacgcgaaacgggacaactcaacaaacggccaaaataaagccctattaatgacctctaagcgtgccattagatagatctcgagatttgaggaattttggaagttgaacggagtcaaacggatttacggttgggaagatattgaatttctaagattattggatttttagtctaaaggaaaaggatttaattaaatcctttttggaaaagaaaagaaaagagggagggaatatagacttttcctcggcggctagggcgcggctcgagagaattggggcggtccggccgagctaaatgggccggccggcccaaggcggcctagggcgcacgcgcgcgggagggaggagagagagagccggtggaccgggctcaccacgcgtggtcccgggtgggacccgcttgtcggtgactcggttcaccgtgcggagcgagcacgcggcgcacgcgcgcggccggggctgggacgcggtgcacgcgcgcggttcgcggtggaatggatgcggcgggcccacgcgcagcctcacggctcgcggtggaacgcgcgcacgggaggggctgaccggggtcggcccgacccgatctcggccgagctggtgccgacgtggcgcctacgtggcgcctacgcgggctggcgggaggaagacgaaggcgccggccgcgaatggacggcgggcggcggcggtttctccgggacgccttgcgacgatgaggggcgacggggcgtacaccgggatgacgagggagaatgagagggagcgagcgaacgtcttggattcgccggagggtgtccgtcggcggcggattgcggcggcggcacccggcggagagaaaagggagaaacggcgacgaggtcacgaggggccaattcccggcggtgagagcatctacgcggctacgggaatctgttgctagcgtcggattgggcggagctacgtcgagcgaggctggcgacgagcgggtgctacggagcacgggcggcgacggcggcgagcacatggcgagcggcggcaacggttggggcggcgccggctagctacggggaggctacacaagctactaccgaaaactaaggggggagatggagcgaggaggaagaacggagggaggcactaccgtgcgggcggggcgcagtgacgagaggccgacggcgcgggagtaatctctccggcctcgggccggggaagaggaggaagacgagcgcccggagtcctcttccgcgtccacgaacgcaccggttctcccggcgcttggcgatgaacggcggaggcaagacagagctcggaaggcggcgacaacaatggagtggaggcgatgggaggagaagagagggagggcgcctgggctttaaagggcggcaatgtcggtttggaaaccgactttgggcggtcaaggcgcgagctggcgctccggctagcggccaaatcggcgacagggcggagggaggatgacgccggcgggaggaaaaggggaaaaggagggagagaaagggggctcgccccttgcctctttgggaaaaggaggaggggaacaggggcgacgcggcagagggaggaggggctctgcctccgtcccttggcggcttgcgctcggagtggcggggccgaggcaatgacgacggcgatgactgcggggcggtgtggagcggaacggcgacacgggcgacaggcgcgggcaggcgctgacgacggcggcgaccaggcggtcggccaccacggcacgcgcgcgcggcttgcaacgggaggcgcggcggattgagcggcgcggctcgggcacgcgcgctgg

SEQ ID NO: 41520 - DNA, 32158 bp, Oryza sativa
attcggcccatcgaccccgggggaggcaaaatagacttttgcggaggaatttgatttggaaggatttggattcgggattgaactcgacgatagatcggggatttgagatctgggatggcacggacactagacaacaagcaaagaaacaatttcgcaaatagagtttttatgagataattttcccgctaggcgccacgacggaacaggcgctacaacccctcgtcggcaagtggttcaccctttaaatgttttgagctacagttgataaatcgcagaaaaaataaatgaagcaatcaagaacaatttatgaatcctctaaataaattttgctaaaaaatcaagattggcaagtaggaaaaaacaagggtttgttgtgaatatggaatgggagagttggtctagacagttggatcagaagaataattgactgagatccatagcgagttctcttgcaaaagatcaacctcatcttttcacttatcttgggacggagggtggtacagtacacactggtcaccttaaagaaaatgcacatcagtaataattgttgatcacatgaaaacataagaaaggattggacaggtaaagtacaggttgtaatatgaattcaatactactttgtcctaaaaaaaacaatcctagctacgaccctgaacaagcatttgtccagattcgtagttaagattatgttttttataggacggaggggctactgctgaagccagaaccaaccattcaatcaggacgcaacaagtaacaaaacattaatcatcatccaccagtttacatgttgcatgtgcatatgagagaaacccacaaagagggccatgcagaggggctgattatatagcaccatctgcagggaagaaccatctcggatgtcgccactggtagtagacgccagagtgacgattaccacttaccaaacgcaccaacggcgttatcatctcgtttctcatgttgtagatgccagagtcgccaagaggatttgcagaataaggccggttgtagtcagatatgaagtagatgcagtcctcctgagctccacattccacagcagggacagacttggagccatgtgtgccaacaaagagagcttggcctcccaaagattctacccttctccacatgcgagagccattgctcaaatctgcctcatataccacaaatgaaagagtacgcggatcttcaaggacatcatcatgtgacagagggaatgggtaaccgaaaagccgaatcacctgcaacaatcttccaccagattcaactagatatcgccacagcatccggggatgactctcacgacaaggttggaaatgggattcggttaccggttcttctgccaagtcaaccatggaattaatgcatgaaacctctggttttccttcatggccctcactgatctcaaggatgtagagcttcccagaagcactcagtgcatacagctcccaccacagaaggcgatatcataggtctgttctcgagtgaaaaatcatgagatatgaatgaatcagtagcaatgggttgatagcaaatacaagcggcgctcacatgaagggggtcattgatcagcacagcgacaaggggaactggtgatgagtccaagggcaagggaactgcaaacttataggaaagtagagtatattcgttgcagagaagtataccagatccacggtaggcacgttccatcttatcatgccaaatgctggctagcttaggaagatgtaatgtaaccttggagaaaaggttcatcagtgagcacccaccattactatccctgaggaagagccagttgtcaatggagccatggcaagaggcatcatttggtaaaggcatgcggtgaattttaccatcagagatgctgaggaaggtcccatggaggagagtgagccaagggagtggaggggaacgggctgcaaccgagcattggagcgccatgggcgacagactgctcttagccgaacacgatcagctaaggagggaaggcgtccgaggacaagacccaggagctctggctggaggtctgcccaggatgaagaatgggtagcttccatcacgcaagacttgaaatctgaccttccaaaaatggaaaaaagaagggttcagaggtttacaagaaaaagaaagacactaagcgttgcactacttatacttgcgatacttggtaatagcatcagaagatagtgacatgtactaatatttaacaaggcacactaaactgtactagtcatttgctaaacaaactcaaggtccataactaaataaaaaggctgacctcacctgactgacatcttgcaagactgcaagtctaacacgacgagacaaaggtttcggattatgattaagcaagcactatttaaaactatgtattctggtcacacttgacaagaacatcaccagaaagcagtatctaacttttttcacaaatcaaaaggtaaatgcatctgcacttactcctttacccaaatctcaaggtagatgagtaaacataaataatgttttttttatttttgcaactaactagtatcatcagaaacatactagtgggtgatgacgtagtgaactagatacggactgatagtatactaaatccaatattaaaaaatgatatccacctatatgatttcgtagcaggaaacgctaaaacaaggggaacgtgcacatcggcactacacattgaaaatatgtacttctcttagatcttacatgctcctccataccagtttagatcaagcaaaaaaaatttggtccaaaaacatttataaacacatccaaatatccaatgggtaaatagtggtatatctccaaatgtgaatagtaatggtatttttttcaaaaccaataaatttataatgacaaggatccaattaacccttttctggggggttcaaccaagttgtagagaaagacattttctcatcgacattagtgccgcaattcaaaatgtttgtggatttaggccaaatgatctccgacagaaagccggcagctaatatcaaatcagcaacgaagggcacatgaatgtgggccatctagagcatcgattcgttgaacgaaattagggctagtgcagaggagctcacctgcttagaggcgatgacctgatgaacggtcggtgagagggggaggaagagcagggaaccgaccaccaactcgtcgccggcgggagatcgagcagcagcagccgctcgtgtccggctgcggggagcacaggctgtgcgcggttacgacgcggcggcgtcctctagaggaggcggcccggcgatgagaggtatccgctcgcttgggtggtctccggcaacgccgcaacggcaaggctcgccgtcgccggcgagcagagcaggcggcgatcgggaagtggaagatggcgtgggagccggaggaattggggtttttgcttcgattctgtgcggcgttattttttttatttattttttatacctttttggtctttcacctactcgcagtaatgagcaccccctgaagtaattagtgaagtgctgccagctactcccatgtttgttgatttattactagattattatataatgaattactatttaattataaatatatattaaatagtttaataaatactgtaaaataaatggtttaaacaatatgatagtaaaaaaaatgagaaaacattttttttaaaaaaaaacatgaagtaaataatcgatttgaactagctatccaatgaataatatgaaaagaacgaggtcgtagtataattctctgcataatataaaggatgaacgtattagactttatacaatttaatttaatagaattccctgtaaaaagaagtgttgaaatcatctgagtatattaatacgacgagacaataaaactttcaaacaaaaaaaaatgataagtacagaaaccttcaagacctactcccagtttatcgagctgtgtataaaatttaaaactgtaaaacatcgtcctatattgctgggctgatggcatgcaacacagcgacagcccgaaacaccctcaactccacatcgacacattttagagctgtcgctgccaaaccaccgagcaaacattattatcattattctcatttataatcaaacaggtcgagtttgaagcctgtgttgttcttgtcatcgatctacaatgcagccctctgctggctgaaagccaccggaatttatgtgaccaggttgatgccctcggcgaggagggagtcggcgagcacctggttcgccgcctccgacgggtggacggcgtcccagaacacgtacgtcgtcgcgttcgggcaggtgccgatcgacttggggttgcacagaagcaccgtcgtctccaccgtccctgtcccgcagcatcccctcctcgcctccgtgaatcctaccaccaccaaaaccatcatcaatggtgatgaatttttagcagggccggccaagataggccaaccaatcaatggtgatgaatcactgaatatgcacagttgcagtttgcattgatcatgcaagatgagatacagatttgcgtataagtttgttgttataccttgggattgaggagaggtgacgaggtcgtagaggggcgtgtagatgtcgaacacggcgatcttgaggtcggagtaggtcttcgaaagcgagtcgacggtgacgttcatcttgccgttgaagttctgggcgtcgctgttgagcctcgagacgcacccgctgctgccgtagccgaacagcgtgatcgccgccggtaggcagcccaacggcggcagcgacgtcacgccgatgcgccgtgctcccatgctgtacagttgctacaagaagcaaaggtcccaaagaaattttcacatcatctcaacaatccgtgttcagaaactatatctctaattatactatgagtctagtctatgactatctatgtcgatgaggaagctggttagttgcttactgccacggtgtttttgaagatgccgacgaggcggtcggagaactggtcggcggtctgggtcttgtagaggaaaggattgatgtagtaattctggacgaaatcgctggcaccggcgctgatgatgtacaatgagccgttgatgattgactgggcctggctgcttccggccacggctgccagcttagattggtactccttgaagtactccaattgttgggacaaaggaatagcatgctgcattacacagttttgtccaagttagttaagagatcatttacaccgccacatggatttgcaggtacaccgacgtccgaaaaatagcaatgatagagttcataatttatgaggcatgcatggaggatgtaactatgtattaacacgcagctgaaatatttcaattcagagcttctcttctccttttcaaggttattggtgatacttacatacagaagtgcagtgtggtcatagtagccagatcctgcagatgcaaagttggctccaatcagaaggttcttccctgacgcatctgggctgagatacgcaggtgcgtagctttcaaaccccaacgtctcggctgcaaccacaggaagtagcagaacaggatctctattagaaaatgcaactgcaactcacatatacattggaaagtaacaacatttagcaagagtgagaatgtgaccagtgatatcagtagccagcttgccgttgcagaacctccccgtgggtacctggttcttgaagtcccttccgtagggagggaagtttgccttgatgatggttttgaggtagtcattgttacctacgtccaccgatgagtcaccgaacgtcatgacggccggcacgagcggctgcgcttcaccaccatgtgttcctagcagaaggaagagagccaggagcagcaagcacttcacctccattggagctatccttggagtcttcttaggagtgtggctcgaaagagaagcgtgttctggtaagacagaacgctgtgagcttgtttatataagtgtgcctgcaaacatatatacacaaaatgagatgaaacgcactaattcagtagttaatgaagtttgttatgaaccccataactatactcatgagacaagctgtcctgataagaccagtaagcaactaacttaatcagtagtggggcctagttgtcatccaatgtagtagtataaatcttctttcggtgcaacctttggtgtagtgtgtggcatgacagtagcacattgttagtatagtacctcatcgtggcaatgtgccaaattcagtctccatgccctgctttgcatggttatccacattaattcttccatctgcaatggcgactatttattagattgataaggaaacaaggggcagttgaggtgctattgaggcacatcggcactagaagtgccaggaagaaggtgtaaaccccaacagctactaaacaaccactaatcagttattgcacatgttgtactaacacaatatatgcagttggaactcgagcattgggtcccaactggaaagatctttaacactggttataactgacatggtttttgacaatgtaagaaaaataaaaggagttgcaagacttgacaataaatatgcaaatctttcaagtgctgtgtgccagctagtaagacttatcatcattgaatgcaatgctgccactcgtttccttcaatgccagtacttccccacgaaaataagtactccaaataagataccccctccgtctcaaattacatgttatttagatttattctaagtcaaacatatatatctttgatctctattttttaagatatttatgtgatctaacaacatgtgaatcatatattataaaattatttctcatggtgaatctaaaaaaaatatatctcttatgataataaactatctgagtttataatgtgaattgatggttaaagactaaaatgtttgatttatgacaaatctagaatgataagtaatttggaacagaagttgtaccagaaactgagacagctcagataaaatattgtgggggaaagctagtaggaattcgatggtcaaaatattgataaaaatgtggcagtatatatatagcaataaaatattcttccaagattcttatgcttgtggattcttgggaggctgggaccaaagatgtatactacgtacctttcatgctgtttctgaacatggatcaagagcatacctaatataaaaggtggtgatttagacacataactgaattctgtacatgtcatgctttcaaaggttattgtccatttctctgattgagaattgaaaaatgaaaataggccagtgtgagactgagaaacacaaacagtttagagatggagcgtatgctatgaagtttgatcattagctaaaaaaaacttatgctgtggtcactgtttatttacgaatactgcaatggacatatgatcgctattatttttatgataaaaaaagggtgaatagtcaaagtggtcatccaagtttcatctgaggctcagtttagtccttgatatttcaatctatccatattagtccttcaagttttcattttagttcaaacttatccttgaaaaccaacaactctcttcataaataacacttatacccctcatcattcacatatataagagagaaattgcatgcttgaatttttttatagataatacatagtatattatgtaaaacgaaaaaaaattatgtactagcaagtgtatacgatagcaattgcttaagtttcatgtgcacatgtcgaaataatggaaagtagatctgtaatattgtttattcatgttggctttctcttttctagtatatagatgtatacaaattaagggcaaaaaggacattttctaatagaaatattgactataaatagccatatggcatattaagtggacccaaggatgatttcaagccaaaacaaatatttgaaggatctatgtggacaaaatgaaacgtgaaggaccaaattgagccttcgctgaaacttgagggactaaattatctattcacccataaaaaaacttataatcttacactaagaaaggaatataagatttgttaaaatatgtcaaaagaaagcagaactcggaattaatgcacaaaaaagaagtaaactagctattcataggaaaagaagaagtctggggaaagaagataacattaggggcaataaataaagctacataacttaagatattttattttcattcttaaatgttcagcaaccacatgccatgtaaaaacaattggaatattgtttagtgcttaacaaagcacaacattcaattgagatgggttctgaaagtgatgaaaatctcagaaaagaacctggactgtaaaagtgactctctgaatattaagtagatggagtttctttgaaaggaggaggatcatacttcaaaacaacatattacaaacacatttagatttgtaatgaatcttcagagaagcaacgagctgctatgtatcaaattaacatttttttcaagatacactcgctgttatgttagtatcaagaatggacccagtgtgactgattaatttggatgtctacgaaatatgttcaaggtcagatatgacaacaattgtacttacatagagagtgacaagtacgactcaaataacacaaaaaacacactttgccctacataatacagtgtatgtatgcatagcttcgattacctgattgtgtaaaaaataaaatcataatagcaagagtaaatcaaaaggtataatgaaaaacatgagcatttagattatcaccagtcaatcggtacacataaagcatgaggccatcataataccgtggaaaggactaccttttcgaacaatgctagtaacaacaaaatagttgcaaaattgggtaactagacattggccaagctgctaaagtcaattattcaatttattcaaaaggttgaattaacacattaagaagacgaacatacatgtctgaaacaaatgtctgcagattggattgaataatgaacttaccattgcaaggatatatggagaaaggacaatccttgtgtgtttagcatcaatactgactgcctacttcataagaatcattagtgttgcaagtttagtagacattatgtagtcatcacaaaaaatactacggcagtatggtcaggtagattttagtcacattttactgtgttgaaatcatgtaaaaatattccctacaaaaatgagagaatgttgaggaaatagtatgtgtgaaagctaatagtgaatgcaagaacggtaaaataaactaaagttatctttctctcagagtttcgaatgtttaaaacaggcctgcaaagagataccatggcacaatcacaggataacatacttcgaattctactgtttcataatttcatataagaataaaaacactagctttggaaacaattacagataacatatagaaaagctagagagtgatgagctggcattccatgatgaactgaggaaagaattgattggaccatgttgtacttagttccaccaatttcagttctagaagactatggggtatcaaatgggtaataatgtcaaatatacataccttacacaaatgcacaaaatctaaagagtgtactagcattcaacgattacgttcctttgtatctaatttacccagatttacataataaagaaaccattggccatagttgtcatatatgctacgctaaagagttaagatgtgtaataaaaatgtgcatgcaactgaggtttatcaggtaaagcagaaacaaatataaattcaagtggggttttagtcctaaatggaggaagagcattgatattaaaggataatgatacattactgtgtttattagcagcaaaattcagttggatgttatcatcaatgtattcagatttcagcaggaagtcagaaacaaccttttgattttttttttgtcacaaacagtacatataaatgttatgattcagaaacagaaattggaaaaatatgttaatcacagggtgaatatgatggtgatggttccgtttctttcattcatagcagcaaaaaagcacttgttcctatggcactgcttgaaacatgggaatttttcccgataccttgggaattaaattgttccgcataaaaaagtcttgtactccaaacagggtgaagaggatgagtttcattaggacagaacagttatgggaaacaatgacagtacaactaacacaatgaaacaaacaagaataaaggatacccttatcatgcaatattttaacagtaagagcattcagtggtcctagtcatcatttatatgctatggaattccaattggaagtacaagaataccccactcgtgcagatgcaattatcagttagatagaacatctatatggttattaaaagactctgtccatgacaagtccaaacaggactgagtaacttctgattagcatccaaaagaacagtcaaagaaatttgacatttaagacacagaatatgaaggataaacacgagcatgtgcctcaggttaagcctgcaatgttttactggttactgacaaagtgataattgcagcggcagcagcagcagcaaatagtatacgaccttctccaacacctaagttttctcttaaagatactccactgagtagccaagccaccatcagcattcagatacaggtttgccatgaaacagcaagctgtatcagtaatttgttctcagatgttgatcattacaaactctttctgtaaagttggtaaatgttccatccaaagccacagtaataatgatcaaatttgcatgtctttcgctgtcgatcttgatcatcatccaccaccaaaatttgtacaatcttaaaatggcccaagctcatgtacccagtttagcaaaagcaagcacaaggcttcacgcatgtttcacagcagcttctgtcgctgcgatctcctcccatgccgcgcccatggcaggaatggtggtaacatgagcccagtcaggtcccaaggccgcccaccaccttcctcctgccgcacaccaccggcatctcctccgcaatccatccaaccattggagccagcatccatctccaccttctgatcaccagcgattgactccgcctcgccgttgcgcggtgccgattgcgccttactaggtttggacgcggcggcacccctcccgcagcccggagggtacctccgcacggcggaggcgcggcgcacgagcaccacctcggtggtagcagcggggacctcgattccggccaccaacccattcccctcgccgtgatcgggcccctcggtcgcgaccgcgaggagcggctgccttgccagcttgggggatttcgtcgccgcgcgcgccgatgcgttcggaggtggtcggaggaggttggtggcggtggtggaggggccgggctgccccggtgggtgcgcagcgcggtggtcgcggccgcatcccggcgggtagcggcggacggcggaggcgcggtggccggcggcgagcatcggagcgtgggcggcggaggtggtcgggcggaaggaagtgcggacttaagtgaaatttcgaaccgaacgaacggaggattgcaggagaaggaacgtgaagcttgtactgtttcaatctctctcctgaaaacgcggaaccagttttgtgtttttattttaggttagttgtaaccatgtcattacagatatatctatttcagataaatattattatataattaatttatttgtagttgttgcactgaaattttataaaattaagatcgccactgccatcatgtttttcatcgatcttcttcattcttcgtcttctccctactatcttcctatcttcttgcattgcgacgggggcagtagcatgcgagcagcagtggcgacgattgccgacctaggggcttggctacttgctacccaacagcgggacaggtggcagatgacggtatagagaaggttagggccggatctagatagcgacgtgatggcgatgacctgggaacgcgaaggatgccaccagtagagggcagtcccatcccccctgtggtggtgttgggggtggttccctcgggtgaaagcgcggtggtcgagacgggtcccacagtgtcggcgacctccagatctaggtggtattgatgggaggcgcagagaacgacaggtggaggcgcaagacacgaaaggcgtgaagaactggcgttaacgacggggatccgagaaaactatacactttataaatgtgcttttttttttcttttgaggaacattggtaaatgcatgacaaaaaaatttctatataattttgtgctaatatgcattttccttgttttgtttaaaaagtcaaatttctacccgtcctaaggttttatgcagtataatatactccctccgtcctaaaatataacaactttttactataaaactaaaatgcttataatttgggacggaggtagtaacttttagcggtatactgtgctatagcatccccttatcttatgatcataatatgttcggcatgtacccaatgtaactttaaattaacattgacaattacttaaggagtgcacattagtctccattagcgtatgtatttttttctggttcctatggggatcaaatgatgtaggtgaaaaatgcttaaaaatcttatgaatttatggtttcttcttatataaaaaatctaataaaatattccactgttctccagtaaactaaagctgggccgtatcctgtattcatgtgggctttcttgcaacaataaacccaaatactccagtataggtttctaactctgcgtcgcacgcagcaagggccgaaggccgcatcttcgccgtccccaactccttccaccgcgacttcgccgccgtccacggtccgccctcgccgccgtcgatggccgatccctaccgcgcttacgcccctccctcctctctcggccgaggtacgtgtttgctcgctcacgccctccccgacccaggccgaccgggtctcttctgcgtggttcctgtgggggcgttcttgtgtcgattggacgaatcttcgaatgaatcgggagctcttgctgggttcctgttgttactgctttggatttatagattcagttcctgcaaggctcaattttgggtggctcagatggttttcttgtcagtttggtgcgcaatccgggtagttcagtgagttttacttcagttggtgcacactgcaaaggagggtaatgattcgcatcgtgtagctgaattaatagatttccatcatgttgtgagctctaatgtcattaggattcccgaccaaattagcaccactagtttctgattgctcctgattcgcagctgctaggttgatgtcttaatgaatggttggattgagtatatgctataatcttctgcgagaaattctgtgtgaatgttaaggaatcattgcgctggatataatccatctggatgcaatgtctgtgcttatgttgagctagacaaattacaactttttggcatcaattatggctcggggggtgccatgatgggagggttgggaacttgtgacttgtgaatttgatgttgtttagtttaagtgaacaaaagattcctttttcccagtattctaactggacatcttgctattttgaattttaataaaagggtaggacgtattgatgtaagatttcactgaattgggattttgttttgagggatcatgtggtgtacaattcacccacataaatctattgttgaattgaactagtgtacaaagaaactacctttgtggatacaagacacttctttccatatatgagcagttaagaacttttgatgatttggggaagaacggaatgcatggttgttatgcatagccttgaggaacactggtgtcaacggcggaccttcttttgtcgttggagtgggttggataaattgttgatgcattgttaaaagtatataagaatatctgaaaactatatagacagtttgaacatggggaggttgaatatagaagggattggttttcatttatttgaacttgtgtcatgtttttccttttgttttccttttcttgtttgttctgagattgataatgacacttatcattgcattgggaagttgaatatagaaaccttttatgttcatagcaattttattgtgtttgcagatccgcagggtgattttcctaggcatcctccatccgagggctcttattatgcttcaagaatggctgctctccatggaacatcagatatacttagacatgatgtaacgactttatttttagtggatttgatcgcaatataaaagtagccaccatgttgtcacacaacacgttgatttgatctacaggtaccattacagccaagagcttatggtttggatggtgcagcaggagcaagtcatcctgctttggctggtcttggtggactggctgctggaactacagctcgggggcctagtccactggaagacccagctttagtaaggagaagttcttctctaggaaaaactgctagtattccagatgttgagcatcccagaccccttctgaaccttgatggtccaagagaagatgaatccaacattctctttgttgatggtctccctactgattgcacaaggagagaagtggcccgtatccttcctacttagtgttcttatgctctgtgtttatatctctttcttagtttcctttcgtgagccttaacttcccatggaagatttgttccgtccttttgttggcttcaaggacatcagactagtgcataaggagccaagacatgtacgtgcttttccttttcaatgcatcaatttttttttcttagttgaaaaatatggttggacagttctccttttgaataactcacaagtctatgcgtgtatttgcattcacatcttggaactgagatatgttagaagtaccacatatattatagaatgcaatatatgcttttctgtccttaacatatataattcaggcagagctgctttttagcttaaaaaatatactggtatatagtatataatgcaatatatgtttctagccattacatgaattaatttaatcacaaaagtagcatatttagttagactatttatgtatttaagtgggtaagaaattacattgacttccacatgtacttttattgccgtcttttttccacgggccaacgtcagtagagctgttaacatttgtcgccatgttttccctaggcattatcttatttcctgtggtaatgaacctacagttgtttatgcttgttttgcatcacagatccccattccattcatcatttatctgttactgctgattctattagtgctagtttgaatttggatcaacactaacttttcatactgctgcttgcagagtagtgatagggcctatgttctatgctttgtggagttcagtgatgcaaaatgtgcaataactgctatggaggctctccaaggttattccggtgtcattgatttatcgcattgatattctcttgacagcttttcatatatcctggcagagtcggtttgctagtatgggattataatcatgttacattacatatagaattgaatggtgtcttgataattgatatgcatggtatccattggctttttttctttcagtagtatttcacagttcacagtgtctgttagattcttgtgacacactgatactaaccatatcttccttcaagagctgtagctatttaaacaataaggcagacagttcgctcatatttcatagcaaacctaaggatagtaggaatcaactttaaacctaaggctgtaacatgagcttttctttgttgcataagctgaatttttcagattattgattttgcagaataccgcttcgacgagaggaaacccgacgccgctgttcttaatatcaagtttgcaaggttccctttccggccggccgctgccccccatgatgatcggagacgccttaccttgcactgattagttcctaacttcctatcatccttagttagctgtgcccaacctgaccttatcattgcaacttgtaaatcttgtaccatctctgtcccataatacaagggatttagctcaatcctttatattctgtgatggaggtagtaacaacctgttgtcagtcgaaactggctagcaggaatcttgaacagcagcaaaacaaggaatgtacatttgtgggttcgaaacaccttcagattttttgctggtgccagttccagaaacaatgggatttgcttttctgcaggctaattactaatttggaatggaagatattttaaggatgttttgtaggaattgttccgattatcgtcaaaatcctataaaattcctgcgttccaaatgagcgaggatcctttatcgtaatgtcactactgttaccgtcactggtacgtaggtttcaccctttaaccccacacgtcaatgagtgttattgtgatagataatgtgaacccgttccaaaggagccgttaacgtcagcactgtgtcaattgctgtaagaacggcatcctgtccttttgagctgttgacgtgagacaggtttgacgttcaagtctccggtcctgcacaagaaaccaccaaaatgtgtcaggctcgttcatctggcggccgatctcgaattctcgatcaacatcgccgtcgagtctgggcgctcgtcgacgacggagaggtcagcgacgaccgtggagcgggggcggcgagaagctcctcctcctccgccgtcgctttcgccgctggaaactgccggcgaggtcacaggggcgatgtgctccgccgtcgctttcgcccgctggaagatgcttttgcccattttgcctgtggccggtgattgacgctgtttcttaccacggtgacgcttcgcgagtgaggtcattccaatattccatccacagttatgtcttaacacttgtcaaataaccaaaatttccaggaaaccaaacaagtttttttttctctggaaaactctaattacatatagatattattgcaaaaataagaattttcgtgtaaaacacttgcctgatcgtttgtcctataactgataagctgtaaaacgaaatataaaattatggcttatcagcaattaaaatataatttatggacaaaaatacacggttaaaaggttaatataaaaaaataaatcatgataaaaaaatcaaatcaactttgttcatttcttcgatcacgctataagctggatacaatttgccaaattgttaactgaaaagcacttatccaacacatgacatgacatgttcttggcatctcttacattatccttttttttcccactgtgacaagttcttttttttttcttttgatttctaaagctgatttgccattcttgcaatttgcaaaccactagtgccccgtgaacacatatatctgacgccgttttctgccgccaaattggatggcgcagcctttgcaatttgtcaggatagatagagagatttcacatcacattccctcgttgccacggtagtgagccgtcctgtagccggtggctgcaaaggctatttggattctagcactgtgctgttccatcatcaatttgtgtaagtgcactagcattactattctctgcatcccaatttactgcaaacgtagttttcactgtctattgtcagttttgtcacagtagatatggaatttatgctggaatactaatttagacgattgcggaaaacgatcaacaaatcatcctatagctattaaaaataaaagcattcatttaatttccaccatatttctctgtatttattagactgaacactacaattttagatgatatattgcgccttaatttacacaatactaggtgaaacattgctgtgggaatttagtatgataacaataaaaaaataacgtgtaagatagctagataacatcagattaagtaaattaatgtggtttatgataatttaaatttaaatagtatgtagaatggtgattcaaactaacaagtaaggtggtatgactttatggaagaagaaaaatagagagatagtttggaccgttgattaatcatctaaaggctaaaaacaattgatgtgatataacttaattagaggaaaaaaaggagaaatataatttggatcatagattaatcatttaagcactaactaagcgaggatgaactatataagtatataggatatcataaaacataataaagatatacattgaaacattatgtgaattatgttggatgataatttaacatgtttgtatttgaaaagctcttaaattataaaaactataaagatatagcatgtttgcacgatgtttaaatgtgatgattgttagtggataatgatgtggcatcttgttaattagtggatgatgatgtggcatcttgttagtagataatgatgttgcatctttgtatattaagcttaaagagttagtggaggataattttatagtaagataaaattccatctgtaacaactaacggtcttaacctgcctatgtaaataatacccgccatatttatccgtattttatttgacaaaatacttcagtacaattttagattatttcacccccaatattgggtgtacaactgtacatcgcaatagtgatggccctagatagtgttgcactatatgtgtgtctttcaaggcattgaccaaaacacacacgtgcccaagctgcaatttatctcaccatttcagattatgagaatcttcaattctcctagacagcaaagaaaaagcatatacaattttacatcaccattttcagattaggagaatcttcaatagacatcaaagaaaaagcatatgcaaattttacctcacaatttcagattaggagaatattcaaaagacagctaattagaaaaaaaaagagagttaaaaaaacccataataaaaaaagcaaaaggagactagtactagcaaggctagccagcccatggtgttcgactcgtctccatttcgcgtctcctcctcctcctcctccggccatctcaccctcccggcgagcagcgagcgggaggcctccgccaccgccgccgccgccgccgccgtcgccgcccgatggggaagccggggaagctagcgctgccctcgcacgagtcaaccatcggcaaattcctgtgatctcccgttccccccatctctctctctcccgcttttccgtgtcctctgctgctcgcatcacgcttgctgttgttgttggatgtgtgttgcttgtgctgattccggtggtgtttcgggggtttgggttttcgggctgcaggacgcagagcgggacgttcaaggacggcgatctgctcgtcaacaaggacggcctccgcatcgtctcgcagagcgaggaaggggaggtaaagtcaccagcggaaatgatatagtttcacctgtttggtattccgtttggcaatcgtaggagtgaactcgccatggttggatcttctcttgggttttgttgaggagatgaaggtgtgaattggatgatgggcgggtcgctagcggcgttcctggattcactctggagtgaattgttgttgagctctgattatattctggattggaatgtcatgcgtttggcaatcagggtgctgtttgcctgtttggtaatagggcagatgcatacgctaattttctacattaaaatgtgccaataatttgcaaccatttttatatggtagtgaagaaatcctgaaatagtttaattcacattttctaatccacagcgaactaggataggaaacagcatgcctttttatcttcattgtttcgatgagcgtcatacttatatagtggtttctcatgtggagtgtctagacactaactagtggtatctgcatatgcaataaattactgaaagcatatatgctgcatctggtagctctgttcctggtgctcacttatagtgtgagaatgttctttaatactatcattactttttgtactctccattcatttaatatgttcttttattttgtgtactcaccttctctctattggcatgctaaaattgttgcaggcccctcctatagaacctttagatcataatcagttgagtctagatgatctagacgcaatcaaagttatcggtaaaggtagtagtggaatcgtgcagttggttcgccacaaatggactggccagttttttgctctgaaggtattatatgaaagtacattctttgctttttatgatttcttccactctccccttaccagttttaactacaatctttttagtgttcccaatagttatagcttcatgtgagtccagtgttttttcatgtggtcttttgcctaacacttgcaaaggatctttagttctttacctccattgatatattattgcgtttacaggtaatacaactcaatatccaggagaatatacgcagacagattgcgcaggaattgaaaatcagcttgtcaacacagtgccaatatgttgttgcatgctgtcagtgtttttacgttaatggtgtcatttcaattgttttggagtatatggacagtggctctctctcagatttcctgaagacagttaaaaccattccagagccctaccttgctgcaatctgtaagcaggccagtgacatgtggtagaagctatcacacaatttctttgctttgcaaatgttacttaagcaccacatggactttataataaaaataaataaatctttcctgcgcaggtgctaaaaggactgatgtacttacatcatgagaagcacatcatacaccgagatctgaagccgtcaaatatattaataaatcatatgggtgaagtaaaaatatccgactttggtgttagtgccatcattgctagttcctcggcacaacgagatacatttactgggacatataactacatggcggtgcgtaaaagtttctgtgtcatgaaatgtatctctgattattgcatgaaatgctatctattttgtttgtcttgttgaaccaaagggaaattctgttcttgacagccagaaagaatcagtgggcaaaaacatggttatatgagtgatatctggagcttgggcctcgttatgctagaattggccactggtgaatttccatatcctcctcgtgaaagcttttatgaactccttgaagctgttgtcgaccacccaccaccttctgctccatcagaccagttttcagaggaattctgttcattcgtctctgcatggtaattgtacttctttgatgatttctcttatccacttacatttgcagtactagcaatttgttttaatttttagtttacaatcacgtgcttctaatatcccaagttggtgcctgttttatacattttacatgcaaaatttaagtgaaaaggtgactaccttcagagtgtgtttggtaccctgtatgtcattcagcctggcttgcatcagcagagcttgcccaaccagtcctgtgtagatgctgaaaattgacaagtttagttacatgcttttgcttagctaggccatgtagggagtttgtttggtttacagcatgtatacgtgcaaagcccaaaatatatctttggagccagtgcatgccagcaatttcgtgctctcaccagcaggccagcaggaaacggattctgaatacggaaaacgtttctatggggccatgcccatacctcactttggaatgcgcagggattggcccatccaatcacacagaaaaccaaacattggaactgttccagggaacaaatgcccccttactgccttggtatgcagattgtagggacccaattgatgcatggcgggattacacccaactaaatcatttattgtgtggcgtgttccatactccctccatacttataaaggaagtcgtttaggacaatatttaagtcaaaccttgagaatataaatcgtgaataactctcaagttgttgagtttgaaaatataaaaattatatgtatagatttgtcttgaaaaatactttcataaaagtatgcatatatcactttttaataaatatttttatagaaataagaagtcaaatttgtgttttggagaccgtgttgctttcctaaacgactttctttacgagtatggagggagtacttcttttcttgagatatttttgttactcttacatgtgaaccaaataggtctaatgtctttcaactcttcatattcatatggactttcaatgttaagaaggctgctaagttttataaagggaaataaataaataaacagggctaatacagttcctctgtctgttctgtgggttgcagtatccaaaagaatgcttcggataggtcatctgcacaaatcttattagtaagtgaaaattcttatccacgctgttctttttaaggcatcttttgcacaagtctagctcactgatcttgttgcgtcctccctctgctctttgatacccagaatcatccattcctgagcatgtatgacgacctgaatatagatcttgcttcgtacttcacaaccgatggatctccgcttgccaccttcaatacaagtaatgatgagcaacttgtcttttttctttgtttttgccatccattttgtcatagacacatgttagtgccattctttatgattccagtggatgaaccatcaagggaaccttacattcttttttttcgtaggcaaccgatatgatgacagatagtctgatgcaacactgcgtcatcatctagctcgaaggatgatcctttggctgtccatctgtagaatctaccatctacctaactggccccaaatgtttcgtgtattttttgggagaaaactttgccctgtgtactgagctgggattgatgtctttgatatgtaaatttcgcgtaatttcatatgtagaacaattctaggatcattgggcattgaagttttgtttggccgtgcaccaggatgatctgttcttgatcgctttacctttgtttctcacttctgtaactaaaacctatatttaccatttaccggattgttcatggcctcttctgggcaagtcggtgtcgactgaaagtctcaaacaattgcctcttcctacgacgactggtgtgtttcatgcaagtttcgtgatcttttgacaaggtgtgtgagcactgagcagccggtgcgaagcaaacggcacgaagttggccttgtcggctgaggcacgtttcccaaccgtgttcttatcgtgtcaggtcgccattctggattgcgagctcgtccgttcaaacatgaattacatactctatccgtcttaagataccaaattaggattagatgagacataacctataacaaatctgtatatgttttttataattttttttgagggagtcattgcctattcgcccgtggcatttttaaatacagtagttaactatctccacaagcttatgtaggccagtaacgtgggctgtatgggccggcagtatgggcccgtatttaattatagcccaaaagtatggatcgtttttggttataatttgctggattctgttcatacttttgctttatataaaaaaccgcaaataaataaataatgaaatgttaaattaaccgtccgggtttctccaacagccaaagaatttatagtcgaactcgaggcgccgtcttgtgaattgcttgatattgcttccacacgaaaggagattactgattactataaaataaacgcatgcagaaccagtgccatgatacaaaactaaatacgcgtgaagtcacgtttcgcacatacaatatccgatcgacatgatgatcgccggtgatggccgtggctggctgctgccgcagagcgtcatggccgtcgcctccgccgccgcgctggcgctggcgctgtggcggcagcagccgggaggcagaggcggcagcggcgggccggcggcgatcctcctcgccgcggcgccgtacgcactcctcctcctgctgctctggtgcctccgcgcgttcgagcgggcggccggcgccggcgacgcggccgcgcaggggaggctcaggctcgccgtgtggctgctcagcagcgcgctcaccgtcacgttcgccgccagggtcgcgccgctgatgcacggcgcggcggcggtcctcgtctgggccatgtcggcggcgaccatttgcggtggtttctacatgctcgatttgtttcctctccatcgtcgactagatagaatcaattgaagatttaacgtcattttatactttttttaatcagaatatctgtgaaaatttgatgaataatttgctttaaaaataatattatcggtttctgcgaagctgtatttaaaaatacaagcggaacacaaattttgacaatttgaccatttacaaaaccttatttcaaaaataaaccatgacctcagcgccatcggaattggtgctgagatccaacatctcagcgccactaattttggcgctaacctccgtccgagatgtcatgcattagccacatcatcaggggtcagcgccactaattttggccacttacaaaaacttattataagaataaaccgtgtcaaaaatttatttcaaaaataaaccacgactttagcatcatcggaattggcgccaactaatttttacgctaaccttcctccgaggtgtcatgcattagccacatcatcaggggtcaacgccactctcgttggcgctgacctctgtattggttaaaattttaacatccttttatccaattaagaaggtataaagtataatagctcagtggttgaggtggtactctcattggcgctgacctctatattggttaaagttttaacatccctttatccaattgagaaggtataatagctcagtggttgaggtgatactctcattgctttatccaaatagcttagtggttgaggtggtactctcattgctttatccaattgagaaggtataatagctcagtggttgaggtggtactctcattggctgacctctttacctttatccaattgagaaggtataatggctcagtggttgaaagcaaggtccaattgagaaggtataatggctcagtgattgaaagcaagttgaggtggtactctcattggctgacctctttacctttatccaattgagaaggtataatggctcagtggttgaaagcaaggtccatacctttatccaattgagaaggtataatggctcagtggttgaaagcaaggtccaattgagaaggtataatggctcagtgattgaaagcaaggtataatggctcagtggttgaaagcaaaggtctaaggccctgacctctgtattggttaaagttttaacatccctttatccaattgagaattcaaactttcaacttttccatcatatcaaaacttttctacacacacaaactttcaacttttccgtcatatcgttccaatttcaatcaaacttttaatttttgtgcgaactaaacacaccctaagattaaaacccactcatgtaacttttttcttatatttttccctaccaacggttatatgcccaaaatatttgcatacccaaggcttcgaacccaagacctagggctaaaaaccaaaggagctaaccacttcactaatagtacatttgaagtaggaatcaccattacaatcttttagtctttgcaaaggtcggcgccaatgagagtggtgctgaaccttgatgatgtggctaatatatgacacctcggacggaggttagtaccaaaattagtggcgctgagacgttggatctcagtgccaatttctatggtgctgatgtcgcgattcattttacggtttatttttataataattttttttaaaaaaagtcaaactgtcactatttcggagcggatagatgcacgaatccacctatgaaaataggtacgctggctgtatcacgaggaccttgtgatgaggctgacacgttcttcggtttttcctgatctgaggggtgacacgttcgatcagacctatgcctgccagccgggttcgatcagacccatgccgctcgggttcgatgcttttgctacaccaaggaaaaaaaggttatacgaaagccgggatgaacaaaataatataacgcccaatatttttgtttaggctgagaaatattctactcatcggtatatgagtagacaaatacagaagttgtaagaaacatatgaatgggtgaaagttttatttcttctcgatttaagtacagacggtagaaagtaagacgaaaagttagagtcttatttatagacggaggaggttgacggctttcgtagtaagctggcttacgccagaaggttacttctcccgcaatctggctttctcgacaagctaagcttgtttatggcgccacaagctttcttacgctatgagatatcttttggtataaattttttctccaacttaagatttcttttgaagtaaacttttcactctattataattcatacacatagatatatgttttataacagttaccatttaaaaccatctcattaaattattctaaaactaaaccttctttcctgatctttttagccacgaaagtggtgccgacgtggcaaaatcatgctgccatgccagcacacgtggtgtggtacggcgccacgctcgcggggttagccagcctgatccgcattgattctgatgcatcagctatatactacactagacatgtttgtacacgctacactatcgggagtgagccgagcaatcatgtactgagttacttacatccgtttcaaaataagtgcagtcatagatatccgtgttttatcgttttgaccatccatcttatttgaaaaatttataaaaaatattaaaaaaattagtcacacataaagtactattcatgttttatcatctaataacaataaaagtagtaatcataaaaaaaaatttcaaataaaacgagcggtcaaacgttgggcgtgaatagtgctaaaactatacttattttgggacggagggagtataagactttctagcattgtccatattcatataggtgttaataaatctacatacatatataccttagattcattaacatctatatgaatatgggcaatgctagaaagtcttataacctgaaacggaggtagtaataattactaggtggtgtttgaatctcctaaagataagatgaagataaagattaaatgtttcacgtaaaacgatgtggtaataatgtgtgattaattgagttttaattattacaaacttaaaaaatagattaatataatatttcagaacaactttcatatagaaatttttcgcacaaaacgcaccgtttagcagtttaaaaaacgtgctacaaaaatcttatcttcattcaacttttatcgaagaaaataacgggaccttaagacggttagatttaagttgttctgtacagatggatgacgactaaaaaaagttgaaacgaactagataacctattctcaccaaagttccatgttataaatcctttctattttgtactttagttttgaattattttgtcttactgttttgtttctaccggtcccgtactcttttcttcaacatcaagtttaacccgttaccatagtcttctctttatagtactcttattttcactggtggagaaactatctttcatcggtcggccgaattccacaatagtcccggatgcaataaaaatcagggctaaagatgatctttagtcccggttcaaaagagtaacgggcatatttgatctttagtcccggttggtaacacaccaaccgggactaaagatctttagtcccggttcgaatgctgtcagggtatgtcaggccccttcgggatctttagtcccggttggtgatctttagccccggttggtgctaccaactgggactaaagtcccacccatatatatatgtcttcttcctcctccagctgcccgagcaagcttcaaaatttcttcaaaaaagaggggaggtcatgccaaaatttttattgaatttattttggtgattacatacaaatcggaggtgcctaaaaggtttgcaacttcatcgtccaatgttttttttttgtcatactacatttgcacctatgttttgcacactttttttgtctccaaaatttagttgtaagttgatgagagagaaaatgtgtgtgggaaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtattaataaagatatcttataattattttatgactgtcattattgtaagaataattatttgtgtacgattttttttgactcatgtagatggatcggcaatggatgtatgctgaccggcggtccaaagagtttattgacggcgtgcactattttttgagagtggccgaaactaacaggcaaaggggttttatttgttgtccatgcaataagtgtaagaatcagaaggagtattctgcatccaggactattcatttccacttgtttgagtcagggttcatgccaagctataattgttggacatcccacggagagaaggtgttgaaatggaagaagatgacaatattccggactttgctcagtatgttggatttgaagaaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgatgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgcccatggttcgcagtggcgaaacatcgatagaaaatttaaagaatttggaaaggacgcacgaaacatacagtttggtttgagtacagatggcatgaatccttttggagagatgagtagcggccctagcacttggcccgttacgatgtgtatctacaacctcccccctggctatgcatgaagaggaagtacataatgatgccgattattattcaaggccccaagcaacctggtaacgacatcgatgtgtacctaagaccactggtcgaagatcttaaacagttgtggaagaaggaaggtgtcccgtgtgggacgaggacaaacatgaggagtttaacctacgagcgctgctgttcgtaaccatcaacgattggcctgcatttagcaacctattcggacagtccaacaaggggtacaaggcttgcactcactgtatggataaacagaaagtacgtatcttaagcactgtaggaaggttgtatacatgggtcatcgtcgattccttgcagcaaaccacccggtatggaagaaaggcaagcacttcgaacataaggccgaccaccgtacgaagcctaaacatcacagcgggaaaacagtgtttgctatggttaaagatcttaaagtagtgtttggaaaggggcctggaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaaacacgttgtatgatctgaagcatatggaacaacgcggcgaccttcacccggaaccaaaggagaaaggaagccattacttgagtccaggcagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttataataaggggtatccttccagacaatgtccgggcaacaataacaaagtatgtgcattcatgaacgcaatttcacagaaggtcatcgatccggatagattagaagcccttaagaatgaagtagtgcaatgtctcgttagttttgagttgatatttccaccttcatttttcaatataatgacgcatctactttgtcaccttgtgaaagagatccgtattctcgggcctgtgtacctacacaacatgtttcctttcgagaggtacatgggcgttctgaaaaagtatgttcgtaaccgtgctcgtccagaggcaagcatcgccaagggttatggaacagatgaggtcatcgaattttgcgtagaatttatcgaagaccttcgcccaatcggggtacctgaatcacgccatgaagggagactacggggaaagggaactctcggaaggaaagcaataatgagggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggtaacgagtcgatcaaccaacaacttgccttcctagcgaggggaccgtctgggtcgatcgcgacattccagggatatgagatcaatgggtacacattctacacgagagcccaagacatgaagagcacgaaccaaaacaacgttgttcgtgtcgatgccatgggacacgatggaacaactgccacgtattatggtgccattgaggatatatgggaacttgactatggtcctctcaaggttcctctgttccggtgccaatgggttaggttgtctggtggagacgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagattgacgaggattacgatcagttggataggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccacgatgtaaactattttggatgtattgattatccatataaattaattgatgtatggcataatttattatcattcatatgctacatttaattgaatatcattcatatgctaattataattgactagagaatttttaaaagtattaaatcattcatgtggcatttacagatgttaattagagtttttcacaatttaatttattatctttcatatgctacttatatatgactattcgaatttttaaaaggtttaaatcatgcatgtggcatttacatatgttaattagagtttttaatatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaacctttgtactttaaataatgttaatgcattaacttctattttagaaacacatatgtaagcgaaaataatatgcagagctataatctttagtcccggttcttaaccctaaccgggtttaaaaagaatttggaaatagcgggaaaatatctttagccccggttgatga

SEQ ID NO: 41521 - DNA, 5230 bp, Oryza sativa
gcatttatcctaatacatattttttgtatcggcagaaaagacgtgttgtcggagtcgtccctcaagccggagtggaagagctagccgtagaaggaattcgtgcaggcaagtgacgtaataatataaatgattgttatatttgtaatgcaattaagaatattagacttgtaattagacttagcatataattaagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttatttgtaattagacttagtatataattattgactacgaaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacaaatattgtacgatacaatcgcggagggaagcaaccagtactggaatgaagaagaggggaacgatgatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggttggcacatcataacggaagtggaagaagatggacgtcctagtgccccggccgaagccgccaagaactatgtacatcacagcggttgggttgtgcgggataacgtgcctgtcagtacggtgtactggtgaagaacaagggcacgcggagatcatgagagctttgtcccagattcggagaaagagatgctgtggaccacaatgctcgagacattcacccttcccgcgggtacagaggacaaagtgaaaaggtggactctgaagaaaatggcagaacagtttcagagcttcaagggagagctgtacaagaaatatatcctgaaggggcagacaccgaacttcgacacattcccaaagctaagggatcactgggatgagttcgttgcatataagacaggtgaacaagggcaggtgatgatggaaagaaacaaagaaaatgccgccaagaagaagtaccatcaccacttggggtcaggaggctatagcgtcgcgatgccgaagtgggaggagttggaggctagcttgattgagaggggtatcgaaccggcaaccgccaattggccggaacgatcgaagttttggtactatgctcacggtggaacgctcaacccagctgatggctcactggtcttcggtgatcagatacgagaggctgcgcgatgactaacagatgcagtggaagcctcctctcagggcacgttccaaccggacagagatagggacgagctgacactcgccctgcagactccagagcatccaggacgaacacgagggaaaggggtgattccttggaagattggtttcaaggaggacatccacacgtacaggagtcggatgaggagtaagagagataccgaggcgaagattgcagatctagagttctgggtatcgagctacgaacttagcatgcaagaggaggtggcaaggaaggttgatgaacgcatagccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattccttacaagaacttatcaataaaggtaagctcgtagtttatatattttagatttagccattccgctagttgctgcttatatatgttgattactaataaataatctctcacaacatgaaggtggcgtcgggcatggccatcccaacggacccttcaggtacttaccactgcaggccgattccagcaggatactcaaaggtcgaagttgagttggtcgaaggcgcgtacgaggacctcgagctggattatcctggaggagatggtgagactcatctacgagacaaaagccatgccattattctatggcgtagacggtatatcatcctccctgggcgacaaacggcgtctcgtgcaccatctcctccggctccgccatctcctcctcaggatcctgcaccgtctcctcctcatgatccgccagcaccgtctccacctcaggctccagcaccgactcctcctcaggatcctgcaccgactcctcctcgggctcctacacctactcctccgcaagctcctcttccggcaccttcaaagtcaagggccgccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttctttaggggtatgtctgcatctgtcaaggaggccatcaagctatcgaactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgaccgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccctgtatataagtagactatagaaaataatatactcccttttatcgttatagaatggagattcaaagggcccgacggcggagggttttcgatactggattcatcaaccctcagagagtaaacgtcgcaatgctcgaccaatatccacaagaaacagaggacaatctcgtccatctcctgaaggcgcagcattacaagacgttcatactgttgccgtacaacacagagttagtttaattttacagtcttcctacataccaaatttcattcccgtacgaacttgctaagtgtttcatatgtaatgcatcccacgcacattgcagatgacactgggtgcttttactcttcgacctgtcggcctgcaccgtcaacgtatatgactcaatggataaaaaagagtctacgtttgacaaggttttcgaacttatagacaggtaccgtcataagttcctctgttaattaagaaaatcttgttatgttaattgctactacgaatcatagctttaaactctatgtagggcttggtatcggttccgtcatttggtccgcggcaaatggagagaaagacttaggcggaagttcaaatttcctgtgagtacacatgctctacttttatatttctccgattcaaatacatagaagtgtatattaattagatctctcgttgtttgtcatttatttgtagtgcgcaaagcaaaagcagggaactaacttgtgcggctattacgtatgcgagtattgccactgtaacaccctgattttcgttcgggaataaaaatcaattaataatacattttatagaaattaaacaaaagttaaatcaacttaatcaagtgaattattgagggaattaaaaatttcctttaaaaattattggccgggaatattttgtaatattctttgtgccctaatgtactctccggaattttccatgaactttcggagctcgagaaatagttttaatagcacaaagatcattgcatcaattaaaataaaaagaaaacaaataaaatcctccttcctctctttgggcccctttcggcccaatccctcctttctctcccgcggcccgcgcgccccctttctctccctctcgggccggcctcctccctcggcccgctcggctctctctctccctcaagtccgttctgcctccccagccggcctctccctccctctctctccgacaggtgggacccgtggaccccacctgtcatccctttcctccagctccaactgccgccatggccgcctgagccaccccacgacgccgcttcctccgcgtgcctccacgctcccgcgcgcatgcagacgtggtccaccccacgtcctccccttcctccactttctcccccatttcccccccccaaaaatcggcgccgttcgagccccactcgcccacgtcgccggagctc

SEQ ID NO: 41522 - DNA, 33902 bp, Oryza sativa
cctttccccgcccctcgtcgccgcgtccttggtgagctcctcgtctccctccttgcctccctcctctgtctcccgtgcgcgctgccgcgccggtggccgccgccggtgaccacctggccgtgcgccgccgccccgctcgcctgggccacccggaccctccttgtcgcgccgcgtcgatctcgtgcgccgccgccgcccatgcgtgccgcctctcccgcgccgcccgtcggtcgccgtctccggagaccgcgctaccgccgcgccatggctcagctaggccggctttgtgccgtgctgtgccccagccgcgccgcccctggccgcccgatcggcttgggccgatccggaccatcggttctcgtggaccggtggtggaccgcctcggtggtcccggtccacggtggaccggcgcccttgtgccgctgaccggtggggcccgcttgccggcgccgcccctcccctttgatgacgtcagcaaccatcttttcctttggaaaaataaataataattgcgtcataattcgttaataattctagaaattcatttaaatggctcaaaacttctaaaattcatatctaattcattcgaactccgaattgagccgttcagcttgcaaaattcatctaaaattgagctctacatgtttgtttactttttatgtactgtttccttggtttttattagagtttttcctcgttttgcgtgccagcgtgtagttcccgtcgtttcggaagatcgcgttcgcagggataagagttcagaagatccaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattacagtattagacctttttagtatcagagtgagctgcgtgctcgagacatctagccatgcttcatggtcgtaattatccaactaaaatgcgactgaatggtgggctgtgggtgcatggttttgctagtcgcacccatgtcaattaaggaccggttcgcgggatgccctggaagaacttatcgtacttaccacaagccagcgtgggcaacggctgggcttgtagtgtagctttcctctagccgacgcatccaggcaagggtgggcgtgatggagcggggcgggccctgggacggcctctgtcgcttccggattcacctaggcacgagaggggactgcccgttgcccgctggggatgggggtgaaacctgaggtgtggtgtgcttggttagagggggttatgcgaagggtcctgtcacggcctctttccggtatgtcgtggtgacatgtcggcgcacggtaacgtgtcatggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctattcaacttggtgtagcgttgatcagtggagattcaatattactttaattactcaacagttttactgttttgctcaataaaatgttttacaactgcctttatgcaaatagccacaaacccctccttgtatccccttgcacgtctgcatcgttggtgtggcttgctgagtacggtggttgtactcagtcttgctattattcccccttttcagaagtgtagtgcttctgagctgaagatggagttagaggaccaaggctcagatcccagttgagttttgcctgtggagtggagctgaagccccgctaggatcgcctttttccgctgctgtcgttctgtttctgtgtgaggactaagtgcctcttccgtaagtattttacgctttatttacgtttggaactgtatattacttgtcattttgtgtaccctggctggtcctggacagggatttaatacgcaaaatagtctggaaatttgggttaaatttctgggcgtgacagccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcaagtactactactacgtcgaaatcgtagctagctaggacatataatggattgtaattaatacatgactacatatgtttctatatgcatgtgtacacattttctataatataaatatattttggtcatatatatatatatatatatacacacacacatatgcatttgcataacatatatatgtataaatacatatatattatgcatgtacatatgtactgaaccatatatatatatatgtatatgtatatatatatatatatatatatatacacacacacacacatgtacatatatgtatgtatgtatgtatgtatgtatgtacgtatgtatgcatgtatgtatgtattgaatcatatatatgcatggtttatatatatataaaaaggtcaactcgatctttagtcccgggactaaagatggctcagccggccacgtggctgaggcattaccaaccgggactaaagatagcgatctttagtcccggattggtactcccggtttggaaaccgggactaaagggggttacaaaccgggactacaaagggtttctccaccagtgtttcttagtcaactttgatgttctccgcctccataaactggctgtgtttagattggcccaaagtttaaaatttggttgaaattggagacaatgtgactgaaaagttgtgtgtataaaatgtttgatgtgatggaaagttggaagtttgaaaaaaaaactttggaactaaacacacccattggctaaaagggtgtagaaaaggctaaaaatgtcccaaagtaagggtgtgtttagttcacgctaaaattataagtttgtttgaaattggaacgatgtgatggaaaagttgaaagtttatgtgtataggaaagttttgatgtgatggaaaacttggaagtttaagaaaaagtttagaactaaacaaggcctaaaaacaccggctctataaattaacgagacaaagctttatttacaaaaaaaaccttaaactgaaattttacttaaaacaatttaccccgtaccctaaaatatttttgttttaaaaaaaattccgtgaaaccttaaaaaagggccttccttttttttaaaaaataatttttttagggtttttttgtcccgatttaaggatttgtggagaaaaacctagaatttgaaattcaattggaattgtcgctattccaccttataagctaacaaatgtgtgttagaaaaaaaaaccaagaactatactttgttttttcaatcctttgaaaagcccaagtcaaatcaggctagctctaaatgatcaattcctttcaaacaacactttcgtttttcaattatctattttattaagcacagattcccattatattactatattttcgtatctttatgtgcttgtctatgttccaaccttattctaaagaagccttcgtacgaaaacaatggagactataaaagatgttcacgtggaacaatcaaataaggtttgaaaagaagggatgaatttgtatgggacaaatttcttggagatggccgaattttcgttgcatgtatcaattttctgtccttacaatttttctataaacttaagtactcatactagtcaaataaaattatcgatattatgttcggttttccttcatacacttatcccatatacacttttcaattctaggtttttaacactattatccgatatccctactgccaaagtttcacccgttcatacacttatcccatataaaaatatttaatccctcatatccttgcaattaaaagaactgatacgtaaaaaaaaatggcaaaaaaacaaatgacaaaatacctctagagaaagaccgatttaacaagatccattgtaacccacgagcataaggcagtgtttgtcaactacttttctaactttttactatgtttttcgcacgtgcactttacaaactattaaactgtgtatttttttaaaaatgattttataaaaatttgttttaaaaatcatattaatatattttttaatttattttagctggtgcttatctaatcgatcgctccgttttgagtgctgcgaacgcagagactagacttttgaccaccgcgtgagtccaacccttcacggcgagggaaccatgacgaaaactagcgatcccctcctgaatcccccggcgccggcgagcaatcgcggcaacggcggcgtgcgccgcgtcccgtgggcgtccctgatcggcttcgtcgccctcgccatcaacttcgcgctctgcatctaccgcgcggaaggggatcgcggcgcgatcgcgtttgtcaccttcgcctatctcaacctgctgctcctcttctggtgcatccgccagttcgatcaggcgccgcacggatcggcggcgaggggccggatcagggccgccgtctggatcctcgccacatcgctcaccgccgtctttacatggaaggtggcggcgctgatgccgctccccgtcgccgccgtggcgtgggtcatggccgcggccaccgtggtcggtggattctacggcttcttcatccatgaggacaagtgatcgatcgatccatgatcggatgatcaaatcgcaaaatcggaaaagattactgctccattgggtctactgcttttatggcttcaggttgtatatcggtcaggttaattatgtggtggttgatatcgactcgatcgccggatgcactgtgagagtgttgcatatcataaataaatgaagtctggtgctatatgcattacaacatgatttgtttggtcttacttgtatatgtatgtgttgatttcacctggacatttcaaggtctatctcacattttctcctcgattgcattacagggggaaaaagtgcaggacaagaacatacgtctaatgtttatatggtttcaggttgagccggcctcgatcgtttctctgatgcttgctgatcataagtaaataaattgagtctatacatcaatggtactggtgctatgtgcattacaacatcatgctatttctcttaatttatttgtattacttgtatatattgctcattgcaaccagaaatttcagtctctcgatatcattttcacctagatttcagaggggaaagtggagggtctgatgagctagcagcagagtggcaggggcagtgaacatagttcatgtcctgaagacactaacgaacagagattcttgagcatttcctcacttatagcattacattttcaacccaaggatttggacggttttgacattcaggtatatatgtgctgccattgtgtcgatatcatcttttttactgaccttggatacgacggtgtggtggttcaacaactttggtagggttttgagcagcagaagtcagtagatgtcatgatagttagctagggagattagaaaaatttttttttaaccttttcccggtgatagtcggttcaacggtgtgcagccatctaagacaagaaagagcatccaaaggatttctatcgtacatcactcttttttttaaaaaaaaaaggtagaaaaggctgaagttctgatccatttcatcgataaagaagagatacgcatcgttccaagaaaatgttcagccccaaaacaccatcatttctatcatgcatctacaaatcttatgttgtttcttactctagatgtttcaaacaatcaatgctgcttgcacaagaacacaattcaccaatcaccatgctgtgatataaggaatgcaacagaaagacaaaaggtgaccacacctctttccattctttgtgcactgaacgatcatgtctatcaactatcaggccttgtttcgtttacgcctagattcaatccgagccgggaatgacaagtataataaaaaatttataatagatacaataagagaccgggatttattctgggccggaaaccaatttagtcatgataggtacaacagaatatccggattagttccacacctcttaactagtggattgattcccggtctcttattgtccctatcataagtaaattgattatcagtccagaataaatcctggtttcttattgtatctatcataaatttcttgctacacttcatttctggtccggattgaatccgggtgtaaccgaacaaggcctcaaggtaggaacaaagctgtatgctgctttctgtggccgttgcggcagcagctgcatgtgttgcagcttccaatgacttgcatatgggctggctttcatgtcaggtttccaactgggcaaagtagaattagtcatatgatccggccggcgatatgatcagcactagctagctgcctgtttccagcgaagctaacgatagtatcgatcgatgatcccagagtcgtgcagaacaaagctggatgcacaaagtagatgattattccaaagggctggctcacatcgagcttttagttagctgtgtccaatcaaatgatcctgcggcttcttgctcctagctgtgaaagacgtactccatgttaagttgcagaatcttcagtggaaatgcacgtcgtgacagctaatttttaataattttttgtttcaacattttcacaaacaaaactaaggccctttttaatttttttctgacagaaatagaattgtgttatgtggaaatacgaactctacgtttttggcgtacgattcacacaataagatatatattttacagtccataaaaaagtatctatagactatactagatactaaaatttgagagatctatatgacactactaaattttacactataaaatataatactaatacatgtcagtatcttattaaagatggtataattatctgcttataatacctacaacaacaacaagcgttgtcatggaaggacaacacgagtagtctctacaacgttcatgtgcaaaggtggcatgtactagcccattacaaggagcagccaatttcaacgtggccatagccattcgtaaaatatataagtaactattagcgtgattaagctcgtccgaacaaacgttgttaatcaggtatcatccaattatttatcacatattaatcctgcgaacggtgtcatgttttcctccctgtacgtgtgcttaaatatgggccgctaattatcggtcgcatgcatggatacgtcgccatttgcatctgttgcgaaataagtagagtaatgcggagtgggacatgctcaaccggtcaggtggttttcttgggtacagactgaagagacagcgacagccctccgtcccattattttaagtgtagctatgttttcatactaaaattctatcgtccgtcttatttataatttcttttaaaaaaattaaaaatataagtcatgtataaagaactattcatattttatcatctcataacaacaaaaacactaattataaaagaaatttaaataagacggacgatcaaaattggacacggaaactcatggttgcagttaaaatgggacgaagggagtacttctaagcaagtagtaataggagtaatcgtcccataaaaaacaaatctagcacgggatatgatattgcaaatttaaatactacactcacttcgtcccataaaaattaaacataacacatgatatgatacgtctcagtactatgaatttgaatagaatactatccagattcgtagtacgtcacataccatactagattaaaaaatcgtcccataaaaattaaacataacacatgatatgatacgtctcagtactatgaatttgaatagaatactatccagattcgtagtacgtcacataccatactagattaaaaaatcgtcccataaaaattaaacataacacatgatatgatacgtctcagtactatgaatttgaatagaatactatccagattcgtagtacgtcacataccatactagattttttttaatgaagagagtaatactattatgttactgtcatcctgcttaaaatgtatgtgccgttgcatataaattacatcctccgtttaaaaaaaccaacttcaaaaaacacaaactaaatatgcttattatctcaagaaatttggtttttttttgacagagaaaatgtctgtacggattgacttgtaaatcacgccctctgtctaaacaaattgagagcatgaatctagaaagatggaattataaaggtttggtttaggacggagggttttttttaaagatagagggagtaaactagataacttattaatcagtgcttactcagtggactaggtaggtcgatctcaaatgttattatttactttctacggtctttttaattccttataattcagaacatgggcataggtctatggtcccgttcttagtagctcattgatttccccgcacaattttatacgtgttagttaaattagatttgttatacaactcttagcttatactatacgccgttaacttttaacatgattttgatcattcatcttattaaaaaaatatcatttatttttttacttattttatcattaaagaaactataatctcaacatattcttttcacatattcatttatattaaactttttatactaccccaggagtttggcctcacagttttttattttttttcatattcacttaaatgtgggccctacttctaatttgtgattaggctagcgcatcagcacaagtggaccaaatcaatgtgccacatcagcaaaaaccactcttaaaactgttaatggagccaaattgcatcgattttaatatcacgattaggagatacaaataatatatacctatattatttgggggagtaaatgtggacttagtccttccagcattgatctgctaacagcccacatgattgcggagaccggtatgggagacgaaaccgcgtgatctggtctgagggttcgactgttcgagtcggttcgaggcccaggagcattggtagtagtactacgtataagcaacgtcagtgaatgcgtcagtacctcaaggtggataagctataagaagtagtcgaagacgaaattaagtactactactacaattaatacattttgtgtaacatttgtacatgtacaatggtttatgtatatataaagtaaagctagatatgtatatatacatgtgtagaaagaaccaaacatttgcaatatccaatagctagcagccagtacgtaacgatatttacacaggaattaactgttccattgcttcagcatgtcgatcgatcgatcgatcattttcagtctacgccgggatgatgaaggaacaaggcgtagaatcccccaagaacagttgaggcggccatcacccaaataatcgcatccaccggccacggcatgagcgcggaaaccctccacgagaacaccgcggcgagcagcgccgtgacgacccatacgccggccttggcgccgcccctcgccggcgaattccgcggcgccgcctcgaagcggcggaggaacacgaagagcagcacaaggctgaggtacgacacgacgatgaacgacgtctcggtgatttctccgtgtgacctgtggatcgcagcgatcgagcttgctgtgaggaggataaacccgatgcaggtcgtagcagcttctgatgccatgaaacggatcggagtaaagagtgacgtcgtctggacgtccgatatattatatagccggcgacaaatactggaaatgggatcatggtttgttagcatgcatttataggccgcgcttgcctgcgcgtcgggttgaagttaggtcggtgcatgtatggccgagtttagtttcaaactcccaacttttccatcatatcaaaacttttctacacacacaaacttctactttttcatcacatcgctccaatttcaatcaaattttcaattttagcgtgaatgaaacacacttgattctcaagcttacggtggtcatcagtatgatatgattaacgagtggatgtatatcgatacgcatgacgaggtaatgatcctttttgaacggaacgaggtaattaatgattgttggttctcaagcttactgttgtcatctgtatattctgtagcagtataccatgtaaaagatttagtcttatgataatttctcacactatcattataacaaactgaaatatatatatgttgctaatattcctataaacttataattttattactatagttacagttttctaaagtttactctttaaaaaatacagtatatatgtcggtttcccggtgcactacggccccattagtaatttactcgtcggttcgtacggccctattagcatgtatgtccgccgttcgtttggcccactaacagcatattaaacatgtggataggatcttcagtgagggccagcacaacacggaccattaatcaatggcggttccgggtaacacgctgagtcaacgcgggatcagcgaccgacgatttggtcacgcgctccaagctacgtaaccatatgattacagttattctttacttctaacgtaggctgtgcttagcttgggggtctgatcggtcccgcccccatagacactcctcccacttctcccctttctcctccccttcttctcctcctattatagtacaccaaaaaaaaaattaaaaaacaaaaagttagaaaaatttatgtataaaaaatttgaattcaaattcaaatttaaatcgggtatgtaaacttttgacttataaactttgaatctataaactttaggtgtataaactttagatatatagaaatactatatatagaaaatatttgaattatttgaattcaaattcaaatttgaatcagatataattcaaattcaaatttgaatcgggtatataaactttaggtgtataaactttagatgtgtagaaatactatatatgaaaaatatttgaatttaaattcaaatttgaatcagatataattcaaattcaaacttgaatcggatatataaactttaggtttttaaatttaggtgtataaactttagatgtataaaaatactatatattaaaaatatttgaattcaaatttaaatttgaatcggatatataaacttttggtctctaaactttagatgtgtaaatttgagatgtataaactttaggtgcataaatttactaaaataggaaagtaatacggtgccaaaaaaggaaaccaggtagagggagggagggggaggagggttcccgtgcttagttcccttcaaacttctaacgttttcgtcatatcaaatgtttgaatacatgtatggagcattaaatatagatgaaaaaaaccaattgcacagtttgtatgtaaattgcgagatgaatattttgcgcctaattacgccaagatttgacaatgtggtattatatcatgatttgacaatgtggtgctacagtaaatatttgctaataacggattaactaggcttaatagatttgtctcgcagtttacaagcgaaatctgtaatttgttttgttattagtttacgtttaatactttaaatgtacgtgtgtatacgttaattttttttcgaaaacaactaaacacggccataatcaaaagaaaattatatttattttatttttgacaataaacattactaatatcactagtacagtaggaatcctcttctcatacatttctcaccaagtacagtacacgccacacgtcactgctaatttaattgtcaccgcaagcttcatgcatttcagcaattttgaagccgcggcgatgctgcatgcagtaattttggggcgcacagaaataaatcactggcacgaacaaattaaatggtcatcccgcgcgccgtgtgcttgcccggcgcgatcgatggagaggcgccgtatcaaattagcaaattaattagcaggagtaccgaattaatttcaacatggcaaaggttaactagctgtactgtttacataattaatcatcaagaaactactcctagcaagcattgcttttacatgaagcacggagggggagataatgccaaacatgagtagcggccgcgttgagcagttgagcacgcctacgcaactatttggatatatatacattgggacgtgttgactgagcagtgagcacaaagagtcacggcaacgcttgacctgttgagtacggatggtctccctggctagatgatcatcagggtgttttccttgtaattatcttatggataagtaccagagttgaaaactcttacacaagagtacaagacatgtcattcttcagagcctatcccctcacaacggctgagtatacaacacaactcttaaccattaatccatcacaatattttttttattacccttcttacgagaaagcaaaattcctttatgaaaggtaataaatgattttaaatttaacattgatgttttttctttcctctcccctcgctctctcatgttatcaaatttgtcttgttagttagtaaagctacgagcatttgattaaaaattgtggtacatgtcctaagtgagacgtttcatgtcaaccccttattgttttgtagtgcggtggagagactgaaatgagctcgaggaaatcgaaaagaaaacacaggaacgaggaaatagacacgacgtcagattacagtctccagagaactcgctttgatggacgataggatagacatgctgatatggccaccatgatcaaataatgtatcaaaattatgggagacttgtatctatgagagcatctagactctagtttccttttccacatctttatctgtcaaattttgatttcgaaccatctgatcttagtctaatggttacattactactactccctccctctctagacccttttatccctctccaacctcaccatcttttccaaactattcaaattagtcatatctaaactgcactatactagaaccggagatacactggtgacgtctttttttccctcagaaccaacattcctctacctttgacaccctttccatcatcgcaagcatgatgaccctcctgttagaataattgggctaggctcgatttatcctattaaaatctcaaaggcccataataagtgtgataataataccaccttaggatttaagcgaggactatctcaacctaaatagggagttattggagactccctgttgaccggttgaggtgggagtcggaaagccacacgcgtgcgcgccgggccgaggccgtggccgtggctggcgtcacgtcacgtcgctattcttttgcaaccacgatcccacgttcccacgactgaacgatcacaacgattcgcttgcttctttcccgggtgttagttcttcctcctccgcgcttgtgctgttctcgcttctgatcgcttgcgcgcacgagcacaccttcgcctgagatctgcaccgggtaggcgggtgatcaggtttttggggagtgcttctcacacgactgctcgtccaccatgtctgcgcctggagccggagcttccgatggtgcgcctggagctggagccggagatggtgcgcctggagctgcgaacgtcaacaccaacggaggcaattttgcctcacaatccagcggagggccattctcggggtatatccttctcctgctgttaactcattcgttcatagcgctgttagtcctgttagtcgcaagtcaattgcgttcttgcttatgatacctttagcatgctactggttatgctacatgttgtcactagatcaccccacactgtttatgccatgattattgtcttaacattttggattaaaatatgccgatatatgaccatatttccaacactccaaaaacctgataggtcattttcggtagttggctttgctgctgcactgaaaccacatgcttttgatggttctaactataagagatggaaagcacgtgcactattgtggttgacagcgatgtaatgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttccgggaaggacatgtgggatgcacttgaggccaaattcggagtttccgacgccggcagtgagctgtatgtcatggagcagttctatgactacaagatggtcgatgaccgttctgtagtagaacaaactcatgagattcggatgctggctaaggaacttgagaacaacaactatgagttgccggacaagtttgtggcaggtggcattattgccaaattgccaccttcttggtcagactttgccacttctctaaagcacaagagacaagagttcagtgtttctgatttcattggctctttgggtgttgaggagaaggcgagggcaaaggacgtccggggcaaaaaggttgagggaggttctagtgccaatatggtacagaagaagaaccctcatgcatcccacaataacaagaaagtcaagcatgatgtcaaacccaaggctgcaaccaactttaagaagaaaggcaagggaaaggcaaagggagactgctttgtgtgtggcaagtctgggcattgggccaaggactgtcctgagcgcaaagacaagaagtctgccaacatggtcattagcgagggaggaggaatatcggggtacggtaaaatattacctacagttctctttgtttttcactcacctgattggtgggtggatactagtgctaatattcatgtatgtgctgacatttctctgttttcttcttatcaggtcgggagaggttcctccttgttgatgggaaacgggtcgcttgcggctgttcatggtgttggtatggtcgatctgaagtttacttcgggaaagaccgtgcagctgaagaacgtgcagcatgtcccttcaataaagaagaatcttgttagcggctctctactgtgtagagaaggttttagacttgtgtttaaatccaataaatgtgtcgtatctaaatatgggacttttgttggaaaaggttatgacagcggaggcttgttccgcttttctttgaatgacatgtgtaataatcataatgttgtgaaccatattagcgagaatgatgagtctaatgtgtggcattcacgactctgtcatgtgaatttcggttgtatgacgcgcttagctaacatgagtttaattccaaaattcactttggtgaaaggttctaagtgccatacttgtgttcaatcgaaacaacctctcaagcctcacaaggcatctgaggcgaggaatttggcacctcttgaacttgttcattccaatttgtgcgaaatgaatggcgtgttgactaaagggggaaagaaatatttcatgacaccgatagatgattgcactaggttttgctgtgtgtatctattgaaaacaaaggatgaagcattgcatttctttaagacctataaagctgaggtagaaaaccaacttgaaaggaaaatcaaacggttgaggtctgatagaggtggggagtatttttccaatgaattttcatccttttgcgaagagtttggaattattcatgagaggacgcctccctattcaccccaatcaaatggggtggccgaaagaaagaatcgtactctaactgagatggtgaatgccatgttagacattgtagagctttccaaggaatggtggggtaaggcagttttgactgcatgtcatgtcctgaataaaattccaatgaagcataaggaagtaacaccattcgaggaatgagaaaggaagaaattaaatctctcatacctacgaacatggggctgtttggccaaggtaaatgtacctatagccaaaaagtggaaacttggaccaaatactgttgattgtgtgttccttggttatgctattcacagtgtgggttatagattcttaatagtaaactctggagtacccggcatgcatcttggtacaattattgagtgtagagatgctacattctttgagaatgaatttcccatgaaacatacacctagcacctctagtcaagaaactgtcatgccccatgagcactttgcaccgatagaacacaatgatcaaacgcctgaggaaaatcctgaggaggacaacattgtagatactcgtaagagtaagagacaaagggttgcaaaatcctttggagatgactacattgtatacctcgatccacaccccaagaaccatagaagaggcatattcatctcctgacgctgactactggaaggaagcagtacgcagtgaaatggactcgattatgtctaatggtacttgggaagtcattgagcatccatatgggtgcaagcccgtaggatgcaaatgggttttcaagaaaaagcttaggcttgatggtacaattgaaaagtacaaggcaaggcttgtggcaagggttatacccaaaaggaaggcgaggactttttttgacacatactcaccagttgctcgcttgaccacgattcgagtactacttgctctggcagcctctcatggtcttctcgtccatcagatggacgttaagacagctttcgtaaacagagagctggaggaggagatctatatggatcaaccatacggatatgtactagaaggtcaggagggaatggtgtgtaaactgttgaaatccttgtatggcctaaagcaagctcctaagcaatgtcatgagaagtttgacaccacgcttacatctgcaggctttgttgtgaacgaaactgacaaatgtgtgtactatcactatagtgggggagaaggagtgatcttgtgcttatatgtcgatgacatattgatctttgggaccagcctcaatgtgattgaggaggtcaaggactatctgtccaagagttttgaaatgaaggatttgggagaggctgatgttattcttaacattaaactacaaagaggagatgagggtgggattacacttgtgcaatcgcactatgtggacaaggttttgagtcgctttggatatagtgactgcaagccagctcctactccttatgatcccagcgtgctattaagaaaaaaccgaagaatagcaagggatcaactgagatactctcaaatcattggttcattgatgtacttggctagtgcaacgaggccagacatctcatttgctgtaagcaagctgagccggtttgtctcaaatccaggagatgatcattggcaggctctggaaagagtaatgcgctatctaaagggcactgtgagctatgggattcactataccgggtatccaaaagtactagaagggtatagtgactcaaactggatatctgatgctgatgagataaaagccacaggtggatatgtgttcacacttggaggtggcgctgtttcctggaagtcttgcaagcagaccatcttaacgaggtcaacaatggaagcataacttatagcattagatactgcgacagttgaggccgagtggcttcgtgaactcctgatggatttgccggtgcttgaaaaaccagtgccagctatcctaatgaactgtgataatcaaacagtgattattaaaatgaacagttcaaaggacaacatgaagtcatctaggcatatcaagagaagactgaaatctgtcagaaagcagaaaaactccggagtgatagcattggactatgtccaaacggctagaaatctggcagatcagtttaccaagaggctaccacgtaatgtgatagacagtgcatcgagggaaatgggcttgatacccacctaaggttgcacaatagtggaaacctgtccattgtgatcggagatcccgtgaatttggatggcgaaacaaactattgtgtgactgagagaagagacccttgaaaagggctcattttcatgatgtacttctcttctttcctgcatggtaggatggctcatgccttaatgtgatccgagtggcttttccaagcagagatgttgacctgcagaacatctcagaagtaacacacctatatgagttcgactgctagtcacagtctatgaggtttgggcgatctctagatactcatgaaaggcctggagtttgacttatatgctccaaacaaaggggatgcaaacggcagcccagtaccagtcaagggtttgagtgaaacctgatcacacaaaactgacaattcaaggcatagtccattgttcagttgtggtctgatgtagctcatttcctagttggaagttcaacttaacagtctccaccaaaacactggtatatcaaacaagcacaaccttgagaacatttcttatgagccttgaagtttggtggggattgttagaataattgggctaggcctgatttatcctattaaaatctcaaaggcccataataagtgttaaggataatagtaccacctcaggatttaagcgaggagtatctcaacctaaatagggagttattggaggctccctgttgaccggttgaggtgggagtcggaaagccacacgcgcgcgcgcgccgggccgaggccgaggccgaggccgagggcgtgggcgaggcgaggcgtggctagttggctggctggctggcgtgcgtcacgtcacgtcgctattcttttgcaaccacgatcccacgttcccacgactgaacgatcagaacgattcgcttgcttctttcccgggtgttagttcttcctcctccgcgcttgtgctgttctcgcctcctcgcttctgatcgcttgcgcgcacgagagatcggaaggagcaaggccttcggaaccacaccttcgcctgagatctgcaccgggtaggcgggtgatcaggtttttggggagtgcttctcgcacgactgctcgtccaccatgtctgcacctggaaccggagctgctgacggcgccgttgctgctggagctggagccagagatggtgcgactggagctacgaacgtcaacaccaacggaggcaattctgcctcacaatccagcggagggccattctcggggtatatccttctcctgctgttaactcattcgttcatagcgctgttagtcctgttagtcgcaagtcaattgcgttcttgctatatgttcatgttcatgatgcttatgatatctttagcatgctactggttatgctatatgttgtcactagatcaccccacactgtttatgccataattattgtcttaatattttggattaaaatatgccgatatatgcccatatttccaacacctcctagcacccaaccgactagatgttccaagtttatttattgactatttctacccctggcacactcatcactcatccatcccatggcccatagccccaaccacgtcaccgccatctcaccacatatcatgttcgctacccccaaagtccttgaagcacaaggggttggaaaacaacgatgatgatgaacacctgatccctaaaggcattaggtttccgtcatcgtcgcactatcactgtagatagacagctcgtctaaacgacattttaattgtgtcggaccggatcgtgatttaaaaatcttggcatcaacctaaagacgataagattagaattgaaatccacccaaggatatttgttgcaaactaaaacatatattcattgtagtctttacataatagatacattatttcccatataaagtataggacatgatcacatctaatagactatactgtaaaagaaaaacacaaaaaacaatagtaataatctagaggtttacaacaccatgtttttacatcatttgtcaaggtacagttcaactatctatgtttttttggtactttccaacaatatgaattaaggtatcacaaataaacactgctgtttgttaggttgggtaacgtaaaccttttgccgccaaacagcacgtacgtatggagcttttgaagctacaaataatcaaacaccgtttggaagttttatctgacgtgatatatatattcttccatctactgccgaccagaccaaaggaacagtgtgtagaatcctccaaccaccgtggacgcagccatcaaccaaacggcggctgccacaggccacggcatcaacgctgaaactcgccatgagaagacaaccgtgaggagagacgaggagaaccagacgccggccttggagcgagatttcgccggtgagttcgccggcgccctctcgtattgctgcaagcaccagaacagcagcaggaggctgaggtacgacgtggcgacgaaggctatgccggcgatatctccgtgcgacctgtagatggctagtagcgagttgagcgtcaagaagccaaaccatacgtaggccagccatgaagccattgccagccgcaacagatgatcgatggtctgttaaggcagctagctccgcaggtcgcgtctcccggccatattatatatgtcgcctaattaatgcttattgttcaagcctcgagcagtcatatattaccgactcaaatcttttgacttgtattatatgactatccgtttatttatgttttcaaagtagcgaatcaaacttaattaatttgtttagcttaatactatatacaaacagcctagacacgtaccgcgtacgtacactcttgcgatcttacgaagcaaggaagcatcatccatatatacgtcttccccaaggctcttgaccattgaggcattgacttcactaatctaataaagaagtcttttcgcgtcgtgtagtccacccgtttgataattaaattacttgttactttaacttacacggcagtctaagggaaataaattctcggcattttccctcgcaggctgcagtgatcaatttgggaacaccgatccaaaacgaatggatgaggcatgatctaaggttagaaaatccatgtccctctgcattaacaacttctcgctacttgcgcgtccctgttcctgaattttgtcttataccagactcaagacctaccctgtaggagcgaaaaaacctacagggtaagacctatacctgcaaaatcaaaatttccatccaattatctaactgagacaagcacaagatctcctagctcaactaccagatcaggtatatatatacgtacatattttgcatacagaaattttcaaattgggagctttgagaatcaaacggaaagggaataattaacctcaacatctggaattctctcgattgaggaaaccgaacctttcaacaccgcgtcactcagcgaggagcggcggtgaagaatcgaaccaacgcaccaccgccggttggtgtgcagtgttgctatatgaccaaaagatggatggatggatggctggctgcggcggccttcgtttccggccatcggcgatgagcagctcgcatgcgactgcgctccgccgcccgccgtacgtcaaggtgcgacgggcttctgttccgttgccatctctccttctggcttctgctccggtgctcgctcgcgtttccttcctcatctgcaaaggagatgggatagttgagaggactggtgccgaagtttcaccgaaatttcagtataatcgacacccgggcccggtcttaaaaggagagagggagacattaacaagtgacgttgggccagtttggtttgtgaccaatgttggccttacgaaaatttggtatgccaatttttgataaggccaacatgtgtttggattgaagccaaattgaactaatttggctattgaaatgacctatgttatataggcatgcttcaattcaaacatacacaattattgttgaggttgctaaaaaattggcaagcctaatttagatctcaaaccaaattagcccgttctgccgttttatcaatgaaacacgtatgggttacgtcaaaccgtcgaagtcacctgatccacacaatatatatattggcttagttccaaatcttttcttaattaacatacatataatttatcttgttttaactatgtattttaaactcgtacgaaaaccatttatatagaagttgatttaaaattaatattaaatatattttcaagtttttagtaattaagattcaattaatcgtacattaatagtttatctcatttatatgcatacttaggctgtgtttgcaagagcaagttccaacactctcctcccgtttttcgcgcttacgcttttcaaactgctaaacgatgcattttttgtaaaaagtttctatacgaaagttgtttaaaaaaatcatattgatccatttttgaaaaaatagctaatacttaattaatcatgcgctaatggactactccgttttccgtgtgcacggtgcatgttcccattctcccctagtgatcagagccttaatcttaatactagactttcttgaacgaggcttatttgctatactatgtcccgttcttttctcatgaagataaagattttacctcagtttttgttagcatgtttttcaaattacaaaacgacgtgttaaaaactttttatataaaagttgcttttaaatattaaatatatccattttcttagtttataataattgaaactcaattaatcatatgttaatatgttaatggttttcttattttgggtgtccgcttttataccttcggtaactaacgttcattcgtcaatcaatcactctcttcattaaaaaaaaacttcatagttctatttctactctctttatcctaaaattaataaaattagtagtactagatttttattttaaaacagaggaattacatcattacctagtccacctatactagttttctactcccttcttcccatattataatgaaatacggattttaggtggatgtgacacatcctaataatacaaatctggataggagtaatccacataaaatcccttaaaatatgggatgcaatgagtaaacagtacctccatcccaaaataagtttattttcacaaaaaagatgataatacctctattttattaaatctcatgtaattatcctcactttatctatttccaatactatttttataaactccaatgcaatgattactataaaaataaacttcttttaagataagtgaaagaagataaaaataaatttatcatgggacgaagaaaataggattttgatctttctccttaccttcttggcatggagtagtatacttgagtacttctttccaatccgaatatccggagaaaagaaaatgacttgcacccgcaggtgctgtgactctgtgggcctgtgataatatggtagcaccaagtactgactgtcttagagaaattaattttatgggtatttgaaatttatctaaaacttgataaacttaaccattcatctactgtaggcacattgacatgtgattttaccgctccttttatatttcaattctaattttatcactctaaactttatattgtctatactaccgggtgtactgtaattctttttttcaaacgactgctgtacagacagccccatttcaataatacatatttccttcctcccaaaatgttacgaatcctaacgcaactaatcctatcctcgatataacatttgggaagaaagatgatcctcgatgtaacatttcggaagaaagatgatgggtgtgtttagttcacgttaaaattagaaatttgattgaaattggaacgatgtgacggaaagttggaagtttgtgtgtgtaggaaagttttgatgtgatgaaaaagttggaaatttgaagaaaaagttggaaactaaaccaggcctatatatggtgtgtttagttcacgttaaaattgaaaatttgattgaaattggaacgatgtgatgaaaaagttgaaaatttatgtgtgtagaaaagtttcgatgtgatagaaaagtttgaagtttgaagaaaaagttaggaactaaaccaggccataatatagtttgtttatatttgcagtacatattgtgacatacgacctccgtcctaaaaataagtgcagctatgggtatccgtatccaacgtttgaccgttcatcttatctgaaaaatttatgaaaaaattaggaaatattagtcaaacataaagtactatttatgttttatcatctaataacaataaaaatttaaaataagacaaacggtcaaatgttggataacagtgtaaaactgcgcttgtcctgagacggagggggtagattccagcaatttctgtaaacaaaaaagttaacctaagagaaaagagaaaatatgacatatcatattagaacaaatataaaagattcgttgtattaaaagagattatatccccacatagcccttgtttagttccgaaataattcttcaaactttcaactttttcatcacatcgaaactttcctacgcacaaactttcaacttttacgtcacatcgtttcaatttcaattaaacttctaattttgatgtgaactgaacacaccctatagctagagattgtttttggacggaggaagtataaaagcaacagccgctcatcctgtcatccatatccactgaagataagatcactcttatccatacggccgggaagacaatccagttcctctgctctcgaggtctcgcctgagtcctcatcctgccaagtgctagctatggttgaagtggacgatggatccaaacggcagatcggcgtggattagcagggcggggctgggcatcctcaccgtcaactccggcctcgccatctaccgctccaggggggacgcagccgcggtcgccttcgtcctcggctcgtacaccgccctgctcctcctcttctcctgcctctccgccttcgagcgcgcgccgcccgggtcccccgcgaggggccgcctcaagcgcgcggtgtgggcgctctcgacgctcgtcaccgccatgttcgcgtggaaggtcgcggcgctcatgccgccgcccgtggcggccgtcgtttgggccctcgccgtggcaacctcgctcggaggattcttggccttcttcatctacacctgaagtggtgaagccgatcgatcgctgtttctcggtcgcctgtgatgtatggatgtacatatagctagtaattagctatttagctattactagtttgtacatgcttcaagtgaactatactctgcctctgtacatatatatatagtactttagtaacataccggatgtacatgttttgtacgtatcagcgtatgaatatttctttctttttcagttttcactctttgttccagcgtcttgttacagttccaattgatctaaacgaggaacaagttcactttaggtcccccatttgttgctgggtcagacatccgtccttaacccgcaataacaaacattacgcgtcacttaactctgcaaatagtccacgtctacatggatggtttgacttaatccacgtcctaactcctacgtggtattggaagcaaaataaaaaaaatattttttttaaaaaaaaagacaattgcttatttggctccgtttaaactgatcctactttttctagtttgtttatgtgaccttacttttcaaaacaaacaccccatctgacccttttccactgcaccactaaagtttcattttttttaaagaaatataattattatttgtaatgaccaaactaccctcaagaaatcctatccacatctaaccctatctattcaatcccgtctttctcgtatatccattgcagcggcggcacgcggaggggacaagcagccacgtcagctagtggaggtagtggcgacggaggggcgcagagggaatggacccacggcggtgcgtgcgcggaggcggtgcatgcagagaatggagcagcgacggctacggcgagcagaaggactagcggtgatggtggctcgatgacgacgacgaggagcaacggcggcggagctcagctatgacggtgtgcaggcgatggatccggctttagctgggtgtgtgagccatggatctgacgacggctgggcatatgagtcacagatccgacacatgcgggtgacggatcccgtggcggcgggtcagcgacagcggcgctgcggtggtctcagggattgcgggtcatcaacgacgcacgactccttccccgcgccggcaagctctccgacactggccgccgctcgccgccatcctctgcgcctctctcccgcatgttggtgagctccggcactgcgccgtcacttctcgtccactacgcgccggcctcctccttccttcgcgcgcgtgatgccgtcgcccgccctccacacgcccgcgagctccagcgccgctccctcactccccgcgcgtgttggcctcagtcttcctccacgcgcgccgtcactgggtaggcagcgacaacgacgacgccgtggcgaagagcatagggtaccgctccctccctccccgcacgtgctggcctccgtcttcctccgcgcgcgctgccactgagtcggcaacaacgatgatgacaccgtggagaagatattatattttttttgggatgctatccaaaattttgttatattttaattatatttgataaaataaacacatactccctctatactcataaagaaagtcggttaggacaatgtttaagtcaaaccttgggaatataaatcatgaataactctcaagttgttgagtttaaaaatataaaaattatatgaatatatttgtcttgaaaaatactttcataaaagtatacatatatcacttttcaataaatatttttatagaaacaagaagttaaagttgtgttttgaataccgtgtcgctgtcctaaacgacttcctttacgagtacgagggagtataaaaatgttttatttttaaattatttttttacaaatacgacgtttggccgtgaaagtcggccggacggctctactactcctatttaatttttaaagtacttttttaagaactcttttaaagtactggtactcgtagtacaactactcccatgtagtatagcagagcagctacaataggttcactattgtatagagtgagtgaaatgcatggagtcatccaacttgtgcttaaatatttggatcgttaatatgagttaagtgagttatttagcaatctaactatccacatgagcttaccttgtacgcatagcataccgcctaagactaaaaaaactgcatctagacatccgcaaccacttcacaccccatccgttgccttctaggttttcgcctccgtcgttgtttatattcataacttcttgccgccgctgggtttgatgacaaacgagagagagactaagaactagaagaactcatcgaaacagacaagtgaaatgatttggttcacttaatttcaagtatttccaagtgctagctagtgatgtgagaaaggaaaaatatacacacaccgttttctgcacatccaaaagcaattttcaatcataggcagcatgccatgtgtacaaagtatgttcatgtggatagttagatagataaataacttacttaactcaccttagtgacgtagatgtgttttttgaaagtaaagtgatctgcatgacacatctaaacaagttaaatgatcttccatgtactccctcattctcattataagcacaaccataagtttttgtgtccaactttgatcgtctgtcttatataaatttttttaaaaacataagtcacgtataaagtactatttatattttatcatcttataacaaacaaaatactaatcataaaaaatattaaatacaatagacgatcaaagttagacatgaaaactcataactgcgtttaaaataggacagagggagtgttatactttaaacctagctatatcatcacaatccgatgtggaaaagagagaattgaaaagagtgtaaaacagactctaaatatataaccgtaggctccaagagagatgcaaatggaggtttccaccaagagcttgcatgctacttaccatgaaagtgagatactacctccgtaccaaaatatagatatttttagcacaatatcttactctaaaataaagctatttctgcatctatctccttctctcaaccaatcacaatcattcgtcttcacctactctttcttttcaatcaatcatacttcacttactccaatcattatcacctacctttttaatacatgtgacaatctaaaaaatatttacattttaggaaagagaaagtatattatagaatgatgccattgattgtagattgagtgggctgctattatacttttcttatgtctccaccatacctaaatagagctttcgacagcagaacctcctaacaatcgaggcccacatgttatcgataggctcatctcacgggccggcgacgtgccatatgtgaacgggctccatatgcctccgtatggtcctccccagcaccggccagcagctatgaatggacacaaacgcctctcttatgctggccggcatatagagtaattttctgctgtctttaggggaaagaatataccccaccgtgattgaccaagccgatggggaaagccacgcgtgattgccggcgtcggcactgaactctttcggcgtggaacacggagcacgttaggcggagtcgcggagacgaagagcaagtataattgcaacgagtgtggaagtaaggtaactagtctatctggcaattttccatcgccatggattcagttgctagcggttacagcgcctgaaacacaacacattatgcttgcattgtttcaccccgccattgtagaaacggatggaccacaacgatcgccattcttctttactcaccaaggtaggattcggtgctctcacttgcaattccatcttcgccatctacaggtcgcagggtgacctcgcctcggtggccttcgtcgtcgccgcgtacgccgcgctgctgctgctcttctacttcctcggcaagttcgagcgcgcgcgcccggaggagaggggcaaggtgaaggcggctgtgtggtcgctcaccacgctgctcaccgcaatgttcgcgtcaagggtggcgcctctcatgccgccgctcgtcgccgccggcgtctggatcatggcggccgccactgtcgtcggtgggttctgggctttcttccttcatccctgaaattgtattgcagagaccaacagttgtgtgagtttgaaacgtgtattgtaactttggaagcgcatttaagcacattaatgtaagcgatcgaatatgatatacatcctcgttttctttttacttgattttctgctatttctttagccgcagccaattaagccaattttcatgaaaggccataaccaggaaaacaaaaaaaaatataccacccctcacaccccaacaacgccaacacacagactcaggagaaggctagaaacggaccggccgccgctaagcgtgaccgaccgctgctagaccagcaacggaacatagccaagatcgtccaaaacccaacccttacaaccaacacaaaaccccaatctatctaagtctttgggatttagggagagagagtgtgagagagaaaaatggaactcctctccccctaggccctccaacgtggccaacttgcagaagttagggcgccgacacaagaggatatgcttggggggtttcgacaaggggatgcctagacaacctctccaagctgagaagggacgaaacgccgccgctgctgtccgtcaaggtctcaaagagaactgagactgggctttcgcccggcagccacacttgaggggtgagacgacacaataacgtcctcaggacgggaatgacgctcgaacatcatcgttgccctgggttttcacctgtcgtccatcgcctatcgatctaccactgatacaccattgctcgaccgccatctaaaccttcgtcggcgcatgggcaccagtgcaccggcgcccctgtgggccagtctctacgtgcctccgctggcctcccctcctgatgcgcaggccacgaccaccgccgccacgccagtcggcctcgtcgtgccgcaccgacacacgcctcggccacgcctcctcacgccacggccactgaccacgcctcctctcgccatgccggcctccggggctcctccttgcgttgcacggccaccggccacgtctcctcgcgccaccaaccgcgtctcctccgtcgtgccgtccgctagcctcgccggctagccacagccaccatgcctgctgccgaccgcctgctcctccgcgctttccggccacagctatcgtgcctccgcgcctgctggccatagcagccgcgccttccagctcgccgcgaccgcccgtgcctccgccaccgtcctgcctgccgcggccgtcgtgcctgccgccgcctgccaaagcctcctgcgcctccgtcaccgacgccgcgcccgcaccaccgcagcctagatccgacagcggcgacgctagatccagctgcggaggtgctagatctgacggtggcggcgccggatccgccaccatgcgccttgccgccgcacggccttcccggctgccgccggggtttggagcctcaccgccgccatcctggcaggccgcacagtttcaggcaacgtgcttcgacggcggcgagacggggagaggaggggagggtgacggcggccggaggctaggattcgtccctggtggccggtcacccgcacgaggacgacagggagcgttattttttttgtccgtgaactgaagctatataggagagacatttgacattaacagaacatgcccataagcataactcaacttgctggctcaaatacaggaaagtcagtccatcccgcaccaggcccaaagaaaattgtccaacagaaaagtccaaaacgctagtacataggcatcgtttagatccaaggcgcataatcctagcttgacctgacaaagcctagcgtttagaactgtaattgtatcgtagcatttgggggcaagctagcccgaacgggcaaggaaaagcttgctcgcggtggagagccaattcggctcggtccatcgacggcaaaagtaagcccgcaacaacctggtttgtctaaatgagctatagctgaaggtgacaaacaaccaaacgtacccggcggacccctccccggctcccctcccctcgttctcgatcgatccagatcgatcggtgtcggcaaccgccgccccgtgcaatgcgtcgcgcctcttgctccctgcagcctcccctcatcccgcgctctgctccctccatcttgcttcgcgtcgcccgtccagtggtcggcgctcgctgcttgctgctggttcatgccccaggacccaagcagccgtgcggaggcgctgtcctatgccgtgagatgcccactggtcgccgtcggcctcgcgatgagcaacccaggccgagtgcgtccctatccaacatggaggaggaagatgaggtgccgccgtgtaggtgcaacaacctcctgtgatttgttcaaccgttgaatgatgatttagttgttcaacacttgaaaggcttgtgatttgttggtttgatacttagacacagttgcatacttggatttgaactttggttgtataacctgaatctccacaggacggatttcatgctaatttgttggttgatttgaaaggagcgtaatgcaagaatttttcaacacgtgtctaagacactagatcaacttgcggaggatagtaaagaggaaattgctgtctggagggtggctgggattttctcccaatttcgcgagtaatcgccatgactgtctgcggggtttagccctgctttcttttctcgttcttagttggctgggtcctttccttgctaccgtggtatagtaatatcgttgtaacattttactgtattttccctcaaatcttaaaattggttggctattcttttggccgacccggtaaaaaaaaaaacctaaatctccattgcaatcattgcaatcattttggtttggttgtattggctcgcgacctaaacgagctgaccagcgagccgagccgtgctatttcgatatttaccccttagctgatctcttaaatatttttttatttaattaatgtaggcgtcggtccttccgctgactaaccctgaggattagttaatagtactggagtatttgacggggtggttgcgacttgggagtaggattttacggagaaaatggaacaccctgcaatacaagccaaaggaaggcaaggaggagatggttttctcgacgaacatgaagtactcgtaactctctcgccagggagcttccctccccggcccaagcaaggatggaggtgaagccggagctcaatcgatctgcacagggttacacgaggcacttcttggttcttcgatccagctagctttgggatcgatcgtccggtaataagctcctggtatgctcctcttcagtaccccctggccctgtcatgctcctcttcccccctttagttcggattttcgacgccattcctaaatcctgtgacattttcatgaacatgttgtcttccagatggatctccatggttctagctagctatttgtgctttgatgaatcctgattccactatcgtcgtcgtcgtcatcatcatcttttttctattgttggtacatgttcttatatattctggcgcatttcgattcgagtttgtctcctgcgccttcgatgaaatacttacaagtcgatcgaacaacacctgtcatcatggcttacgccaatagctacgtgccgatagagtatagacacatgatgcacgacaggacgacgtgtttccacgtgaaacgtcgtccgcgacaagttaatctagaggcggcgtcgtatttgccgcgtccacacacgcgtggcggtggacaagaacgaattgaactttttctccatccgtctctataaatacacggacacacaaccgcacacggagcttcgctcccaccgtttagcgcatcgatctgcttaattagctgaaccttggattaaccattatttcgacgggccaaaaaccaagaaggcatagaaatccatctctatttcagcccaatataccatatggatatggatcgccacggagccctgaccaagctggggttcggagcactaacattcaactccgcgcttgcaatataccgatcgcggggagacccagccacggtcgcgttcgtggccggcgcgtacgcggccatcgttctgctcttctatttcctcctccggtttgagcgacgacgggatgacagggggaggaccaaggtcgtggtttgggtgctgacgaccctactgaccgcgatgtttgcagcgagggtggctccgcttatgccgccgctcgtcgccttcgttgtctgggtcatggcggctgggacgtcggttgctggattctgggctttttttctcaacctctgagatccaagagcgcactgtagatttgtttacggcacggcctttcttattgttagtggcttgcttatttaagttgcttgtaaccaaaataaatatagactttaggtgggaaaaataaaagaatcatcttgtacttttttgcgggccacaattatagcccattaacttgacgcgtcaccaccaattctctcttccgtggagcatatacgagggtggtttgatctgtcactagaccacgagacgaatttatttagtctaattaatttatcatagcaaatatttatggtagcacaatattatcaaatcaagccaagacaattaatccacaagccaccaagaagaagatcttgacgaccattccgaatacctccgccaagttatttcgttggaattctaatttccaaacaaacaagatttcggataagtaatttaagagaaaaaacctataagaacaaacatacatgtattgttaggtatag

SEQ ID NO: 41523 - DNA, 22099 bp, Oryza sativa
gtaggcaatacaaccagacatgagagtcaggtctctaattaagacaatactgtgcatggactccgtgtagtcacatccatagaccttataaccatacccacggaagaccgtgcactgtattgtcttaatcagagaacttactctcaggtctggttgcattgcctactatacctaacaatgcatgtatgtttttgttcttaggatttttctcttaaattacttatccaatctataatccgattacactattatgcacgttgcaattaaatatttacaacaagatcttacatgattatatttttgattaaaaaatatctatgttgtaaattactattgttaatatgtaagttacttttatcatatatataaattacttttagatttgattaaattacttcttacacattaatagtgctttgagttgtttgatttattattatttttaagtcaattccataatttgtactaattaaatttaatttttagatagactcatgtttttacccccacaacgaatttacttctaatgtcgtgataagttactttctttttgttttaagttacttctataatatatgtacattacttttaggatttattaaatttacttttatatgtcaaagaagtaatttaatggaatctaaaagtaatttagatatattataaaagtaatttgtattttttatcaaaaatatagtcatgtgagatcttgttataaagatttaattgttatgagcacaacggtgtaatcgaatcgtaaatccgatgagtaatttaagagaaaattttatttgaagtataggtgatagaaatatatttctctacttacatgttggactagtaggatcgctgtgcgtcgctggatagagcaaaatcgagagcgcgcacgatttactctcaaaatagggcttaaatttatataaaaatccccgtgtttctgtgtagacatacttctcgagataacactcaaccacacaacaggtatatttcttactattataaagatgtttatcgacgacaaacaccatcaaacaccaacttatggcgtattatgatttttatattaattgttcatgttgggttccatttaacaatatatttccttacatatatctatattattgatttgatgtcctcatagtaggtttataaaaaaggaataagtttactttgggttcctctatttgtcgcccagtccaatttttatcccttgaccgtaaaaccgggtacgacccgtcctccaacttatgaaaaccgggcgaacgaggtcccacggcagttttaaaggcggttttggctgacgtggcgcctacgtgacttgtttgactaggtctccgtcccacgtggcattgacgtggcgtttacgtggcaattatatctcggaaaaataataaaaagcgtggccccagatgtcagctgcacacaaaaaaataattttaaaatggagggggccacgtggccccgcatgtcagcctgactcctcacttcttccctctcccttctctctcttcttccctttcccctctctctctctccttcttctcgggcagcggacggcgcgggtgggcggtggcgggcgtggtcggcggccacccaacggcccctgccggcgacctcctcggtgtgttcgggccttcggggacctccttggcaacgggatcttcaacttcgacggggagacgtgggtggcgcagcataagactacggccgggcgtgcgcccccgattctctcccaccggccgccgcgcgccgctccctaccaccggtccccgcgcgccgccgctcctctcccgccctcccgccggtcgccgaccctcacgcaccgccgctcctctccctccttcctgccggccggcgcacgccgccgctcctctcccgtcggccggtccgacgagctcacctccttcctcgcagagctcccgtcggccgccgtctccgccggcgcgacgcttgcgtcggtcgctctgtccgccggtacaagcaaacgaagaaaaggaatgcaaaagaaaacaaaaggatagatagaggagagggcgtccagcacgtcgaccagcatcaaggcgcgcaagctcgagctcgcagccggaagcggcaagagcgacgcgtcgtcgccggcggcggtgtccatgccgttgtgctgctccgctgctagcagctagtagctagccgcgcgtccctatgtcctccctcctgtgtagttccgtcgtcatcgacacaggctgccgcctcgccgcgagctatgcccccgttttgagttcgcaacatgcgacaagcaccaagaaagtcagcaaaatgccagcaggaagaggatgctaagatctcgatgtaattaaccgctaactaattttgcttgcaggccggtggagccgagcaggcggcggcgcgcgaagacgataggaggagcagagcgggcggcggcgcgcggagcctataggaggaggttgagcagcggccggcccgcggagcaagatgggcagcggccgaagcgggctacaagctcgccgtgatgaggaagaagaggcagagccgagtggggagagggggatgacatgtggggcccacgtgggccccaccttattttttaagcatatatgtgggccccaccatttttagattaattattttttatgcggctgacatgtgggctcatgatttttattattttttcgagatataattgccacgtaagcgccacgtcaatgctacttaggacagagaaatagttaaacaagccatgtaggtaccacgtcagccaaaaccgcctttaaaaccaccgagagatctcggttgcctggtttttgtaagttggggacgggtcgtacccggttttacggtcaagggaggaaaatcggactgggcaacaaatagagggatccaaagtgaacttattccacgatgtctataccacacacgctgcttatttaaccatcacaatctgttatccgaagttaaccgcttccacgtcgactcgaacgtggtggcatcatgcatgtcaccttgtcattgagcaggagattttttttaatggttattagtgttgatctttccctgtttcaagatattttattttagcatttttatttgatccacccaagctttatctttgaaacagtcaatgcattaaatttttgagaaagcggatgaaaaattcatttggagtttgagaatgcaaacgaagggcactaaatgcatccttatgtagtttgagatagtgaaagttttgtttcgtattggcatgtgtgaaatatgttaaaaatggagtcttttagaatgcaggcagtaaattttattaataactatgtgaaatcttgcgcattgctgcgagtgctgcgggtttactataataacaataagcaaaaatattgtataagatagcttaaataacataagcttacatttacataagttgatgtgatttaaatttaaattgtatgtagaatgatgattcaaatgtaaaagtaagatgatatggcttgataagagaataaaagaaggaagataatttagactatatatctaagggtgaaaaaaattaagataacatggcttaatgagataaaagaaaaataacatgaactaaactaagtgaggatgaactgtatatagttatataggatatcataaaaaaatgatatagagatatattaaaatattatgtgaattatgtgggatgatttgacatgcttacattttaattctctaaaatttaataattattaaattgtagataatatagcatgtttgtattatgtttagattattagtgtattataatgtgacatctttgcatgtctatagattcttttgccacgagtttgacagtctggctcatctaatgcaaacagtattggcccatgaaagccaattgtaggaagcaaaggaagatcggttttggatttatcaagacaagaagtaagataattttgaagcatgagttctcatactccaaaactgggagacatgtgttaacaccaaaatttagtaagcccgaagtcatcattggcctagagttagtatcggcttcagagtcttggaatcggctgatgggagtcgtcaagtcactagcagttgtgttttttgtggaatcggatcaattaaaggaaatttatccaaaagagtctgagttcaaggaggatgcggcatggcaagtgtatctattaattaggaatagtttgttagttcattttatctttaggaaagtgtgtttagtgtccataaggactttatgttttccttttatctttaggaaattttctttcttgtcctagaaggactagtatctccctatgggtataaatatatacacccggggtcattgtaaaatatctcaacaatcaatacaactactctcgacgcatcgccaccctctttaccgaggtttttacttatcatccggcggaacttggcacctgacgcggggccacatcggttcagttcgatctccggtgaaggggtaagtcctacgttccgccggccctggcaattgtattggcttcatcggcgtcgttcaaggctgcatcagtacattcaaactcttggattgctctggttcggttgatatatttgcctacctatcatatgcctctgttaatttaatcttagcatatcgatttagctctatcggctgcttctcgctttagggtttctgtcagtatcggctaaatcgtgttgctatattagattagcttagacatccaccaccctgaaaatcagtcaacggcttgattgtctagatattatgtttctttttcatacttagtgttgcatcagttaagtttgatctattaagtcatgtttagaaccataatctctagcctgcttctttgactgctaaaaaatgttccatcagggtttcagccgatgaggtatctagacgttgcatcggcttacaaagattacgtataagtaggatttagccgatcgcaacaaggtttcactgtttatctaatcttgtggattttatgacattggacctcccaccgatgtatgctttaaccttcatatcagtgcttattctattatatcattgctagccgactggtttctactagatattattatttttatattgattatcatcagccgattgtctttatatcattatctacattgaatatatagacgattgctcaaaaccctatcgacatcggctggaatcgacatctgctagtatcggctatcagctggaattacttcatcggcttgtcaaccgatcggctatttgatctattgtttacgtatcttgtcaattgcaggatcaaactaattggcacactcgcacctcactaagatttggacctgcactggagctaagtagatctcctaggccagtgtgtttttcgcatcaacaggtggcagctcgttgctgatggtagccaagaaaggaccaacctagtccaatatgaaacatattgtaagaatacttggtcacaagtgaaagcatgaggcagaccaggggcggatctacagtagaagggccagtgtcaggtgacaccaacgattttcggtaaaacctatagtgaaactgtttatccatatgctataacacaatgatctaagcataattagcatactataacatcgatagacacgttctgacactaacgaatcgattttctggatccgccactgaggtagaccctggttcataatacaagttgggtaaaataaccttggccaaagtgcaattcactcaattagttataaagaccaatcgttctcgatcgttggaaacagttttagagagaacagaaaaaatatttttttcactgtaaataagggggaaagggaaaaaggaaacaccaggcttagatccaggggcgtcctcgggcccgtgcgggctgtgcgactgaatggggcccccaaattttaaaggcccctaaaatattaagtatgtcctatatatgataatattatagactttaattttattaatttgcagtccaaatagtagtaaaacaaagcccaaaacgctgcagaaggtgaaccgatcaatcttccatgtactcccgtccaggcgtccgcgtcatcgcgtatcgccgaagtcccgacgccgcagctcgcttcgtctcctctccctagtcccctctagccttcgtttctacttcatcgctgatgatcggctgatcgccacacccgtttttaattttactataataaatatactaggctactagactctattttaatattttgcacggggacccgatttgggcggtatataccttacttcacgtgcactccaggtaagtaattaaacggtcaaatttcttcggcgataagctacgtgcctatatatagcccatcagtcagcagtgcgctctgcttacccggctgatggacgaacggaacgccgccgccgctgccgggctcgttcgcgcgggtctcctcgttctcaccctcacctccggcgcagcgatctaccgggcagccggcgacgccggcgcgatcgctttcgtggcgaccagctacgccacgcttctcctcctcttccgttaccttcgcgcctacgagcttgcggccgccgcggagagagaggggctcaggcgcaaggtgtggtatatttgcaccgtcgttaccacgctgttcgcctggaaggttgccggcgtgatgcctccggccgccgccgccgccgtctggctcctcgccgtcgccacctccgccggtggcttcgtcgtcctgttccaccaccgccgccgtccatgattagtttagtactgtacgtggcgtatcagtccagtgttgctacatatacgtacgtacggatcgacttcacccttgcgttgcatattcattcgattgacgattggctgtgaatttgtaattgggagtatacatgcatcgaaagaatttcaggaacaggtatttaatttcatttctgaatatataatttattcattattttatttcttaagaaagcatggactaatggttaattatacatttgtactctctctgcaggttatgtacttatgggaagatcgttatatgtatatgtcttctgaatttctgatcgattggatttctctagctggctagctgaaatggtattgtagatcttggagctttcaagcaccaagcctgtctcatctttggatcaaattaatggctcattgctgttgttattgctgttttcaaaggattgaataatttttgtggggcaatttgttggaggttttgctcgtcacgttatttgctacccattttcccatttatcgagtaaattagtactccaggaaacaaagtcacacggaaaatctcggtgacatatatatatatatatatatatatatatatatgtgaaatttagtccatttatagtatattaaaaatatagaagtaaaatattgtacttagaactagtcatgaaaattttctcttgattgaaaggattgttggctacgcatggagtttggtctccgattaaacaatgtttctaccggaagtcatcaaatattctattgaaactttgaaagtcgtggcaaatttccaatgtcctattgtaagtcatcacaaatttctattggaagtcataaaaataaatctattgaaagttatctaagattttgtttcttactgaaattcaatttcctaactatatcatgaatacgaacgatgcacgcgcaagaggaaccaaaacgttttaggcatagattttgttccacgcacgctcgctatctaggcatagatttatacacatttctttttttttaatacaagttagacggggctcctgatgcatgaagcggcgcgagcatcatgcgagtacgaacgacagacgctaaacatgttcactcctacggcctcaatgcttatcagccaaaatttaaattttcaatcttaaattttaagttgattttagagttttttatcgaagtttatttttcaacttttgcttttacatcataaaaaataagaacacgtatataaaatttttattcataaattattttttatttataaatataccgtttcgcttatttctcgaataagcgaacgatggggttctagcctattggaaccgcatccacgcaaacattcgcaatttaggaatattgctcacacccacctatgtgtgtgaagttaagacttaaaacgtagatcttcagattacgaccatgaaaaatatgagcatccttgctttgtttaaaacttatttccgttaattaataagtaggttaagaacaccgaatcttacaaacggaattacatataattctgttagtggtatatgagcttttataaggaaaatcaaaggaatcattctgagtgatgccatttcaaaccataccatttttttttgggtaaagttgataaagatgtgcatatatttagtttcttgccaaattttgacaaatacataagaaataatttactaaaattttggtaatattatcaatttacctaaattaatttactaaaattttggtattgctaaaatttggtaaggttcattttggttacaatctaaacagctaaacaattttatgcacaatacgccattatatgtgagagttgttgagaaaccagtctactctattgatcagcacacaagcagacaaacacagagttatggaacacagaaaatatgagcaagtggaagctttatttcttctggatttgagtacaagctataagaggagaaacaggagaccgaagatcggttgtcctcgccttggaccttctgggccctatttataggcggaggagggtagaggcttgcatcgtaagccttgaaccttctggcttgcgtcgtaagccggcttacgtcgtaagctggcttctcctgtaagctggcctacgccgtaagctggcttcttctgtaagctggcttctggcgtaagctttcttctgtagtaagctttccactgataatttaatttgtcgataataaaataggtttgataactagagtgaccattcctacattagttcttctagtagcttataggttcgcatatcacagtgtcacacggccaggagcaggcgctcccaaattgtggaccaaaaaagaaagcctggatagagaggcggagcccaaaaactctccaacaatccgggcggcccggaaacccccagatctttccgctcctcctcctcgtcgtcgtcttcctcctctttcctcctcctccccgtctctccctctccgcttctctctcccaccaaccccccgcccccacccatggcgctcgcatccggcacgtcctgcgccctccccggcgccgcgcgcccccacctcgccgtgtccccctctccgcccgcctcctcgatccgtttctgcagaggcggctcccgcggaggcagggccgtcgtctccctccgcgcctccgtgcctccaggtagttcggtcaacggtgatgatttgtttctgcgcatgtagttagagagaatagaggggctagctctctctttttttttgtgcttaatttgagttttggagacctgaaaaatggggatggattcgtccgtactatgaggaatattggatggtactagtagcaaatagcagtggcatagcaatagatcgttgatatcgataaggctgtggccgaattcatacgggtctattcggattggaggagtttcacgggagttttggaggaacttaaaatgtttcttgtgaaaatactgtaaaattccagcgttccaaaacactaggaagggtactttccatttaggaataggtttttagtatgcttgatgcagtggctttgaggattactgattgcttaatcgatgacatgcctggtagttaggcattaaagtccttgtttaatccagttctggacatacatcccagctcatgttgctttttctcactcgggcactatgttctgtacatgacaattttgttcccattaattggtactggacctaactatggtttacaaatagttcatccccgtccaagttaaatgttacatatccttgtataagacattatcatgtttcctggtagggaacaatatttctgtgtgcaatttgcattatcaggggatcttatagaagcaattatttgtacactaatttgatcatagctgcgtataatcatgtgttatgtacactaatttgatatgcctatccctacatatggttacaaatttaaagatactcgtacttgggtcactcttgtacaatttgaaactagcgtgatatattcaacatgttggtcaaagtatggcaaattgtaacaccctttattcaggcacgcccatctgccctgtacttatgagcgggtaacactgatcagggtaacctgttaagattaaatgtctacaggctaaattctgtgatttcttgtcaagtatagaaataattaaacagtggagtaaatttaagataatgtcttccggagttaaaccattgattgctttttgcagcagcagcggcagcaacaacatctggtagcattgcacctgcaatttcattgactgaaaaggctttgaagcatctgaataaaatgagggctgaacggaatgaagatctctgtttgagaattggagttaggcaaggtggatgttctggcatgtcttacaccatggagtttgaagatcgatccaatgccagccctgatgattcagttgtagaatatgatggctttgcaataggtaaatttatccaactgactgttacaattaagttcacaaatctcaagtgtcagcagtcagcttgacatgcactacttttcgacctctttataacactcaagtaacgtctaatgtgaacttgtccatgcatgactaaactgatatcaattagctatcttgtttagtttcaacggctttgataataggtcacatgagcttactttcagaatctatttatggctcttcatgcgcaaagtaatctgattttatttatcgtttgttttactggatttcactcaagtgatcttttttccattctgcagtctgcgacccgaagagccttcttttcatgtttggaatggagctggactacagtgacgcccttatcggtggtggattcgccttccagaacccaaatgcaacaaagacatgtgggtgtggcaaatctttcgccaccggaaaagaaacagagagcacagcaacagcctgcaacaactaagctagaaacatataggtggaaatgccatatatatagctcacccttggcaaaatgttctatggatataccacagatgaatactcgaaactcagaagtgtaacgattttcattacagtttgtgtgtatcactgtatccaattggacaaattactgctcgatagaattcaaagatagttaccatgaactccagattttgtctatgatgctgctcatgttgttgttgatcaacaaattcatttcatgtcctcaacatatgtcttcaggaccaagctccagttgcaacttgcaactactagcatatggtagcaagggttaattgccaaatcaatctggtccgttggatttccatcggacggcacaggcagacggaaatcccgtttcaccagccgttatccgagcaagcgacgccactacacctctcgaccacgtcttccctcccccgcggcgaagcaatggcgacctcgtcgccgccgtgcgcttgcgctgctcctctcctccgccgccgcctcctccccgctccgccccgcgcgccctcccccgcggcgccacctcgcctgcgcctgcccctccgccgctcgccgccccccgcgcgcgccaagttcggcaagttcgaggcctccgacgccgcccccacggaggcctccgccgaggaggcggaatcggcggcggcggcgggtgatggggcggcggaacagaaagcggaggaggacgacaggtcagggtcactcccacctcttgccgagctcgtgaacaatcgtcgcatcgtgatgcgtctgtatgtgtgctaccttgcgttgtgtgtatcagctgcttgccgtcggacttggagggcgcgatatggcaatcggggaaggcgagcgccgatttcgtcaactctggtggcatgcgagccattgtatgttgctcattgttcatctgctgttcttactgtcttacactgtttcagtttaaccttacctgtcacaaaagttgtgctgttttcacctggaagttggaatggcatggagtcacttcatgtgtgtatgagtgtatccaagatgttaaatgttctaattttgttttgatcatgcaaccttgtcatgtacttatcattgataatttgtatttggttatactgactgtaggcagagctactgatccctcagttggaattcctcaacgaggaaggagcacaggctgaggtctgggcactgtcaaggatattcctggacacacttgtaaaagagacaggccaggtttggatgcaaggtcgtttagcaatagatgcactttttgctctttcttgacagtttacagttcaatggacctagctctgatttacccctgattcggcagattactgcatgattcttaacgtatcactttggagatgcagaatttcttgtccatgtagattaaatatttggcctgttgcccctatactgattgaattcttgtttacagaaagttaaggccatttttcctgatgctggagcagcggcccttcttaagtatcagtggacagatgcagagtttaagtgcgccaggtgggtattggttcacttacattaatctatgcagaaaagggagatggctaatggtttgcataatactaatgtgatttttttgtcatgatttcttgtattcatgttacttcctagcagtatttacacagaagaacaattatttttttcgtggttaaaacttatccagtttggtacaaaatcctagcagcgaataccacgtaatcacagaaaggatgtagaccattttgtgttactaggaaaaataaaactgtaggttatttctagattagggcatcaaatactactcagaaatgaaaaatcattagttttctactgatattcgaaataaaccaatagcacaaacatccttggttttcatcgtgagaatattccttttttcctctctgtataacagtatatcatttcctttgaatgctcccagtcttaatgcattgactcttaagtatttttttcctctgttatattttcacaatttatagactttttgctcgttaagtttagttggcattaaatttattctgcttaatttttgtgtaaatataaattctatctaatatttaacttgaatttcagcttaagtgaccggaaaccagttgacgttgaagatgaagttgttgttatgattatccctgatcatcagatggtggaatctgttgaacggattgcatctcaactctctgatgatcctgtatgtaacttatacctgatcaatttcaaatattttcaaataaacttgcatagttcatattaaaaataaaatgaaatttcaattgacgtgccaacagccaaacaaagttggtaaggcattgcttgtataattgcaggatcttactgcatttgcataagcaagctagcataaacctacgttcttggccatcacggcatcacatgaaagtgctgatgtagaattctatgctcaaagacatccagcctgttcaatgcactgaagtttctttcaatctactatccttttaaatctgtctattttgaccattatcttcttcatgctactattactgtttgcatgcaaatcccatttcagtatgatatcctaaaatattaccacttttaattcaatgaagataagacctcttgtcatgtggaatccacgccttgttagtggagatgttggagttggctttaatgttcgaaatctgcgccggaatttcctaaggtaagttagtcagatcatctggtccttgttggctttcctaaacatgtaggagtacatagctattcttgctggcatcacaatataaaacttggccaatgggggaaagacaccctccacggtatttcactaagggtgtgtttagttcacacaaaaattggaagtttgattgaaattggaatgatgtgatggaaaagttggaagtttgtgtgtgtaggaaagttttgatgtgatggaaaagttgaaagtttgaagaaaaattttggaactaaactcggcctaagaagagctcaatcggagcccagccaagaaaggtcaccaaagctagtccccctcatacatggggatgccgcctcctatggttcgggccttaagccatgctttgaggcccagcccttacacaagggcctaaccaacttgtcccgttttccagtgctaatattgttctttactacaagtttcattgacctatttcatgtttagttccttctgtacgtagtgtttcacctatctcttgctaattttcattcccaactttgcagcacttttaccactgtttactcgatgagaccgttgccaactggtgcagtctttcgacaatatccggggtttgtagataattattaacttacttatttgtatatgatcaaaatatgtaagtagtgtaataatgcgctaaaggcttatctgtgtttgttcatgttacagaaagtggaaagtattctatgatgacccaaagaggcctaaccggtatttgcttgcccgagaacttgtaagccgacctgatgcaacagacattgaggttaggcactggagttatatattatttatttatttttgttactattaatctgtatttgtgttgagttgagtatatgctcactccccaaaaaatggctagccaaagcatgaaacagcatttagaaactactagaagcatccaacagtcaactcatttctcaatctctagacatcaaggtgactgcacacaaattaggcagtcaaactaccggacactcaattcaagccagaaaacctctgttttttttttataaaaataactatttgttgcttgtcactaggcaaatgctaaaccactttcccataaagacaacatttaaaataagaagcattgttgcaatttgcagataatatttggaggcggcgatgaacaatctgacgaggcaccatcattgatgaacaatgtaatgggcgtatttagttccgtgagccggtttatgagagtaatctccaagtgaaagtctcaaccaagccgttgatgagaatctttttggccatgatccacatcatcagcgatgctgttaatctgcaactccatgggttactagctgctactgtctactagcaagcgatgtctagttcacgttgcaggacgtgtacaagctaccaagatgtgtacttgcacgattgtattgtagattcctgcatctatgaatgatcctaaacaatgttagctcctatataacatttctgtagatagttacatatccttctgtttctgcaaataatgaagatctgaattgtactttctgagtcacttatttgtccatgtatcatatgttcattcatctttggctaactcaaaaaaaagggaggggaggaaaacacaattacatgttgtttacagttaatcaaaacaattcctgtatcctatatagtcaagatgattccctcttatgacacacactaatcaacattgtgacacaagtatatattgcccctgcatatctacaccaaattgtgatcaaatcccaaaaatgttccaatggattcaaatgatgagcataagtatatgtatatcttcagctaattaattaatgtgcttgctctctgttcgccacaggagacgtcgacgcactcgtcgtcgatcctgataaccccagcgatggctgcaagaacatctggctgctcgagctcgccgccgccgccgccgccgtcgacagcgacgagtgggtcagcccgagcccgaggtgctccccccacttgagcccgaccttgctgtcctctcctcccgacgccggcggcgagcccttcttgccgacgtacgacgtgatggcggccgccagcgccgtgtggaagctcgggtccgccgtgatcgccttcgcgatcgtgtcggtgatcacgctcggcggcggcggcgccgccgccgccgccttctgctgcatctggtagagcggcggcgccgagccgccaccgccgccgccgccctgctgcctgcttccgttgatgctgctcagcgcagcctcgaacgacgacgagctcttgccgccgccggcgttgtacgggtgagcggatagcgacgccccgtagctcaagtaccccggccatggcgcgctactcgggccggagccggagaaggtgaagccggtggaagggtacctggtgtgcgagaacctgttactgagggagaaggcggcgtgggaggaggtggcggcggcggccggcgaggtgaggtcgagggtgatggtggggtaggaaggggtggaggtgatggcggcggcggcggcggtcgggaggaagaacgggcggccgccgatgaggggcggcttggaggaggcgtcgaatgcgagggccggcgacgcggcggcggcggggtaggcggcgagagaggtggaggaggagccggagatgagcatggaggcggcggcggaggtggtggaggccatggcggtggcggagacggagagcgggtggttgtgcgtgccctcgtaggtggtgatgaggatggacatgtcatccgcgcatcgctgcacctgcaaaaaacgtgcatggtgagcaccaaacaatttctcaaaatttttcaagaaagtttcacgagtatttgtattgaacttttacaagtaaatgtgcaacaactcaaaatctaaaggcagctttgataattgttccactttactatttttcttttagcgattacatggaaaactcaagtgcactcacacaccaccatacgtgcgcaccatactcacactctcacgaatgtgctccattaacatatactcaaacacatgaagaccaatagtaaatccttacccccactcaattgcttattgaaaacgtgtatgtaatgttcttttttggctagtccaaactatatattttttgaagctatagtatagactatagtaaaagttgtcgacttttgctgcagcatgcatcgttggcaccgatgttttttttattagcttttgatcaatccttttattttagaccgggtaaacttgcattcgtttcaatttggaccacccgactatctcctcaagcatatgaacaatctcaaatacatcggcactacttgtcaatgaactcccatagctatatgtgagaccatttctttgggatatgccaagttgaatgtaaatgaataaaacaaaattgagggtggtccaaagtgtcacaaaggtaaaagtacctgatttaaagtgaaaatattggttaaatggtaaccaaagtgaaatttactcatttaagtaattggtggacagattggcttgagatttgtttacatgttcaaatttaaacggtttcagactttcggggtatcttactgaagcttgtcactaatttccttttaaaaaaacttatcactaaaaagggtgaatagccaaagtggtcctccaagtttcatccaaggctcagtttagtgcttgatgtttcaatctatccatattagtccttcaagttttcattttagttcaaacttatccttgaaccaacaactctcttcataaatgacacttatacccctcatcattcacatatataagagaaaaattgcatgcttgaattttttatagataatacatagtatattatgtaaaacaaaaaaaaatatgtactaacaaatgtatacgatagcaattgcttaagtttcatgtgcacatgttgaaataatgggaagtacatctgtaatgttgtttattcatgttgactttctcttttatagtatatagatgtatacaaattaagggaaaaaaagaatattttcgaatagaaatattgactagaaatagcatatggcatattaagtggacccaaggatgatttcaagccaaaacaaatatttgaaggacctatgtggacaaaatgaaacgtgaaggaccaaattaagccttcgctgaaacttgagggactaaattagctactcaccccactaaaaaaattgggactatttgcaagagagaaatttgaaaggcacctatataagggcccaccaagttatcaaagaaagcccagtaacctaatctgtacggttgggccaaaccagtttgattcgaccaatgaaaaacccggccgcttgcgcgcgccgccgccgggaaaggcggaaatggcggggcggcggagggagcgaaccctacctcgaggcgccaccggcggccggcgatcaacacctctcctcctccacggcatggagtggtggcgcctcgctgcgtcagcctcgccggagtgcgcggcggcgcgtaggcgtagcagttcaggcttcgccctaactctggatcccaaatcccccatgcgggcgtctctccctccaccaatcaggtcaggctccgatcccccattcgcttgtgctctcctggtttctaatgtctggttgcttttagcctagtgctcgattacttgatctagcggattttttggaccaatttggtggcttggatcatatttatggggtgaattcgtaatactcaagcgattaataacttaattagctcgtgtactaccaattggcaaaattcggtggtggataaacagagtactctgaaaccaatagttggatttgattcggaaattgagaccatcaggactcatgacttgttaattgttagttggtccatttctaccaatcaaatatggttcaaactgaatgtaatttggttcaactactgtgcccagacctacatatgtgctgatctatcccattgggtgtagtctctttgttagtttgggaacttggattcaatccattcctttcccgcaagtcaattttttcggtgagtgaatttaaaaggagttgcaatgttgaacagaaagatgcgtaccactgtagctttaaagacatatgccaagttgatttgatcattatggtttgatttattatagatggtacataatgcattatatatacctgcttcctgactgggcatcctgctgccacggtgcaccggtagtaggcgcgcgggcacgggttccccttcgcaatcttctgcccatactttctccactggcatccatcattcatctgcacaaccatacaaatttaatcacaaatttttccatcatatctcgtttattttaccattaccttagcatattctattagaatttagcaagagagaacattttccaacataaatacttatactagctgtatatacaattattctcgtaccgttggcgcatcacatctcgctctcactgaaaccctagccttcttgacctgtggctgaggagctatgtcatcctcggcttccgcgccgacgctcctcaaattcttcagcattttgcttggtggccattgctctgtggtctctgcggtgtcatccctagcatcctcaaagctgccttcagggctcaacgtcatcacatccggctgtaccttctcactgttattagcatcaactctgcagtctgataatccaagagagagacctcctttgatcttcagaaaatcttcagtactccctttgacttcgctactggtggtactcttgtcttccttcttgcatttgctcgtgctcgttccaagtctcagagagacgagttcaggctcctcgatgtcggtggccggagagtctgggagcttcttagctcggccttgctgaagaacgtcatagaagtgcgtctgaagagatctatagtcgtgtgagatgcgcgacagcaacgtcttgagcctctcgttctcttctcgtacttcacccatttctgcccttgttgattcaagcttatcatcctgaccctgaagccataatagtgcaacaaaatgtattagccatatttgaaacaattacatatgataatggtcacttgtcttgtgaacgacatagctaggttgatagaaaaagacattggtataactatgatgcatgctatgcatcctgaccttattttgagctttcatgtttagcaatgatgagtccatacatgatctttctattgggcctggtgaacacacctagaaaaataaactgatggtaagaatagtctagaagaaaaggtaaagtgtgtgtatgaacttaaagaaactagttggttttatgacaattccaatgagtaattttaggacaagaaaattagacgttaaagtttacactgctgcttcttaattatgaagtaaaaagaggcagagaaaatggtagaaattgattaatgaattgatgggtgggtcagagtagaggtacctcctcctttgtgcttgatatgttttgcaaggacttgaaaaaattgccatctgaaattttatcgccatcttttataacctgcaatatatcatagaattgaagatactatatatcagtagagatcaagacaatacacaaatatattcaggctagctacagagaatctataaattaactttccttccagttcatatatatattatccatgatttatcagtgctatctatgtacgcataagaaccagtggttctcaatttttttaagaaattgatgaacaccgcatttcaaaaaaggaaaaatcgatgaaacctgattaatttggaccaaagaactgcatctctgaaaaaaaaaatccctattccacgaactaagaacaagaaccctgaagagaaaactctactagtcctagttgtacttacccaaataaatgatccaacttttggaagaaaggttagaagtttatttttagataaaggaagcgtaaccttttctagaaagataagaaatacatatatagttcagatagaaaagagatccatacctcgtcttttaaccgatcttcatgggttccaagctgcctctctcccttgatcatctcctctttcatgtacatagaagctagctgctttgagtctcccttgatcatctcctctttcatgtactgagaagctagctgctttgagcagcacagctacctctcctcttcttctcaagttcttgtctgccttcagctccttctcttcttccttttgttcctgcaccagtattatggcttaattataaaggcaagccatgtcctcttccgtctcctctttggacttttgcataaattaagttgtaaccttgtgcttacctatgttaggcggtcagcatcctaaatgtcaaacacggccgcactcttgggtgacttgtgtggagaggaaaaaaaaaagagcacaggcgactgagatttatgtggatttcaacgtgtgtaacatgttgctgttttgttgaagggctgattctaagatgtgtgtccagactgcgtacgtctggccggaatatgatctaatagcacgtccaccgttaatgtccgtacgaagcttcctgcaagtctttgccatggccgactattataggaccatgtgttcaagtaattgattgattttgaaatttcagctggactttaggacgatagctaggtccttgtatgatgatcatagtcccctgataaagatggaggggcagctcgagtactagtataatattttaggaaaaatgcttgcacaccatgactggccaatttaatgaacattcacattctgatgacatgctagctagctagttttcagaaaaattggggaaatttgctaacaaattctggttctcatgtctgagttagatcaatgacagcttgtccgtattggtaaattagaggaccacacacatcttaattttatccgaattgattggtgagagtagaggaccacatgcgtctctctcataagtaagaatttatcttgagtgcaaactccacttcattcaacgggctatagtaacatgcatgcatgatactataagttcctagagtagtatctagacttgatcatatatgtcgactagcaatattccaagactttgaaattgaatgccacatcatgatcactccttattcaatctgtatatatagtttgattgattctttgaaaacaaagaatacgtatggtgtttttggaccaggcaactaattggtctggaaatgtgaattgagtatagacagtaggtgccgtttcgagttgtaaccaaacagtctggtgtgctcagacgaaccaaatatgtcaacatcgaatttcagcacaaatttggcaagtgagattgcttggcagagaagcagactggcaaatccagcatactttcga

SEQ ID NO: 41524 - DNA, 4501 bp, Oryza sativa
ggacacaggcatcttacagaaacgtttcttttgctcaagaaaactaatattctcttgttagctagatctatcattaagaactgggctctgcctgcaaagcttggactatgactagattatatctcctagatccaaggtttatcagtggaccacttgtatggtattctatggaaatcaacaaatcagcacactaataaaatgcatgaccattgaccttaatcataactatttcatggaaatttagagcagtttataggtactgtgatccaaagttagctgtaccatttatctagattaccgagtgggttctgctggtgggggtggtcttcgagattcagactgcctcttatgatgatctcattggtacccttttaaaggtatgtatagttcatggagttgttctctctgttgtttttagatcccaatgcgttgaaatctccattagccattgcctaattagtgctgcatgcatggttctctacttgcatctgtaacagagttttatattgtataaatgtgttcagtattagttggcgctggccttctctttcctttcccccctctctatgtttttttcttttttttaaaaaataactatggcaagataaagagtaaattcattttctctgtgcctgctccattttggaacttcatagttagctcatatatcgcagataagagtagatttgttccacattgtctatataacgggcattgccacctaggtaacttgttcttcccagcatcaagtttaggtaattaggtactgcatcaggtgccgttcaagtttttcttttgaattggtgtgcaggccggcctgcctgactttgcacacttgtgttaggtaacatggtacagttttggctgagtttgaaatctgaagcagttcaagaattgctagaagcctagaaccaggatttttaaaaaccagtccggtttccaactgaacagtgctagtgttaatttgcctcatcaagtttgatttgtcttcagccttttaattaacacgtggaattattcactaatgtagttcatccattgaatgaatcttttgttacagcctgtgtgtcattttcagttgcttatttttctagcccatgatctatctcgtcgtcacatatgtaaactcatgatcatttgactttgaagagaaaataatttgctaactgtcagaatttaggccctgttgaaattacaaaactaaaagtgtcgtaagctgcatttatgcatgcgttgttcgcctatttctgattctgatctgtattcatatgatcatgcatgaatcagaagtcaactcaaattaatttatctaagttgagaagtaaacaagctggttagcttttacaatttgcaacatacgacctgtagatttcgagtactgatcatattggtacagtgcagttaccatattcaacccattgcaggttcatccttcaagttgactattgctagttgtttatttataatttacgttatgtatgtattagttgacttcatcgagtacctatcagtattttcacactttaaggctgtatatttttgttaattataccacatgatgcaaaagatatatgtagttctgaaagtttagctgttctgaataattgacacaagctaagcatgagactcatgcatgcaggaagaattagtactagctaaagaattaattcttttgttcataacttcagatgcagcaattgcaacttcagcttgcaagcttcctctctttctcggaattcacatggtctgaaatggaagcaacattgtgtagacagatacgaagtcagatggcttcggtgatagccattagagaaacagtcggttaatcttgacatacgtagtgacattggtggccattatatcagaaaatatgcaccaggatcacgtagtagctaacatagttttcatgatcccaagaaaaaaaatgtttggcttaggtagccaagaggattgacaagtagggcacacaaagggtagttagatcgaagacacacgagtacaatgagaagactgaaagtacgtgtgtcctgttaattaatttatagttgcaatgatcagaaggaaccttcaacttgacgcccagcttatgtcatgcttatgtgccattcatgcatccatccatccattttatgcaaattaaggagattagctgtgctcttgttggctgcacaacatgcaatcccatggtacatttatagtaggatattattcagagtagaaactagaaagcaatgcttcttcagaggatagggcagacttaaggggttgcatctatggactactttgcatatattgcctttccaattgcccccttgtgaactacaaaattgtgagtaagggatccaatatatgtttgatcagatgataaactttaatattgatatcatcatgggggcggcatatggggccgagcttttcaacgataccgtcaaagtggtgcctaatcacagggcaatccacatggactcattgtcatcggggcaaagaactaggcaaccaattggagattgatttggtttctaatccattttcaaaccggttgcttcaaagcaagtgacttccctcatggcagagtcctttgattttgtattcttgtgtcaactttcatggcctatacagtattgggagtcttcacctagcatgtgacaactgttcccctattgattgagcttttccgttgaactgtgcacaagtggtttccaatggtcaagaactcaaggatcaattagttatattttgtcctcctttcagaaaagaaaaaacaaaagaagcagccctgtttgtccagctcagattctcaattatggaactatttatgaaagtctggtgctgcatggtcgcatcaattaaaaagagaaacttctactgaactatttgcaagttgcgtcgcatgcatggtcatagtcactgccatgacataatttgctagtgtgatgttgaaaagtgctcatcctaattgtttacctcacaattttaagcatgattgacaaaaggatacctataacagggacatttttagctatacgttatatatacccgtgcggtgtaacaggatgaaatatagggaacttggtttgaaattttttttctacaattttatagggacatttttagcttatatacccgtgcagtgtaacaggatgaaatatagggaacatgatttgattttttttctctatacccgtatgttgtaataggataaaatattgggaacgtggtttgatatttttttttctcacgtaattctctcgttggtcaattagggacgtggttcaattttcacttctctcgtatgtttctcgcggttggtcagtatttttggtacattggatttttggagtggtttttctctacgtgggatggtagtgaaattggaaggacatcggtgttttttataatagtagaaaaattccccgtcaaaaagcatcaaagaagtctacgacaatttcatggggcattctatctttgaactgtatgagtaattaatcctaaacatgaatggggttttctgattgggtgtgaaaaacattgagaaaaatggagagaagcatctcgcccaaaaaatttgagttctgattggacaggggacttttatacagtttcgtcactgtcgcatctctttctgccattattttcaataattatagcgtcctgtacgtttgatgattttccatgctgtactttctccatttcaaatatgttcttttcctgttacaatttcttccaaattagttgcgcgtgatggagatggttcatttgattttggctattttctttgcaaagccatgtgagtttggtacgacttggaagtccttgaatttaatgttagagcctgatgctctggtaccaattggagactatccaaacgttgtatttgactatatgtattagtacataagtatatcgaaaccatgtgtcttaaataggttagatctggcgtccatgacctcttacaacattgaccaaatgtgctagctatctagtgtctaatatttcagttcttttttattctggaatatagaaagtctcactatcaatcatcaatcaacatgttgaccttaacaaaatttagtgtgtgattcaagcattttttaatacctgaggcttacatcaaagagaggaatgaatggtcatgctgcctaggttaaattaggacaatgtaagataggatcaaacaagctgggaatcgattccaatcacctagctgtatacatgtatctaatttccaaaccttcaagaagttacaggacgtaatataggataggagaatagatgaataaacaaactgtaccttagtttggctgcaactgcaaaccaatagagcacaaccatgttgacagaaaaaaaaaatggagagcaataagtcagttcattatttagaaacaaaacgtagctatggatcttgtccaagttaatcaagttgccctttaaataggattatctcatacaaacagttgatcatggacatgagtaaagtagacgagcaaatatgaccaaagaa

SEQ ID NO: 41525 - DNA, 1137 bp, Oryza sativa
gtacccacgaattcagaacctcagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacgcgcctgca

SEQ ID NO: 41526 - DNA, 821 bp, Oryza sativa
ccatttacagctgaatggaaaatagaaaacagaagcaaggaagggaagtgaagggactggttgcgccagttctattcttgcaacaaatggggcgatctaggactgccgccggctacataagtagctgcggaaccacagccttcgcaaactgccaaagagctgcttcttccgccattgtctttgcaacgtcgacccagttctgctgtcgttggttgcacactcggtcattgcgctctttcaaatggaccaggctcctagagtgactcgagccggttcttttcatgatatagagtgccagaagtagtttttgggcatatttcgttgatggagagattgttttcctttataatatataagaatatgatatgtgggacaagttactaccggagcatggtacacacaactgtaacagcaagccaaacaaaacatgacatactagaaatctatgataataaaacaaacagtagccacagaaaaaatatcaaagtacctaaatctgacaaagtctccaagcaaacaagaagcatgttcttcttatttccaattttgcacctcttctttgagtggaccaacaaaatgtacaagtttctattaagtcacttacgtgctcgttgatgaaaatgggattcttgagctctgggtatatcccaacaaccctatcggcataaagcgcaatcaagatgtactcatcaaatgtaataatctggtacttccctgtgatcaagtgtgaaagcattattggcaaccatattttaagcacagatgaaacatagaacaattaacaaagattagactgagcattacatgctacagaatacaca

SEQ ID NO: 41527 - DNA, 2447 bp, Oryza sativa
tcctgcagccctgttaagagtaaaatccactgggagcaaacaagttcaaaagttacccgcaaaattaaataacagaaacaaatgctgcaaatagcaacaaagaaaaactgtgtcctcataccaacaaaccagccggtcacattttgtctctcaacttcataggttctcttcctgttggcaaattctgtacgattggcgatatcagttgttgcgtccaatataacatcgtggaaacatatcagatgtccgtcctttgttgcaagtatgtcagactctatgaagtctgcaccttcttcaatagccctctgcaatacaaccaatgcatatctttgagtttgcattaacaatcttcagagaatctctcagcaaaataatattatgcacatgatctccaagatagaatttttaaataaatttatatcatggcttgtcttggatattgttagttaacaacgttaatgcaatcaagtttcacatgtcactaaaatatgcccatgcctgtacttcttgtcacttgtcatttcgttaaccttttgtttttgcggatacaaatttattgtaattttattttggaagtggtcactcaaatttggatacaaagtaggtactgagaaatagattcttatttaccaggtaggcagccgtggtctcttcgggtatttcaccattggaacccctgtgggcaatgttgtaaggtctgaaagtttgaagtggcttcctgtggtttacatccagctgactctgctgagaggcagctggattggcattggattctccagaaagtagtacaaggacaatgatagagatgagccctgtcaagacaacactcaattaacagtactagacttgaattgttcaagtacgctgaaaagttggaagtttcattcttgatcaaggaaatagagaagtgaagaagccaattcctttgatagttatcattccacgagaaagatgcattaccatcagtatcatatgaactgaagaacatatataaggtagaaatgcttcagtgctaacttgaagaaaatatatgaattactccatgagagctacagattcagatacctagtatttcataaacatacatcgaggttcatgtaaaaagatgctgccaagaggagcattggaaccacagcatgggacaggaaaggaagatgtgaagcacacaggaggtgcatttttttcctttttgaataaacagaggtaaactattgtcaatatgaagaggaaagaaatgcaactgtagctgaggagaagagaaggattttggtcttacagaaggcagccatgcttctctctccttcctcttcctcctgcaatagtctgagctaaaacctcgtcttctcaaaagaggagcctttccttctttctctctcctccctagctctcttgaagagcttatggctgatgagcttttaagcagaagcaccctgcctgcgaatattccttggagttgacatgttcttttgtaagttgcagttctattcttcctctgtgcacactctgcaccagttaagagtctagaaaataaaagaaaggagagtatatgtatatcctattcagtcagctgcacatagcatgagcttctctcatattttactgatgaggaacgaagctgatggaagatggtaaatttgcaacttgcaaatatttccagcaaaactagaaagcttattagcacatgattaattaaagattaactgctctaaactttaaaaatggatttatttgattttttaaaacaatttttatatagaaacttttttcaaaaaatacaccgtttagtagtttggaaagcgtgctgacggaaaacgagaaagttgaagtatagaacggggtaagtaatgaaatgctgttacaattggcatagttcttgaccaaagctgggccatcaccatccatttcaccgaggactatgtgtccccaaacttatgtcagcttctgaagaaagttgagacgcggttttcatttttgtcaagttttccagcggtcaatgatcaacgccgaaatttaaatcccggccgtgtgattcgagtcctagaattccacttgcattgggtcaagtcttcttgagggaccccctccctgtagttgaagtgtttaagagtgatgaggctggaccagcaataatgcctgactgagacagtgcactagaaagaatggaagataatcctaagctaatgtacaatatccagggaaaaacttttgtgtggtctaagtcatcggattagctttgcaattcatcattatgacaaaacaatatatatgaaattttgtaggaacattgttctgaaagatgatgcagtatattccttagtactgtgtttgtataagtttgcttttgcgtgtaagtttgctggactggatttttgtatagcagggatgaagtatgaacatgacgcgtaatcgattatcaagtgccgaaattacgccacaaataactagtg

SEQ ID NO: 41528 - DNA, 1342 bp, Oryza sativa
ttaggatattagtgcggtggtggtagcctacaaggaatccagttaatcagaactagcagtggaaggtagattcgcaatttttgaactgtatacagtggatgctatttttctaaccaaagctttaaggaaaagcataacagaatgtgactaccacatatattcaacacataaaccatccatgtagcattctctgttatctcgtgatgtgataactttgtacttttaaatacaaaatgtgcatattacaaaaaaaaggatattcttgtgtagttatgtggttttcagttatacactcaaattaatagagatgcacgtaatggctatgaagtaaatctgccaggaacagttaagtgaaaaaacaaacaaacctcaagatcttggcaaatgctgctccaacatgaatttgaaaagtccctagtttagccagtccaaaattcaccatgcagctctgtgggtactgcaaacatacaggaacgttaaagctgagtaagttcatgtggattatccattgcttcccttagtatcaactctgccctctgctccttatcctccttgaagaaccagggatccttcagttcaaccagagctctcgaattcagtgccatcaccattgacttcttatcaatcccaattctaaaatacaccggtggcctctcttttggaacaaccctcttctgagtctgactatcattttggccctgatccataccctcatcaaattctccaccttttgattcttcaaatgcgggtgcgaaggcctcaacaacagagaatgtcttccccacaccaggcatggtaacctcggacaccgccttctccccataaggcaaagctcgctcatgaaacggattcgccttgctctcaaccacatctagtccgttcgctttgactgcatcatcgaccagcattcctggtcggaacccgtcggcacctgcaagagcaagacgccgttgcaggctgagcagcgacttctcagctttcctccgctgccgcgcccgctccacctcatccgccccagccttagccacctcctcactccacaactcgctcctcacatacgtgtgaggttccggaaaggccgggagccattccgggacatggctcatcccgctctccctacccaagaccgcaaagctcgtcgtcgagtgcagcggcacacgctgtaccggaaacctcggcaatggccggcccgcgaacggggatccttggacgcgccaacaaacacggccatatccttgacgacggcggagttggcgaggcaacgggcagaaaccgaggcggcccccgcgaagccatagtaggccgcgccgcactcctcgaggaactgtatgacgtcccactc

SEQ ID NO: 41529 - DNA, 3634 bp, Oryza sativa
agcaacagagagggtggggggaggggagaggatactggcgagagggagagagaagaaaggaaatgacaggtgggccctataatttattattattattattattattattattattattattattattattattattattattgctgactatggcaattgacaccacgtgtgcaagctcttggtcaaaatcgcccaaaacagtcctagaagggtaattcgtccgctttagaaagttcagaggagggggtaattcgtactttttccttatgattaattaattactacattactattaaaagttgaaattagttttatttgatatttaaagatacatttatgtaattttaaaaaagtatcgtttagcagtccaggaagcgttctcactagaaataagaaaatagctaaccctgtcaacttaaatacagtagaacacaacgtttgacgaagtatttatagtcacgggtggtataaccatacaagtgtttttaggtagagtgtggtcagcattccgaggtttattatcattgtatgagcaaatactataagacctttaattacttgtcctacattgtcatatatgcttatatgtatgatgaggtagatgagagaagagaagagagataaagagagaggagaagatacctctcatgcaagaaacaaacttatccctcccgcacggaaaacggagcggtccattagcgtatgattaattaagtattagctaatttttttaaaaaaaatagattaatttgatttttttaatcaactttcgtatataaactttttgcaaaaaaacgtatcgtttaatagtttgaaaagcgtgcgcgcggaaaacgagggagatgggttgggaacacgaggatgcaaacacagccttaacacaaacttgaagagaaataagagaaaaggaaagagttgattgatcaaacaaataaaataaaatcattagaatcaatgcaagtgtatccattgaaaagggaagagtaaatttgagcaaacaaataaaatgaaacaagaattttaaaactgtttttttccctgttaactgcctccattaaaattattgtaatgctagtgttggacgtcttatgagtcttcctgatttctcattttctatgtggtgaagttgttgaaaacatgttaaatgacgctacttgacaaacatattctggtgggggtggtagatcgccaggcacattcctttgttgtatcaatatttgttaaatacatttaagtaagcaattcgctttaccaaaagcagaacatgactccatggcccaatggataaggcgctggtctacggaaccagagattctgggttcgatccccagtggagtcgcccatgtaagtttcgatatttactttttacctttctttttttttataaaattggaaatttttgataaaccaaaagttgattattctcccattataaatatagattatcttttaccattttgtgttttaatttttacctttctttttttttgtataaaattggaaatttttggataaatcaaaagttgattattctcccattataaacatagattatcttttacttttttgtgtaaaataggaaaatcaaaagctgattattctccaattataaacctagattatattttacttttttgtgtaaaattggaaacttttggataaatcaaaagttgattattctccaattataaacctagatttatattttactctttttttttgtaaaattggaaacttttggataaatcaaaagttgattattctccaattataaacctagattatttggtcatattctgcgcgcggtgcggtggggtgctataccggctgatgtaagatgtctaccggtaaaaagataattccgtgcacacatatctctgaacaattttctccatcctctaaattttgcctcattttctatgtgtctttgcgttttgcttcgagctcctctatgcccattctagttcaccgttagatttttctaaaaagattacattgccctttctcatagttacgatctaccaacttcataaatctcaatgtgcaaaattttaatctacgataaaatcaagttgtggaaaattatttgatgcaaaatttttaaaacaaaatttaatttttgaacaattttttttattaaatccatacctcgtttcatttggaattgagaatcaaaatatttatttgatttaaattttagtgaaattgttgtatgaatttcatcaaatttgatttgaaatttattttttaaaaaatcaaacttcatctttcaaatgtgtggtcaaataattttatcccctttgtttttagaatgattctttttttcacatgagaattgtgtttttatcaccaagctaacacaaaagtatgaagcggcgtatctaggatttttatacgggtagtccaacctatatatattttttaaaataccctaaatataatgaagttagaagtacaattttatcgaatgtgcatcataaaatatgaataaggatttttttcctttttccaaaatttttttttcacatatgtatatatgcatggggctacgattttttggtggctacgaaacaacccctggatttgactagtatgagaaaggggcaattagtcccttttgaaatataattccatcattctgcatgcatacttccgcatgctgccttaggcccctttctttaatgttttaaaacataggaaattcaaagtattgcaattccgataggaaaattttctagaaaagctttgtttcaattgaattatatattttcctttgaaatttcaatgaagatttcggagaaaagttagtaagagctctaacctcttataatttttcctttgagtctatttctcctatctcaatcctgtgttttttatgtggtctattcaaatcatcattcccatattctccatgttttacaatcctatgttttatatttatatttttatataaaagttctattttttttatttgtcttttttttcagtacagatcccttagaatatgcatccatcacttttttttttctcaaaccggacgcctgagtctaggcattttccaaaggaaaaatgttcacttttcgtacctcgaatataggttgagtttcaatcgcgaaactcaacctacataaccaggtacaacacattagttatcttctaaaaacagtgcaaatagtcccaaaatattaagtatggttttggctaacatgacgttcacgtgacagcccggtcacaataaattaaaaatagacatgggcccacatgtaagtgataagggggaaaataaaaaaaaatataagacccacatgtcagctccgacttctcctctctctctttcttttctcttctttcccatccacaactaaagttcatgtgagggaggcagaggtgggcgagggtgagggaagaggaggcggccgatgagacgaagggttacctcatcgacggccggtggtggcgaggaggggaaaggtagtggcacgggtagctagggtggaagccgcgggctgtgagggctagatctacgcgatgagaatgcagtggagagaggaagaaaagtccgcagtggcgtagaaggagacgggagcatgcaaggaggcaggatctcaaaacagtaatgacgataacactctag

SEQ ID NO: 41530 - DNA, 5377 bp, Oryza sativa
ttctgggagccctgtttagccgggagttcctgttccgcgcgtacgcgctaggaacggaggcggcgcgcactttcctggcgtccctaatagtgtcgttctttttttttaatgaaaattcgccaccgtatgtttctttcttttgtttagttgactgaaacaaactttcaactcagatttatccaggatgtggaaacttttcaactaagatttgaacactctcaagtctagatttgaacacagatctaaaatttttcaagtcaagatttgaatactttcaacttaaaattaaaaattttcaactcagattttgaaactttcaaatcttgatttaaaaattttcatgtcagatttgaaaactttcaactcatatttaaaaacattcaactcaaatttgaaaattttcatccaaaacttaaaaactttcatcgcaaatcttaaaaactttcaactatttaagtccagatttgaaaactttcaactaaaatttaaaaactttcatctcagattaaaaaacgttcaactcaaatttgaaaactttcatctcaaaactgaaaaactttcaactcgaatttaaaactagcagaaattaaagatgaaagattcaatttccaaaataaaaaaaacacggaaaaaaatcggcaaaaaatatttcagggcctccccggctccccacggtggaaaaaagaagagagaaaaagggaaaaaaaaaggaagagaagagctacttgagggcgtgggccgtgtgggctagaaacacgcgccagatacgctaatagcgcgtacgcctaattagccattaacagccacatcagctaaaacatggcaaaatactgccttaaaacctcgattacgtagatgcttttttttttcggtttaaggacgcgattgaaattcaactccaatacgagagacctaaagcgaaccttttccttttccaaatcctatatatttcttttgtcagcccatcaaggagcttctatccgaatccaaatttaagttaaacggagcccaacccaaggcagctagttgggcggcccaggaggagataaaacgtattgccgcatcgtctctccgcaaagccgagagaactcgcggcggaacagaggaggagagagagcgaaagtgcgaaaccctaaaggcctaaaccctatacttggaggtctctcggcgcgagcgatctgctctccgatctgagatggcgtcggcggtgttggagatgctcaagaacctgtgggagtcgcaggtcaccgacgaggagaaccgcgcgttcaactatgtccgtccaccctctcccctctcccctctccctgtcataaacttttttttttacctcttcctcgttgtcgtccaaggcgtaattgtttgtgtgggtagctgctgcgtggtagtatttgttattcgaggctgcgattttcttttaaaaaagaagggaagtaattttgctgttcttggaatttggtcgtgcgcgcgggggagatcatcacggggtcaaagcacttggaatttactacttgtttagcctttagattgggtaaattattaattttcttggatcgctggtggtcaatgtgcgattgattaggtgtaaaagagcagtggtttcaatgatccaatctaggctcgatttgctcaatccttctaattgtacgactaagatttcaggggatttagttatttccactagtttagggttggcacctatttagaggtggcaggttccgaaatgatcaacatacttttatctgtcttcggctccacatctactgggagtctggaagttcagtgctaaatcgataagaagcaagttgaaagcaaatctaatctattttgaaacattcagcaaacactatataactctctttgtcactatgaaattttcagttatttttgtagcatctactaatgtaaaaaaaaaatgttgtgcttaaaacgggtgcaatgtacgtaatcctagttaccaaatcacctgggggggtaatccaccctgcgtggtatcaagatccttctgttggctgttgtacgctaccttccaatgcagtttttgagccgggccagttgcctgcaaggttactatttttcttatacatatattttgtcctgtggttcactttgacgaatgatggacatatgttttgagtttattttttaccgcaatataaaattttgccatttttaagctgggctgcttgcctgtaagatagtttttttttttcttttgatattttatctctgtggttcactattgacaaatgatgaccatgtgttgctctacatgccttgcattttatttttcattgcagtataaaattttgacagaaactgtcttctgtctatgtatttctgaatgttggttgtcagttgtaaagtttttaaaaagatacaattatttggtgatttctcttgtatccgtctaactaatttaaattggagctagaatagaccaaacatgcgtgagtgatgagtctggattctggaagcaaaatcatccaactaaacaggagattttagggggggatcaaacatgaatatttttttgttacgtcaatcatggtccttttttttcctggtattattcgcaagtgttttgtggtgattaatgcttgctgcttttgatttccagaggatactaaaggctgtaggtctttttgctggatccatcgccgtgatgcataactttggtgaactgatgaacatataaggctgttctgggtggttgagcagggttccatcttccatggcatcattataagatgtccgccttatcatcaggcttgtcgaattttttgtttacttagattgtttttagctttttatggttcaagcacttattgacattcacaacaggagtatttttctgttggatagtcagtgtcaaatttagctgcaataccactgaaatatagtactatcatggaactttggtagacctgtcctatcagaattcattcatctacttctgaatattgctgttctgttattctgagtaatgatgcctactgaaattaggccacgtttattggtgattgacagcagatctgacgattttcagataaagggagctggcctcgtttaaatcatgcatttttgccctttcctatgcaagtccagctgttggatgagaacataagtaagatctgttggttgtgtatagataattgcatattggccagcattcctttgacgtcactgttccaatggatcccatcggaatatgctacagttttccgtattgcatcgattgaatcatgcggcaagaaaatggcgaatgactttttttttttcattgtctctttcaatgagtagttggcatatgacttaagatacttcctccgtttcacaatgtaagactttctaacagtacttccattcatttagatgttaatgaatctagacatatgtactgtgtttagattcattaacatctatatgtatgtgggtaatgctagaaagtcttacattgtgaaacggaggaagtaaagaaaatcgtagaaaatctgagaaaaaaaaagcaaaacatctatcccttgattttcacttaaatcagtggatctttaaataaatccaaacacgaaaagtgactatactgttccacctctccttccatggtatatatatgtacgtacgttagtacgtaactttttttcttttcaatgtatatagttgagacaattattattactattattagtgataataaattttaaataaaagttactttacaaacatagaataatatatcagcatataactcttttacaagtatacataaatgaattagctctacaatacttgaaaataaagtttacaccattatattatattatgtacccattattttagattattttattaatgaaaatatttgtccatttcttttgttaagtagtcatggttggttttacaaagtttcattaatttttgtgatataaattatagcgaacttattgattataatttacatgacaaaactatattgttaaccgtattatataatagaaataaactttacttaaaaaacttcaaaatttataagtaaactatacatactacttaaatctatataattatggtcttatttcaaacaaatattgtttcaaagaaaacaatcgaacatgcaaaagaagaaagaaattagcttcaaacaatgttacattttgcactaccaagccaagcaattatgtaggtgtttgtgtgcaccaaaacccttcaatgttctttaaaactatagagaaaatattgttgaacttatatagagaaaaaaaaaatctaacttttaatctacccttgatttgtttgttatgtgccttcacggggcgattcaatcacaaaaactttgagttccttgatctcataatttttgcttctagccatattttacacagcccatgtacaaattgtatgcttgataattagctagtggtagtttaatatttacttgatacaaaagttgtatgagcttactatcttctattgaaaagtcaatgaatggtttttgagatatgctaaaacaaaagaaccctcgatatattttaaaaggacattctccgactatatacgagacaattgttgaacaaactataatgttacccttcaacaatataaatgcccgcgcataggcgcggctaccttcctagttgtgtaagtaaacccttgcagtttctcttgtatttattctgcatagattctctctatctcataatttcattattttggtagttgcacatttcagttgttctttttgttgatttttgtgctatctgtaacaaatccaaaaatgctatggcacccataatggtcccatgtactaggcagcattaactgcactacaacatcaaactaataaattggccatcgagttattcttaaatatagatttcattctctcttcagttaatttgtttttaatttattatgtatgcctcacctattgggtaggagatatagcatccgttgagacttgagatttaggaaaaaggggaacatattactcttttaaaaagaggaacttctttatctttgtctatttcctcacatgctgtttcaaccagaagaggtttgggatttcttcctgcgaacaatcacagcacaatatacgtataccccaatacgtaacacgtttcttgtaccctctatgtatcaagcacaagtgagattgcacgtgtttattgtgtactgtttattcatgtgatggtatgttctatacccacccttacttcagaccttccttggctgcatttattttgccatgtttgtgttactccctccatccaaaagtcagacctatttcatttgttgatttttccaaaagtttaaggcctatttgtagtctctatgtgctaaattaaattgttgacgggaacccaagaagctatcttag

SEQ ID NO: 41531 - DNA, 2462 bp, Oryza sativa
tgagccattgaattagtcagcttagatttatttaatcaataagttcttacataaatggagagacatataattggcgacaatttgttaaaaatatattgagaaaatttgttcaaaaaaatcgaatggttggtggcttcaagttgagtatagcttctaaatatctagtgaataaagttaggaaaagtgcaaatgaaatagttgaaaaggactgtgtgaccgaacatgggtgtctgaaatgtttcttcatcattcgtgaactcctatttttgaatatgataagcttgtccagatagcttttttgtcttttgttcatgtgtgcctcatctggatggtcatatagctattagttttgaaatggctgtgtggcaactgtccattgggatattctagattttagcagtaatgcttattggatttaaatctgaagtagtcaattcatgctgctaatactattctgatatatccacttgctaaatatacgtgacatttaaagatgatttgttgctttgtgcagatatgctattgctatactgatgaatccatgatgcaaccttctctcagttggagtgacctgctctgagtggcgtgttgatggattgatttgtgatgaacaccagtccaaactgtggcaccatcttgcttgtcaaaccttcttatacaagttaaaattcccattcttgttctccggtgctttacttgatcacagaaatggcatatcaaaaggaactggtgctggtcagctccatctgtaactctatttctcctagcaagcagcgatgttcatacttcaaccaggctgactctactaactaaaagctcacaaatataccggaagaaccttgcagtaacaagcctttgctgtactctggtcattggttaactattgtgtctcattagtttgctttgtggatatatgtcagcggtttgacagatctcctgatgctctgtggtggttggcagtctccagctacatggccactttattggccatcagttatatattaattgttgttaaattgctgcgttagttgcttggttgcaacaacattgtagtagatttgtaccatatgattgatgattcatttggtactgggtgaccctgtagattatcccggcccttctgaattgcaaatcataccttttctgtaaactgtaaaaagcaaacagtgacagttgtgaagaacagttatcctcgcactttcggctgtgcatttgttttgcctggatgcgacctggtacaggcatcctgatcctgccaagttgtgtggacttcttgtggatgttggcaagctgggtaaacgctttctgtgtgctttgtgataggtgggttcatggttgcacctgacatgtgtgtccatcttatccatttgcttgcttaggagtgaggttttctccactctctctttattttatttgataaattcctgcaacatgttattctccaagtacaagtggaaatatattatttggaaataagcaggcattgtaagcatagctagttctctattattttagttatattgacggtcgaaatttgtcggtaacgaccgtcaacatccacccaaatcccttataatatggacagagggattacttaacaatggcaaacaaacaaaaatagttgaaaaagtgattagaaattctttagaaatgacttgcatttaagaaagagttgagaatttcaactacttgcatttgaaattggatgagtaatataacataaatttaagaaataacattgacaagtgcccaaatttcaagaaatatcattgtgtctgggttacggataaaacataccttatatcctacgacttatggaatacatcgataaggtataccttcacgcacacggatcatttccatattcaccatttggaattctttctaaattacagaaaatatctctatgagtcgaacgatttccaaagtcctactcggaagggatagagtttttgttataccgtaccagatcaaatatctccaagccttacttaggagtcaagatgatccacggtataaaagggacccctagggaggggtgcagggcatcgaatttcaccgcctacacacccaccatagttcacgaagccggagtacgtggagccaagtcgttgggagatctcgtcgaattcatcgactacgatctcgtcgatatcgtttgtttcgtttacttcctttgtaatctgtgattccccatcatcaatctcatatgaactagactaggactattacctgacaaggggcctgaaccagtataatcctcgtcttttgtctgcttgatgtcgtgctatgtagaccctcgttctaacgtaccccagtactcaactcatctggtccacgagtatcactcgtcgacacattgtatgcctttgacaagcgctcaattccaaaaaatacaattgacaagtaagagtttcatgaaatgccatcgtacatgccactttgttccaaaaatgccatta

SEQ ID NO: 41532 - DNA, 6912 bp, Oryza sativa
ttatggaacttgcactcgtcgatgacatttcttggattttctcctaatagaaaatatgtgatattatgatatttttttcttttaacactgaatttgctcctaccttgataatagagtgaatctactcagtatcacagagttcgtcacaattcaacaatatgaatctgactttgtcgacatccataatataccatcgcctttcccttaacctctaaatttaccatcatgaccacagaccgttaatttgcattgaagacctagagtgattgattttgcccctctagttgacagaattgagagaaggctcacctccagctctatgttcctgccctatggagggagactaacccttgtaaactctgtgttatttgctatccttacatattacatgtgctcccttcaactaccagtcactgtaattgaagcaattgacaaggctatgaaaaactgcttatggagagggaatgatcctagctcgaaaagaaagtccttagcgggctagcataaagtctgtagaccgaaggaaaaaggaggcatgggtgtcattaatctagccttgcagaacatcgctctccttctcaagcatttggcaaaattttatcaaggggctgatctcccttgggtaaagttaatctggaattcatattatcagaccaaggttcctcacagagtttttaacaagggttctttttggtggagggacattatcaatctttcagattacttcagaggaattgcaaagtgtgaggttatctcaggtaacacagttttgttttgggatgacatgtggaatgaccaaattaggagcatcacttacccacatctctgtggccatgcaattgtcagaaatgaatctttggctgtcacctgtgctaaaccttttgaggactgctttaagttgccactaacccaggaagcttacacagaatttctgcagctaaagggagagctggatgctctgtccttagcaagtcagcaaggggataattggagctttatatgggtcaggaacaattacacctccaaagctttgtacaagttgaattttgcagccatgcaaccccccatacctttccgatggatctggaagaccaaatgtgtgatgaagataaaagttttcatatggcttcttttctctgataggctgaacacgggagacatgttggacaggagaaaatgcgcccccctaaatgctgatcttacttgtgtcttatgccctatgcatcatagagaaactttgtctcacctattctttcaatgcccttttagcagaaaatgttggcagaagctaggaataacttggaacacttctctagaattctttcagatgctggtgctagcaagattgagatttcagagaaaaggattcttggagatttgtttcattgcatgttggcacatttggaagcaaaggaatggaaagattttccagaatatagatccttcttttgacagctggtggaattgttttaagcatgagattcttctacatatgtgtagaatgaatgatgatcttagacaattggtttctgattggttacaaactttatagtttccatagggggctgtagccttttgtaatttttctttttccttgtaaatacctttttggcttctataaaatacactactgggccaatgcctggtagtacttctttcaaaaaaaaaaattgcattgaagaaaggacaaatatgcccttaggatatgtgaagaccagtagcactgagaccatgccatgtagggcactaagagcaataacaattgagagagaatgtacaatatgactacacatgtgaaaaatatctttatttatacaccatgattaagaataataatgagcacatattttaggtatgaataatgtacaacacgtgtgcaatataaaatgtgtacaactaaatcatatgagatctcacatcatattagcaagattataggacaaaatagagtatcagtgaggggtttgcaacaaaaatcatccatgaaaggtgcatagcacaatttgacaaaaaggtgcataaaatccaatgtccaagtttggcataaccaagttcgatcttacaagagctaaataaataagttaagtggcacagatgttacaagcacatatcccaagatagaaaccacaacatgtaacatcaatctattaatttcctcttgcttctacttgacatggatgggttagttgatggcaatttcttcttgcttctagttgacatagatgggctatctggtagtactgttatggggttagtattctttttccccttggcctttgcttttggtggtggtgtgctcgcttctgttacacaaagaagggcacattggctttgtgttttatttgggccacttgaattacaaggaaagaagttcatgcatatattagaataggcacaacacaatcacaagaaggaatatggataaaaaacatttgaagtacgtatacctcactgatgtagcatttgcatttgcagaagtaattaaattacaactagaactatctggtgcatctgtcctcttctttttgctgcaccaaaatgaaaaactagttatcagatttaggaaattgaagtgcaaaggagtaccatgtgatcagatttaagttatagtagttaccttggtgggccaaccaaagttggagttggagttgaagtgccaatgagtaatgtattaacagcacatgtacttgaatttgatggtgttgttttcttcctcttttgcctagatcgatttatttggcaacaattataacaaaagtctcttatagcaatgtaatgaatgcgaaaaatcaaatagaggaagaaaaataccttgtttttgctaaaagagcatatgcttccttagcatctagatcagctccttacatgcctgccatttgtgaccaaagttgtggcaaatagggcatttttggctacctggcctacctttactagtgtctttcccttcagctccactcttacaccttctattcctatgtctccctgcactcctctttaaaattggtggataaagaaagaagccatgtgtactctctggctgttgtggcatgttagtaagaccaggaatacatggagcatatgcagttacaaacttggctacactatagcattcatctacaaacaagtctatatgcaaacccctcactgatgtcaaggccggctctacattttttagggccctaggccaactccatgacatgggcccttaggcatacacacacacactctctctctatatatatacacatatgcactttggatttttaaaagtatacttttaaagcattcatccgctaatcatgctgaaaataaatattgataatatcctctatatatgttgctaaaaataccaaaagagcagtaaaatggaattactatggttaccttgaattcttgactaaggatcaagcttcagggacttcattaataatacttgataaaacaaaagatgacagacatccatttgcttctcataaaaaaaatactcctttaggcatttcttgatgcaaaatcattaatgcggtatcgagatcaatattatccaagacattcttctcaatgcagcacataaccaagccatttaatctttcttgtattattacatttaaacattgtcatcaaatctttatcaaaagaaattgtgcgaaacagattcaaagcactatcaaggtaccgcattattacagtttcatctatgccccatgtatacttttcacaaatgtcaccaacaaagtcattaaaattagttgtgttagaatcaattggccagtcaaacacccatgcacagccaaatctattgcccgcgcgaataattctcactatgaaaataaaagtggaatatggatccatcttgtggatccacacattgtaaacaaacataacaaccaactggaaatgcacaaacaaacaagcttaggagaggagaaattactcatcttggatgtcaatggagggtgcaacaacggcaattggcacgacctcctttgaggctacaacatggagtagagcatgatttggtgactgttgagaagcatccgtaggttgcactaggaacaacagcagctctctagcaagggagtcgtgcccccttggttgcgacgatggcgttgacgatgacgacagcatcaactctcttgcaggggagccatgtccccttggttgcgacggcagcgctgatgacaacggcaacatcagcagcagctctccagaaggggcgtcatctcccatcggttgtgacaacgactctttaacaggggtgtcgtctcccatcggttgcgacgacgttgaggatggtggtcaggccgccgctggggacgatggttgggtgatgaggacacaactaactcagatatgaccatgactaccttatgtgttaatcaaccaaatgtgtaaatgttctatattagatttatagcaaaaatgcccgtgcgttgcaacgggtaaaaataatttacctattccaattatagtgacttctactgttagattgatacatcatagcaggctcaaattataatggtatagattgactgaatatggtgcttctgcgtgagtaagcgatgcggatgagaaaaaaggtgtcctaagcgcacccagctacgttctcgtgcacacacgacactttatcgagtcggactcgaacggccacattatcatgcacacacgacacgtcgctttatcgagtcagacttagacgatgctttgcctttatatgccaataaagcacttgctacagccctctctgcccgagccatattctaccctgatgcgggcatggaatccttccactgcgttccaaaaagacgtacaaaatttccccaattagactcttgatgagcatgcgataattcataatgacacacaggaagctaagatgacacatgaccgatgaaatgtgaacctgtgaacgagttataaaccagccaaatagagaaagctgtcctaacaaaacgacaactactacattgctctagtggctagatgagcacagcatgcagcatgtaccctaggagacgagagtctgaatcccacaaagacatgcatgtatccctgaattttgcataatatatagttcggattttataagtgtttaactcggatgacggacacaaatttagatgagtatgaaatcatcttcaacttttataatatataaagatttctatttttttaaactctagatcaatagatttatggcgagaaaatttatggttggttatttgtgttttgatttcgttgctgggagtatctatttattgctatgggatgaatcatgtacaatttggaaacgtataaacaaataccgacatggatgctaagtccatgcatgaatctaattatgattggtttgttatatctttacactgcttaggtgtttcacatggtttcgttgctgagaactattatctgtttcctacactatgaccatgcatggatatttatttctatatcacgtttccaaaaagtatcatgtccgtttgttttttcctttaatttttcatccgattgagaatccgggtcgccagtagattttttttcccggtccgatccgtgttttatacgtgtttaactcggatgacggatgaaaattaaggtgagtatggaatcatcttcaattttataataggtaaagacttgttatatgaacaaacgttgctacacaatgaatatcgtgtgttttcatttgtagaggtacttgtttgggtgaaggaaaagagatcgactgtaaggaacgcatggatgatcaaaaaagttgattgggtaccaaaccaagaccttctccaagtctactcctacctcaccatgtcacttttggtccatagaaggcaatagataaacttctatacattttggattcggattcggacctcctaatagcattgacttcaaacagacctagccgctaatctagaaggaatctcggggcccatgagtacttgctggaaagcttatgttgtctactttcagatggttttggtcccacgttaaaatttccaccaagctgtcgggaatctgtaaaacaagccacgtactttatcctatccgaatctgatttgggtcttaggctttgtaattgtattgtgggctaagcccaagggggtgtgcgccctagggcaaccctaggacgtccctaatcatgtatattcagtagttgttattgtttagagtcgggttttgcttagattatttctgccattgcagttttgccgctagatcggtttgtggaaccccaaattcgagtgcttaatcatttatatgcaattgtgttgcaatctatcttgttcttgcttgtatttgtcgattcgcatgcagggattagcctccttggcgaggtcaactgggcagtgcacgtttgataaccagaggagacgtggtgctgcaattgtagggttcggatcgtgtgtgtgaaatttccaccaaatcgagagttatcaataccttttggaagatcgggacctattttcctcatcatcgggccggtgcaaggaatggaggcactggggacggtggtcggggctgcgttggggatggcggtcacgtcgacaatggcgagggagacggctctccggatggagtaggggcggccattggttacagcggcacgggggttagtggggcagccggggggaagtgggaggggtccgggagacatatcaaaggctcctccggcgagggcacgcatgcgatggcgtgcggagatgcggcatggtggcggacggatatacgacgtggcggcactgggaatgtggtgctcaaagaggagaaattggggcgtgctgacttcatgctaaggttagatgactcaaagggtatttggtcattacggaaaaataacagtataaacggcgtatagctgacagaccgtggacggtgatagtaaagtgtagagattaagggaaagccgatggtata

SEQ ID NO: 41533 - DNA, 1965 bp, Oryza sativa
ttggtaaggttttttttggtatcaaagtgaacaggcccaaagttatacttcctctctttcacaatgtaagtcattctagtattttccatattatcaatataaatatggaaaatgctagaatgacttaacaatgtgaaagagaggaagtatatattaatgacaggtgcatgctttcatgcacgtggctagtcaagtgaagtcacggcaagcacagggtttcttgatctagccattctctactgtaggctacgcttagatatcttatcccttgttagctactccagtttgttgacacccatgcatataactatatgcagcaacagtggaagcatgcacagcgcatcagcacatacatgcatgcagcccgcggcttgtagcgcaggccgggatgatgtgcgatgatcgatgaaccagatcgagatgagatcaatcaagatgagatgagatgtggtgaggtgacaaaactctcatagaccactactcatcacgatccttggctgatatatcttgcctctgcttgacgatggaagaccgaagtgtcgtttacctagctagctatatactccttctgttccaaaataaattcaatcatagagaaaataaatccaatattactaattaaaaataaatatggacacactaggattggatttattctgggacagaggaaatataaacagttaattttcatagtcagaaaaccaacatcaatgtcagaatcagtcttcttaaattctcccttctggagcatattctcgaaaaacaagatgatatcgtatatatatttgcaaattggtataaaacttatgcaaatttgatgataagaaatttcaaaggaattaagtatatataaaatgctagctatagcttaagaaaaaatatagaaatatgtaacattatagtttataagaaaaacatgacatacagatattgtaatgtctaatggtgaaaacataacagtacatatacttcatttttcttaaacataatttagagacacaaccacaaatttacgggatatataatatgtttattaagcgcacgcgcgcgcgcacatatatatatatatatgatccatgcatggtattggtggcctactattgttaatttgcctaattaattaagggaatatttaaaagattgattgtgttttatgatgtcgtttcaattgagagtaaatatgcatttatgcatggatatgcatgatgggaggagtaaatgcaatagatgaaaatgtgtatcactcaaagaaatctaagccaactaaaatgaatccaatggtaaaaagtgactttagggtgatttgggatgttgagttccaatcttttgttaagatgatgaaagctttattaaattcaaacaattacatcaaggtaatacaaccatctgagaacacttccagcgtctgcattactaatataaacacagccaaaacgcacacccacacactagatttttctcaaaacaaaagagaatacaagaaatgttaaggaccatcaatccgaagactacaccgccacccgtgctcatgggtaatacactccctaatcactcgctccaattgctgacataccatcgtaataaaatcatgtaatcttgacttctgcataatatcccaagtatgaagccagtgaacaataagggagaaataacctgcaaaggagagtatatatttttgttgtaaaaaaaaccacatcatttttgcataaccataaggaccaacgcaaaataattaaggtgatggaagcactacgtgagagagaaatactaataactactttaagtgaggatcaattgtatgggttatatgaaactattagaacaagaaaaacaggttacatctccttttcgtttgcaaagtaggattgagtctattaaataaaaatgtgattacaattctactgatacaagaaaagatatacgtagcacctataccaacacataatataaataatataaagaggc

SEQ ID NO: 41534 - DNA, 10998 bp, Oryza sativa
cttcatgtggctctacacatgtcacctcctctgaatgatcaaaacccctggatctgaactctgagggcccctttgaatcatatgaatgaaaaaacggaggaatataaaaaacatagaattctgacaggaatgtaagtgtaaaatagagaattgtaaaacacaggaatgatcgtttgattggaccacaggaaaaacacaggaatcggataagagagatagactcaaatgatttttaccaagaggttggacctcttgctaagatttctccaaaacctatatacaacaagccattccataggaattttatagggtttggaaaacttgaatcatttaaatcaaagagctatataggaaaatttcctgtaggattttaatcctatgaaatttctttataattgctttcattcaaagggccctgaactcggaacaccggcgacgtgcatgcacatgcagcattttcagttcgtctcctccccgccgtcgacgcacgacaccactctgcagatcacctgaccgccggccgttggtagggacgagaccaacttgtttgactagctagcattaccagtaattaatacttcctccgttccaaaatactcatcgttttaagtttttatctgtaatgtttgatcattcatcttcaaaatattatgaaattattatttattttatttatgacttgttttattatcaaaagtactttaagtataacttatcttttttatatttgcactaattttttaaataagacaaataatattgcaagaaaaagttaaaacggtatctaatttagaacagaggtagtactcaccttgtttacttttccagtggcccgtagagtagcttagccaacgtgcatgttgatactcattcgtcccataatataacaatatagaattatcctactattatgaatttggataggtgtttagattcatattactgtgatgagtcttattatttgataatagattactatattttaggatgagtttagattcgtagtactatgatgagtcctattatttgatattagattactatattttatattttgggacgagtgagtaactctacagtggctagagggaaaaataatagtcgatgtttatcggctgccaatcgccaggcagtaggttatgatcaaatcaccggtatttagggatgctcgttatgtcaactttactattatagacgtacgtggaacgcaactaaaaagcaaactctcgggctgtgcttaaggtgagtgttaagaaccttttctcctgacatgagaaaaagagtgacgcggattaatatatgattaattaaatattatctaattaaaaaaattaaaatcagttaatatattttttttaaaaaaacattatcatagaaattttattaaaaacacacattttaacagtttgagaaatatatacgtgaaaaatgatggagtagaagttagaaaagtggagagaagaataaacctttaggctgtgtttgttgcaaaggattcccaacccctctcgctcattgtttcgcgcgcacgcttttcaaactgctaaacggtgtgttttttgtaaaatgtttctatacaaaagttgcttaaaaaatcatattgatccatttttgaaaaaaagttaataattaattaatcacgcgctaatggaccgctccgttttccctgcggagggaatgagttctcatctccagatccgaacgcagccttagagagtttcttgacatagaagagagagaggagagaagagaaaaacattgttggtgagaacaccgagtctaattttgctatatgagggtgaggagaaagaaagaaggataataaagaaaaatgttttggtgcacttcatatggtagtccattcgaatgggtgtcttttatcattgttttatatggacttgttgcataatgatattaggtggctgaatagaatattaattgtcaattgactatatatacatcagattgtgaatgctctaaaccgtctgtgcatgtccttaatcactccatcacgagttatcattgtctatgtgagatccttacgatgaattaatgcactttattccctcaatccttaaatgtgtttaccccgaagaaatttcaatgtctaaatttggttgacattgaccaaaagtaacttgttttagaatatgtattttatgtaacatcaaatctttattgctagatttatgataaactgggttgcaccttttaagcacctatatcccgcaagttagccagaaaaaaatgatggtgattttcttttagataatagaaaatgaaggtgatacttcgatcgatcagttagtaatcccttcatttcatattatattataaatcgtttgatttttttctagctagtcaaatttttattagtttgattaagtttctagaaaaatatagcatttttaacataaaataaatatattcaatgttagatttaatgaaattaattttttaatttagatgtttcttaaacatattaaaaaaaatcaaatgacttataatataaaacggaggaagagtataatatattcgtgaaggtagaagggttcaactaatccatcacgtactgtcgagatatgtacacagaatacaaaaaggaaatgatatctgtccacattcaaaaaatatcttggggggtctttcggtgagaacatacatcgatggacggatgtataggtacgtagtacacaactacacatgcgtagcagacgaccggacaaagaactagacactttggtatcttattatgcttccaaccacctttatctcatgggcgaacaagattggatgttacttctcttctttcagaattcagatgactgaattctagaaacatcgaaaggttacatgcgctcaatcctgctgcatgcaaacacatgagagtccaaccattttaaactactcttattaattatcaaaatgtctagatcattaactcgtgaaaaaacttattatactaattaaggtatatatgttccctaacacaattatagaactttcacttatatcaaaatagaaagaatttagcagcacttaagcaaacaattttaacagtttgtagtagcaatccactcactaccacagaaattaatggtcataactgttgcctcatcattacagttggttttctgcccaaatgttaattgtaaatcttgatgagatcatacatcatcaaggttgactactgttttatttggaaccatttacatgtctaaatgtgcattatatataagttctcagctatttgaatgatttcttttattgttttttcaaacgaagttctatataaaaattatagacctcgatgagatctacaacatcttagtaaaatatcgtttcatttggaattttttatatgcccaaatatttgtttgtattacatgcctaaattttaaaaatttgcaaatgactctggatgaagacaagctttataagaaatttttgtgttgatctcaacgtgaaatctacaactttgttaatgttgttctcatttgaattcatttttagtgccaactacgaattataagttgtggacacgaatagtcaaaacttaaaataatagcatgcgaatttcaaacaagaagatctatattgtagggatggtaaggtggttgtgtgtgaagtgcatgtgaggtcttgggtttaaatctcacatccatgtatgtgtgaatcttgggcaaaaattgtatggctagtgaaatttgctagtggtagtggtagactggtatgcatagtaaattagaaatattttttcttgaacttcttttgttcctaaaaatttcaaaaaccgagacaccactccgctgtcaatgatgtatatatatatatcggttcataaatcggcagtgatgcctttttcggtggtagtggaatatactctctccatttgagatgtcattttagatgcagcagtcgaaccttaaaaatattaattactactacagtagtataagaaaaatattatgatttgacatgtaaaaaatgatattagtttatttgccacaacaatactttcatgcagtatattttcaataattttttaaagtgtatgactagaaaatgcatttataaaaaactaagatgacgccgctgactttttgtcacgcttttgaccattcgtcttattaaaaaaaattatgtaactataatttattttgttgtgagttgttttattactcaaagtattttaagcatgatttatatcatatacatttacataatttttttttgaataagacaaatggtcaaatatttgttcgaaagttaacagcgtcatctattaaaaaaacagagggagaatgtcactagagattcagttgatttcctgaacgacgtctagttgaaaagaaccagaggcagtattgaggagaggaaaacacccattaataaaccatccatgggaagtcctaaaattttcccctatacctagtattgcaagagatcacaggttaatcagagacttcgagagcacacgcttcaataatgctatggagctactatgtcccataaaaaataaatctaatccagaacgttacacattccactactaagaatctgtacagctttcttactagatttgtattactacgatgtatcatagtttttttaggacatatgaagtagacatgatggtgcgaagcaacaagagacaaccagagccacactgatgagggcatcactaactcggatataaccatggataccttatgtaatcaacaaccaaaggtgcatactttctattgttgacacgaaaaacacacactggcctgggagatctgcttagctccagtgcaggtccaaagctttatgagatgcaggcgtgccagtcagtttgatcctataactgacaagatatgcaaatagcagatcaatgagccgatcggctgacaagccgatggagcaatctcagccgaggccgataccagtcgatagcgatagggtcttgagctatcggctatatatccaatgtagataatgatataaaggcgatcggctgatgatgataaataacaataatatagcaatataatccagtagaaaccaataagctaacaatataatatactacaacaagattgatccgaaggttaaagcatacatcagctggaggtccgatatcataaaatccacaagattagatagatcgatgaaacctttgttgttatcggctaaatccaacttatatgtatatgcaatcctataagccgatgcaacatccagataacttatcggctagcaccccgataaaacactagcatgaacctatcggcttataaagatttatattatcaacaacaatctaataagtcgaacctaaccaatgcagcacgagattgtatatgataatctaatactcgatgagccgatagatctgtctaatgtgatggatataacaaatctatttacaacaatattgtgaatgtagagatatatcggctaagacagaagatcggacctaaccgagatagtcccaagtaaaccgatgcgtctctaaacacaatgcaattagagatagaattgagatatcaggtaggcaaatagatcaaccaaactagagcgatccaagagatcgaagcaatgcaaccttaaacaacaccaacgtagccgatagattcaccagggccagcggaacataggacttaccccttcgctggagatcaaactgaaccgatgcagccccgcgtcaggtgccaaattccgccggatgataagtaaaaacctcggtaaagagggtagcgatgcgccaagagtagttgtattgatccagagatatttacaatgaccccgggtgtacatatttatacccatgggaagatactagtccttgtaggacaaaactttcctacagataaaagaaaaaagtctttattggacactaaacacactttcctaaagataaaggaaattaacaaactatttctaattaatagatacaattgccttcttcggactcaatccgcacgtggcaatcctcatgaagcacgtcaactcaatctgacaatggttccaatctcaccttgccagaatcggctacatcggcttaccttgtccgattcggtatctgccgatgcagtcccgaagccgatttatactctgtttctattattgatttccttccaaatccgcttcggccttaactccaaatctgatgcacgatttaccaaatttggtcgttaacatctatatacgatttacatgttctatatttaaataaacgatattgcaccatgagttttgtgtgttttcgtttacagagatacttgcttgggtgaaggaaaagagaccaagcgcaagaaatatatggatgatgaaagaagttgattggggataaaaccaagaccttccccaagtctactccaacattactatgtcaaaattcctaccgagctgtctggaatcttcaaaacaagccttgtacctcatccaattcgagtctgatttgtgccatggttcttttagttgtgtcgttgctaagcccattggggtgtacgttctagggcaaccataggatatcccttatcaaatttattcagtatctgtcataatttcgagtcggcttttgcttagattatttctaccattattgcagtttcgccgctagttcggtttgtgaaactccaaattcgagtactgaatcatttatatgaaattgagttgcaatctaccttgttcttgcttgtgttcttcgatttgcatacatagggattagccttctcggcaaggtcaattgggcagcgcatggttgataaccaaaggagatgtggtgctgcgattgcaaggttcaaatcgtgttgatcggaagtcggatcgtgtgtgtcaagattccaccaaatcgagagttatcagtacctatcggaagatcgggacctagttcctcatcacacacacaatgtggatggaatattgaaataagttttttttaagaagaattgtgtaggtgatatggctacgatatataagacacctgaattgagtttagagttttattattccggctctaatgttagccgagaacacaacatccatatgatcttattccatttcctcaattccatgccaattgggccaaccattatatatgaatcatcaaacctcaattatagattctcttcttaactccaacacctctctaaaaataccaggtctcttcttcaaggtttaaattacccatcaccttctcttcctgaaccctagctacgcacttttagtaatgattaaggtgcacgggcggtccttaaacttatagcggtgtatcatctagatccttaaactctcaaaatgcatatccaagtcccagaacttgtcatagtgtgtcatctaggtccgaaatcaccacagccccttcaggatcctatgtggcgctgatatggcatgtcccacggatatgacgtggcataattttgactgacaaatgggaccgttttaaaaattttctttttcctttttttcttctcttgtattttcctttcttctcctttctctgtgacccgagcagaagaaaggaaaaaaaaaagaagaatgagaagaaaacggaaaagaaaaggaaaagaagaaaaaaaaaaggacacgtcatgtccatgtggcaggttacatcagcgccacataggattcaagaggggatgtgtcgatttgggacctagatgatacgctttgataagttctaggtcctacatatgcattttgagagtttggagatatagatgacacactgctacaagtttaaggattgtccgtacactttactctttagtaattatgtcatctaatacttaaagagggagtcgcccttcttcctccctccaacactttatcctaaaaacttctctcttcccataaaaatatctatcctgaaaaaccgatttcttaaaaaaagaccatggtataataaaccgaacagctcaccctatccaaatccttccacgaaatttaataaaaataatggcttataattaactagtatattaaaaaataaaggtagtaatcatcaagcttagcttcctttcttatctccagcacatctataaataatgacaggaggacggaggatctgataataacggttagcccttaatttattgtgtggccacgatggcatacgaacttctattttttcctgataaatataaaatcgcgaaaatacttagtgtcggacgtctgccgtaagatgaaaaattggatgagaaaactactacttacatccctgtctaccacacatcggtacacactatatgattttcaaaatattttttcttctgaactacgtatccaatctatgatatgatcacactattatatttgttataattaaatctttacaacaagatatcacatcgttaaattccgataaaggaaaaaatatatgtttcaatccgttaaatttaatgtttcagacgtgatagcaatatatttcaacatgtgtcttcattatgtttcataaaaaaatttaaatgtttcaataactgaattttgtgtttcaccacgtataactcaatgtttcgctaatgaccgaaaaagtgtgggacgctcatgtccctactctctctctcctgccattctattagctctctcaccatgcatgcatgtgttagtaaccttaaaaatattttttcttgtaaactacttatccaatgaatgattcgatcacaccgttgaattccttataattaaatttttacaacaagatatcacatgattattggtatttcttaatgacattactagaaatataattcccagcaatggcgcagaaatacttctggtatattatggttacagaattcatccgcaagcgcacggatatactattgtagcatttcacctgagagtattccaaaggtatcgtatttatcttatcccgtaggaagatcatgtagggaaaactcaactaataatttatatattacttgtgataatcatattctaagaaggggttaagataatccaagagtagaatgacacacaagcatttaactactcatcctcataatatattatctaagctaagtggaaagaaaagagaaagagaatctattcctatacttataatatacatagtatacatacattctagctaactgacatactagctaataccccctatccgatgccctcctggtacttcgagaagccacccctgactaccgagttctttacgacagcccgtcatgacccatacaatcggggctaaatacggaggagtaccctccctaggaaattaacttaggattatatataggcgcggaggaatacccgtactgagctgtcaccatcagcggcccacctctcatccgcaatatataaccccaaataatgatatcccgtaatctagacaccacgtctaaactaccagatacaactctaatatcatcgtcatgacatagaataattgcataagcaaacattatacccgcaccaaagcttcacccagataagctagccgtatattcagtataacaagaacataatgtaaagtaggtactcatatactcggagagtatttcaataccataaatgcatgtagaagagtattctaataaaagtacaaagcttacaaaagaggaaagaaaagctgctagagccatacccgaactcttccgaaggcttccggactcctgactcctattctaattctattccaccagctagatactactaaactaaacttgagagaaatgagagagctattgtttgaggtgtgtgagtgaagtgagaatggcaactccttttatagcctcccaatgacggttgtggcggttggaatggtcgaaaatgccctccaaccgtcattgggggctaatccacaccgtctaggcaaagccctggatcagatggcgctaaggagggttcggccgaacctggggccggcccgatccaatccaatttcggctggcggcctcctctgttgcttctctttgcagacttgtgaattttggcccagtttgtcgtgtcaattctgagttcttggcccattcatgcataagcctggttctcgacatctcttattgatttatcgttggtgttgatgtcgattctcctccactttatgatcattctctgcaaaaggttagtaaacctaacactagtggaatattattattctaacaaatatatgcattgaaagcatcactagttctctcctgttttagtaatattgacggtcgaaactgatcgataacgaccgtcaataatgattatattctgataaaagaaaaacatatgtttcaaacaatacaaatttattgtttcatacgcgatagcaatatgtttcaccatgtgttctcattgtgtttcacaaaatttctaaatgtttcagaggctaatatttctgtttcaccatgtataacttaatgttgcaccaacggtcaactgaaacatttgaccgtccgatgtttttacaccatcggacgtccgatctatatctctccttgtaacgcatgagcctataactacttcctccgttttataattttataatgtaaatcattttaacatttcacacattcatattaatattaatgaatctatatatatatgtatatatgtatatatatatatatatatatatatatatatgtatatatatatatatatgtatatatatatagagagaatgtaagtcattctagcatgacttacattatgaaatggagggagtagtatattaaaaaacaaaggtagttcttttcttatctccagcacatctataaataacaggtctcccctccttgaaagtactcatcgggtcatcaccttctcctgattcctaaaccctacacacttgtagtaacttgctttgaagtaaaaaaaaaatggtgtccttctacctcgactccaccttcctgcctctcctcgccaccaccatggccagcccactccacgcctgcctcctcctcgccctcctcttcctcgcgctcgccttcttccaccccggcggcgtcgcgtgggcgctgtcgtcgtccggcggccacggcgccgccgccatccctggcccgc

SEQ ID NO: 41535 - DNA, 4660 bp, Oryza sativa
cacggcgcgggagatcctcgccggcgcggcgttcgccgaccgccccgtgaaggaggccgccgcggagctcatgttccaccgcgccatggggttcgccccgcacggcgggtactggcgccggctgcgccgcctggcgtccgcgcacgcgctcgccccggggaggctcgcggcccgccgcagggcgatcggcgaggagacggtgcggcgcgtggcggccgccatggcgcgcgacggcgccgtcggcgtgaggcggctgctgcacctggcgagcctggacaatgtcatggcgagcgtgttcggggtcggcctcggcgagctcggcgcgggcgccgtgtcggagctggaggagatggtggggcaagggtacgagctgctcggcaccttcaactggggcgaccacctgcctctgctgcgcctcctcgacgtccatggcgtcaggaggaagagcagggcgctggcgtctagggttaaggtgttcgtctccaagatcatagaggagcacaagacgaggagagatgccaagtacggcggctgcgacggcgacggcgatttcgtggacgtcttgttggggctggaaggagaggagaggctggaggaggaagacatggtcgccgtcctatgggtaagtacactgatttaattaccatgtgtttgtatgcatggcacgtactttagcaaagcttagtactccaataagattcagttagtaagattttagatttaaacaaagaaatttcttgctaggattttcttgtttcttgtaaaaaaagctcttactgtcatgtagacatgttgtaaggaaaaataatatggaaaaaatgttttcatctctcgaggaaacatccatcatttctagatatcacctaaatagttataaaaaaattaaaaaatttacaaaatacattaatatgagatatatcattccacaaatatacaagtttaaattcgactactataagttataacaaaataataaaataatatatgtatactagttttaggtgacatacaagaaacaaggatatcgtctgtaaagtgatgaaaatccatctccaatttaaaagagaaatcaattaataatttctaagttatgttaatactttaccctgcaagttggttataaaaatttacaataaatccgcagggggccaatgtccaaaacatcacttttttttactcctagttgactaggagctagctacccacatatacacaggacatgcatatgagctagccacaaataagctgcatacgtacgttttaatataagtaataaaacaatatgcctggtcaagtagtcaacttatagtcgtgcatatatagtacctttcttcttgtagtctacacatcggcaagaccatatagtttttttttttctgaacttgatgtgatgggccacatattaaccctttttttttgcgggaatattaatcctttttattattaatattttttgtgcgcctgagtcactgtcaatgagtgagtgtgcatgatctcgtcagtatcttgttcatgtggtcatttttctggaatctgcgatacaacataaggtcactgtcccttaatggatgagctcaaactagctaagctctcactacacgattaatttacataaattaaattgcatgtgtccggttgattgaagcaaattgttttagatgacattaacgtaagagtatatttattacgtactgatcatgacatgcatgtatgattttgacttacatatactaatctgagccgtctgattttttttcttgttcactaattaattagttaactagacttgcatatcgtatacactagggccaattccctacatgcccatgtaatttcacctaatctcttctacgcttcttaaatttatttgatctcttatatacccctgagtttttatatatttggatcccttacatacccattctgttaatttaccattagtttgaccgttagttatcgtagaaattactttattgtccttggtatattgttaaaagctagaaatgttttatgtgtaaattatttgatttgtgaaaaccaataaggaataaattactaaatatttgttatgaatttttaaaaataaaacattatttcattaaaataaaaaagatttattgtaaaaaaagttctgcataaaatttgaaaattatttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaatatcatttagtttttgctcttaattttctagtgaaactaatgtatagatttaatcataatttttaaaaaataaaaaataataagttttattttttaagttgggcattaaatgattatattgctagtattttgtataagttaattttttcatatgaaaatttattgggtaggtaccacatatgtataggatgggtaatataatcattttaaaatatttaacggtcaactaatggtcaactaacggagatggatatagaggagatcaaaatgaaaacttaggggtatataagggatgatgtcaaattcagggatatcgaagggattgagtaaattttcaggggtatatagggaattttctctatacactactcactccgaccataagtatttaacactgttgatttttacccagagttcaaaattataaaatgaaagcaaaaactatttaagtttgatcaaagtttgctcaaaattttaaattattttggaccgcaatatttcaaagtatcgaaaattttgtccatatcgcagtgcccctgatatattaaaacatactttcaacatgaagtttgactattcattttattaaaacatatatgtaaatatcatttattttatggtatttcaaggtgacttatattttttacatatttattctaaattttaaaataaaatgaatattcaaactttacggtgaaagtcaaatgtgacaactattatcaagtactcgctccattccatattatatgtcgttttgattttttttcctaatcaaccttatatatgttttattatatttatataaaagtatagtagcaaatctattctacacccctcccctaaaataactattctacacaccccccctcccatgggtcaaacccacctcccccaccctcccaagggcccaaaaccctcttcccacctcggtcaaagcgtcctcccgctaatcaaacccgcccaccactccctcccccgtcaaccactttgttgttctcgtcttgcaggaatcgtggagtaacaggacggtcatcgggtagtaacaagacaattttcttgcagtaacaacttcaaaagattgtcatgatggatctagtttcgttaagcgttttttatgaacgtcgtggtgcaaacggattagaaaaacaagatatgatatgagagatattgctctctaaagatcgagatgtacctctttttagtcctcgtcttactggaacatcgtagtaacgcaacagccaatctatagtaacacgactgctttctgcagtaacgacgttaaaaaatagttatgatggttctaatttacgaacgccatgatacaaatgggttagaaaaataagacatgacgtatacgttcctactttctaaagattgagatttaaaatattttaactctacaaaaaaattactactgtagtgccactgttagtatgcatattctctgttacttcaatttttgtcatgttgttactgccaaaagtgcagtaacaacctattaattttgcagtaacgtatcatgttactacccttctatgataatattattgttgaattatagtaacaaggtataattcttgcagtaatataaatgatttgttctcacacaatttgaacacacatgcaaaacatacaaacaatgttttttactcacataacatcatatggtgaactggataggagaacttgccacgaactataagatcatgagttcaagtcttgatttcaccaatttatttttaatttttctaaaaaaagaaaagaacaagaggaaaaatatcaatttatttttaatttttcaaaaaaaagagaaaagaacgagaggaaaaatgatagatgggagggcgagaaaaaaagaagaaaaagaaaaaaaagtagaagaggagggcaccgggaggagaaaaaaacgaaaaaaaaggggaaggagggagagggatcggggctgagagagaaaaaaacgaaaaaaaggaaggaaggagggagagggatcaggatgagggagagaaaaacggaggggggaaggagggagagggattggggctgagggagaaaaaaagaaaggaaggagggagagaaaaacggagggggagagggggtcggttggaaggagagaagaggaagggtgcgcgacacgagagggaggaggagggccgcgcgcgcgagtggggatcgggaggactgaggagggccacgcgcggggagggtccaaagtatagtaccattttttaccaaaacaaaaatattaccaacatatatttaatgctacatttaataaaactaatttggtgtgttagatgttaatttttttataaattgatcgaacttaaaaaagttttgatcatgaaaaaca

SEQ ID NO: 41536 - DNA, 6229 bp, Oryza sativa
catgttctaacctatagatcaattttcatgtgggtgcttggttagaacttgaaataatcccaaggttttgtagcctgttctttatataggggtttttttttttcatgctctcgtgatgcaagtatggggtgtggtttgttctctgggagacatgagacgctaataagatgattattgtacttttttaaaaaaatggctgtggaccatatgtcatatatttgttttttgggattatagttgcaatgtacctttacatgttggagatttatgtttatgttccattcttttttttcaatttgccacttctttgataagccaatcgactatttgccacttttcatctcatatgaccatgagaccatcccacactttcttctcacccctatagtatgacaaacaaatatttcttcctcctccgatacttatttacccctaaagtggactcggccctttatttgcccctaattctatatacctatacaatcaatccccactatatgtagtcaataggattttgcaaccttctcatgcttccgcatcatcctaattgttcttcgatctccatcctatgacaggcaagctgtctaggcaatactaggaatggcgagaagctcccacgtcttcatctaataggccaaatcaaagactagcccaactcatccgacctactgcctaatggatttggattggatggccagatccggccttcctcatctctgactacggcctcccctgccagctgttccctagtcatgactcctcgccaactgtcggagccgtgccgcccgctgccaaccccccatggacgcttgctgctccacctcgcgctggtcttcgtcacctccccttcccaaccttcgtcgcccctctccacgtttgatgtggacgggatgaagcgaacatgtgccttgctaccgtcgtccttggtcgccactcagttttcggtggttctctcaagcggtggcggggtggaggtaggaggaagggtgtcggcggtgctagggtgttgggcgccgctcgtgtcacccatgcgggagcgacgcgagggcctctcagtatagcgattgactaggggatgtcaatgtcccacctggtgccacttgcaccggcaaaaaacattaccactaggatcataacatttggagtgaactaaatacggagagatatcactattaccgctacgtgtgaccggactccctgtatttatagcgctttgggagttaggggcgattccaaataggatttgagcttctctgattgttcgcaacgagcgtgcgtggatggcagggtagaccgtacgtgttccccatgcgactaggttagctatcgattactacaagaagaacccaaaaaaaagttggtgaatcaatagggaagtcaactaaaaaaactcccaataaataacgattgtcccctaaagtactaaaattattttctggtaatatgttgttttgtgacctatacataagacgtaatgatataggctcatgacacaccgttcggagagaggcttgatgtttgttgttagaaacgacaaccgcatacgtcgaaagacgtggttactcaacagtggttaagaaaaagtaaagtatattgattagagaatttttcttgggatccccctattacctggccctatgggactatttatagcccctgttacatgttcttactattagggttttggttatacagggaaatttacatggttatccttatgaaagggacatttacatgggtacatagtgtaacagaggttcatggactcctgatgggccgttaggcgatcgtcggcctaatggcccctatgcttgataggccgaaaaaggcttcttcggccctcgcgggggcgagcttgctttggtgaagtcgtctcccttcagcatatactcttcgccctgcatccttcgcccaagaggcctctggcttggcagagtacccgcacgatcctccgcctctcgccgtccttgttccatagtcttcgccagggggggggggcttcgccccgactaactttggcgtctcgggcttggatccccactcctcgcatagccttcggcagattttggtcgaagggcctcataccataccgccaacaagcccctcatgggcaagggtgagattggagcttcggccgagaccgtgcaaaccatgtggtatgtggtatggtatgtggcgccccctttcgaccgatgctcctgccgaaacctacattgttcctgcaaataaagtttgttgtctgtgcggctggtattgctttgccgctcttcgcctcctgcggacggtgatatatattttttttatttttttaccgggccaaaaggaacagtaatgggccttccctttgtgggctttttactgtgcagcttggtcgataggaatctaccatttcgcctaccctcgcgacacgtggtgctttattactggtgggtaggcgaaccgtcgccttgttgggctatatatgctcccccgttatcttttcaccgctagacttgccactttcaccgcccgcgttctcttcctccgttcttgctttcacggccccccttggccctttagatttctcgctcactccccttgttcgccactgcacacacccttcgcgacttcatacgtccatcgtcatggctccccgcaagcctaacccctcttcggcgaaagggcccgaccccggccggattgacgacgacaccactgcctatttggggatttctctcatagacgacggcgagctggcaaagttggtcagctctagggcgttagtcgagggacaggctttcaccccggggaaagccgttgtaccgaaactcgtcgacaaccggacagtggtgttcgccgtgtttttttgagacggggctccggtttccgtgcaacgcgttgttgccggagattcttcgccttttccaggtggagctcccgcagttgagcccgtcggcgctggtctagattgctatctttgactgggcgtgccggactttggggtttgagccaagcgccgaactctttggcgccatattcttcaccaccgtgaattcgaagacgatgattaccccagctggaacgaagaagacagtgttcgggagcgtaaactttaatgttcgccccgagcggtccgatctctggccggtgaacgccgccatgtcgaagtggggccgccattggatggcgaggtggttttaccacactatccccttcgaggctggttctgactccgcaaaagcccttcggtgccggtgtagggcgattgagccgaaccgaaagcccaagatcgccgtggacggcgctatggaggcgcggttcgctctactgcgtaaggtctgctctcgccttagctgccgcgacttggtggaggaattttgcatgcttcacatctttcccctctcccagtcgtggcaagtcacagttgagcaaggcgaagaggttgatggtttgttgaagttggttctccatgaaagaacgaacggtaagattgctctttcacaatgcagtcctgcgctttgttattttgctttgttcgacgcttaatgtggctacaccctttatttttgtagtgttgacccttgaccaggctgacgccgaagcccgtaggatgatcggcgacgtgtcggtcgtcgagtatagccagctgctaacgcgacaagcggctggccgggcgaaccgggtttacaacggtgaattgcctccccgggcgaacccccacaaggccgacgacgatgcaggaccttcacgaaagcgaacgcgcggacaagtaaagcttgcgcccaggaagcgaagggttcctgtttcgttcgattccgacgctaacgacgaggacgacgttgaagagcgtgacggcgaggaggaaggggaggaagaggaggaggttgaggtcgtggtcgaaaaggccgcggacgaggcggtcgaaaaccgcgtcgacacccctggctatactcctactccaagcccgggtcacaatgagaccggggtggagtcgaatagctccccccttcatcgaaaggagttggatggggcgaaggcgctaattgcgttttcgacaggcaaggcggcgaagggaggtccggtcaaaaatatttccaagaagaaaggactcgtcgatgtcgctcgcgtcttcagcgacgacgagtcttctgacgagactccgacttcgcccgctgcccgcagcctagacctttcgaccgtccccgttctttcacttggcgctgatggagtaggcggtagcgccgccgccggggcttcagcctccacggaacggatcgtgacagctgcggcgagggtcttcggtagccctctgcgtcagccggttgtttcgccgctagtcaaggcgaaggggaagggtgcggccgtcgaaatatctgcttcggagtattcccttgcggcgccccatttcgcccctagcgatttcgagacccgggtagaccttattccctttgtcgagggagtaagcaatcttgtcttacctgccagcaccccgagcctattcaccgaactgaatgagttcgatgagaggtgttctgctattaaaagcttagcggttcgggtatgctttttctctattcttggttttcctcttcttttttacatgtcccataattaacatttgctctcttcgccattcctattttgcatccagattcttgcagctcactgttcgacagagcgaaccgtgcaggcttgtcttgacggatttaagaaccgtcttcgggccatggatgacgaaataggccgcaagaacttggagatggaggccctcaccaacaccctgaaagaggcgaaagccgaaaacaagcggctccaattcgagttggagaaaggaagagaggctagggccgaggtcgatcgcctcaaggccgaactggagaaagggagagaagccatagctgaggttgatcgcctccaggccgaattaaggaaagaaaaggcccattccgccgtgctgacggattattataaccttactgagccgaagatggaggctcttcgcctggaggtcagcaaggccgaagcgagcgctgtggagtcgcagcggttttcgcgggagatggtgaaaactaccgaatccgcaagaacggcgtgccaaacgcttcgcctcgcccttactgacatgggtgcaaaagtgcgaggggtccctaccgaagatgcctcggccttcgacttctccgagtggacccagcaggctggtggttcggtttcggactgcgccactacgtacggtgattgctgtgcgcgtgtatcagcggcctttactatgggtcttctgcaacagttcggctgcgagcacgtcgccgagttccctaactatgtgaagggggactgggagattagcgcgcaggacatttcgcctgcacttcgtgcgtggcggaaacaattctggcagaaggacggccggtccaccaccaaggcgcgccttttggagcaactagcgaaggcagagacggcagacctttgcgaagaagaggacgcggcggctgaagggggtggaggcgatgcccaggtgtgaggcccttcgccctttccttagatttttgtagttttccttcttctttttgtgttcgccaggagtggcgaacgatgtgtattcggcgggctgccgctaaccctccttattgtagccaaaaaaaggggcccttggatattttgaatatatatgactcactcttagccactttttgatggtcgaagtctttggcgtatttatgattacgcccatttcacattatgcaatacatttttcttttttcgcctattcttactatgcaattctccttttgccctttttgcactttctaccagggtgttcgccgaaagttgtgcattcggcccccttctgggagttggcgaaaccaaaacgagaaatttgtggcattaaaagatttgccaaaggtgcgatgcccaattcggcctatttatcgtgaaatggtgataaacggacgcagctataaggtttttaaggttgccgggtggcttcgggcgcaccctaggcgaaccttagaagactacgatcttgttcattcaagatgtttggaggacatggctcgcttttggcgaaaccatcagaagactgatcggcaggaggcgatctcccagcgtcgttacagtctagtctgtatttcgcccccttctcctcttagggttgtgtatgatattagtagtgatgacaaacctagttcgcccaatcactccttagagagagagagatcgcgggggcgaagatgtaatttatctgtaagcc

SEQ ID NO: 41537 - DNA, 5682 bp, Oryza sativa
ttttcgatccattttgttctacgttataggaagcactcgtgctttcctttcgatcgagtgtaacggtgttcagctaattgttctccgaaacaagctgttgcggtttcaatcgttcggcaagtgatgcttcggccgattcgtttcgcccccctggcctttttcgctgatcaggcgtttgccttggggtttttccgcaaattatcaatcgcacaaacaagtaaaaagaaggtagaggacacaaagattttatactagttcgggcctccgtggtggataatagccctacatccagtttttttttttgtcttttttcattttcctcttctttttttcttttttttcttttttttcttgccgaaaggcttacatagtgtcgaaggtcttacataacgatatatacatttttacaagtttggcgatttgggtgccacccgttctagacatagaaacgcttgagagaggcagcgttctaggaatggtcgaactcttcgccttccagtgtcaccagtcgaaaggatcctgtcctggatttgtgcttgatgaggtacggtccttcccacttcgattcaagcttgccaatggctatcgggttcgcctttttcctcaagacaagatgaccaggcaacagctccgtcggtcgaacttttttgttgtaagtttccgaagtgcctgtggcatacttttgcatgtgctcgagtgcttcgactcttaccccctccaagagttcgagcgacaactcgcacccctctgttgcccccaggcaacagagttagcccctagctctgttggggtcattgcctcatcgctatagagaagcatgaacgggctgaacttggttggtctcgtgggggtcgtccgaagggcccagagaacagatagcatttcctctggccatttgcccttcgctgccccctcaagccttttctttagtgcttctaggattttaccatttgtacgttcggccactccgtttgactgcgggtgcgtgactgatgcaaacctgatttccaggttaaacccttcacatatttctcttaacttgttagagtcgattgccgttgtcagtgatgaacttttttggcacactgaaacggcaaacaatgcttttccatacaaactactgtactgctgccgaagtgatcgcaccaaggggttcggcctcaatccatcgagagaagtattcaacggccacaattgtgaacttgtgcccgtttcgcgccgccgggaacggcccaataatgtccagtccccatctggcgaatggccaaattggtgcgatgggctgcaactcatactggggcgcggtttggcttcggccatgacgctggcaactttcgcacttcttgatttgctcaagacatactttcaacacagtgagccagtaaactccttgtctaaatactttggaggcaactgttcttgcggcttggtgcgcgccacatagcccctggtgtatttccttcgccatttcctcgccttcggcgaaagaaatgcagcgaagcaacggttgaagtatcccggagcgatagagctgacctgagaccatcttatacttcgtggctctgaattgcaagcgctttgcctctgcttcgtcttccggaagccagccagtttcaaggtgcttcacaaacggggttcgctagtcgtatgggtctttgctcaatttgacgtggtcgattgccaagacctccaagctgtccatgggcacgcttggtgcatacaggacctcaaaaaggatgccaggcgaatgtaggccaccacaagcggcagatttcgccagggtgtctgctttctcgttctggcctctaggtaaatgttcaaccgttatgccggtgaagcacttttccatagaccgaacggcatctaaataccttttcatcccttcttcttttgcctcaaaagacttgtcgacatagcccgccaccagcttggagtcggttcggattagcaggcgccgaatccccaatgctttcgcctttcttaggcccaaaagaatggcttcgtattctgccgcattattagttgtgtcgaactgtagccttgcagcataccgaattggcacaccatttggcgaagtgactactgccgcaccgcccgcccccttgtgcgaccacgaaccgttggagtacatcacccagggctgtttgacgagctcgggttcaggggcgaatgccggtgtccatttggccacaaagtcggctagcacttgggacttgacagcagtgcgggcaacaaaatgtaagtcaaagggggatagctctgctgcccacttgctaagctagccagtaacttctttaccccggagtatttcgcccaaagggtactgtgatggcactatgactttgtgggcctgaaagtaatgcttaagcttgcgtgaagccatcattagggcgtaagcgagcttttccatttcaatgtatcttgtcttcgctccttgcaatgcttcggagacaaaatagaccggtttttggcctaaatccgtttcttggacaagagcaacactgactgccactggcaaagctgctaggtatagtagcagttcgcttcctgatgctgggctgatcagagctagcgggctttgcaggtcttgctttagctcgtcgaacgctgcttggcattcgggagtccagttgaattttcccgcgccccggagggttttgaagaagagcaaacctctttcagctgcctttgagaggaatcgacttagtgccgcaattcggcctgcgagcttttgtacttcacgtacgctcgacggaggctttatttgctgaatggcatcgattttctcgggattcgcctcgatgcctctttcagaaacaaggaaacccaacagcttgcctgcgcgaacgccgaaaacacacttctcaggattcagtttcatacccgctgcgtgcaagttgtcgaaggtctcctgtaggtcggacgcgtggtcgaaagccttgcggctttttacgacgatgtcgtcgacataagcttccacgttttgccccaactgcttgtaaaggaccttgtacaccagcctagcaaaggttgctccggcattcctcagaccgaaaggcatcctgaggtggcaaaaggtgccaaacggtgtgatgaaggctgtcttggggatgtcggctgggttcatgcgaatctgatgatagccggaatatgcatctaggaagctcatgagttcgcagccggctgtcgaatccacgagccggtcgatccgtggcaaggggaaatcgtccttcggacatgctttgtttaagtctgtgaaatcgacacacatgcgccatttgccatttgacttccgcaccagcactgaattcgccagccactcaggatgatcgatctcttgaatgacccctgccttgagcaatttttggacttcggcttttgctgcctcctgacgatcagcggacatcttgcatagcttctgtttccttggctttgcatccggcttgactgccaggtgatgcatgatgagatctgccgaaacacctcccacttcatcagggccccaggcgaagatatcaatattcttttttagtacctctaggatgttcttagcttcttcttcgcccatgtcgccccctcccagtgatacgagttttatggggtcggcatcatcaatctgcatcttgattatcttgccgtgaggggcgggctttggcacgtgcttcgctcggtcatgcggttcggcctcaacattgtgcactgctttgttgattatggccaaatcgccttttgaagcagccgaaggatgaagccccttgatcacgatcactcctgctgggccggacatcttgagcttgagataattgtgatgggaaatgacttcgaacttgttcaaggttgcacggccgaagatggcgttgtagttgtatgggatgtcgacaacgtcaaataatacttgctcttcgcgtctgttttcccccgtgccgaaggctactatcaactgtgcttggccaagaacttgaactgcttctccgccaaatcctcggagcgatgtcggtgctggggtaagggcttgggtagtcaaccccatcttggcatatgcttcggcaaagatgacatcggtcgaacttcctccgtcgaccaggattcgccggacctcgaaaccagctatctcggctgagatcaccagaggatcttgatgcgggaacgttactccttcggcatcttctggcccaaaaaagatttgctggttcaaatactacggagcccctttcgcctgccgaagtgatattgtggatcgttcgcagctgcatcttcttctgtcgcttcgacagttggatcggcgggtcggccttgtaatcacttggatcactctgcgttgcgcatcttagcgctgttcggctgggggtgcttgttcttgagctacttcacgagttgcatcggccgctgctccctgctgcgtccttggatcttgcgcgttgccacgttgccaaatatttcggcattgctccgtggtgtgcgaagagcgtccgtggaaggcacagtagaggtcttttcggaccttctttcggacaggctgctgatggttgcttgcttgctaagcgtcgaactccttgcggagggcttgcacttcttcgacagccatcacagccttgcccgctcggtcgattctgaacttcctctaggtcatgggggcttgaccttgccttggcggttgtgcttggatcgccggctggggctggcgaacaacgagaggaggtggttcggcaacttgaacttgttgttgggcttgagcagtggtgacggaagccttatcgtactcaacttgtattgcttgccatcgcttggaatcctcttcgccccttgtgaacccgtcaatgatgcgaagtaggtgttcaagcgtctgcatctccttgttggcgatttttcttgtgagttcgtcctcgagtaaaccagctgaagtggcgtttatgactgatgcctcaattatgtcttgaacttggcacgggcttgcgagaagcgacgcatgtactcccttatcgactcccccggcctctggcgaatgccgagtagatgctgctgcgtcttcggcccctcataggtgcctcgaaagttaaggacaaagacatcgcgcaattgctcccatgagtaaatgctattggctggcaaattgaaataccaagagcgggcgatgccgtctagggcgagatgtattactgacttggtattttcgtcgccatgagccgcttcgatcgcggattcataaatggagaggaattcctttgggtcagtttcgcctgggtagcgtgggacgggtgggaacttgaattggggtgggattggacgggtcttgattcccccactcagcggtagccccttttcgccccctgccctgttcacggcaccttgctacgggtatggcgtggcgaagggcgaaatcacggcttgcgcgtgaggttgggccatagcattcggctgcccagccccgattggtgatgcttgctgtgccgccatgaatgggtcgaaagttggctgtgaccatgtcatggtgacctggtttggtgcttggtttgctccgaagcctggtgttggtgcttgcggccgaacggttggcgcctgagcagcattgatagagtcgaactacggtccttgactccacggcgaatccccagacctggctgattcgaaggcaactaacgaggcgcaccttgacttgtattcccctccgggcgggccgaaggg

SEQ ID NO: 41538 - DNA, 21076 bp, Oryza sativa
attcctgcagccctgctgttcttgcatttggcgaagcatgtcttagagtcgtgtcatgtactgtcgcatggcttccatggcggcttcggtttgtgtctcggggtcagagttgacttgggcttgcacagcggcgagcgcagttggggctgctgccggctgcgacggagcggcttggggcaccagtagttggtttgtcgaaaggatctccgccctggtctggagtgccctcgccgccgcagccgccttcgccatgtcagccgcgttcggcacctgcacagaggtagcaggggccgaaggcggtagtgatggcgcaggtgcggaagcagatggcgctcctccatcttcggcgacaggcgccgaaggctctgctccctcttcggtggccatatccgccccggcgtcgctttcctttcgccttgtaaccttctcctttacaaccttcttcggtggcattcgctctcagtggtttcgctcggaggtccccacggtcggcgccagctgttgtcgaaacgacaactgcatacgtcgaaagacatggttactcaacagtggttgagaaaaagtaaagtgtattgattagagaatttttcttgggatccccctattacctggccctatgggactatttatagcccctattacaggttcttactattagggttttggttatacaagggaatttacatggttacccttatgaaagggacttttacatgggtacatagtgtaatagaggttcatggactcctgatgggccgttaggcgatcgtcggcccaatggcccctaggcttgatgggccagaaaaggcttcttcggccctcatgggggcaagcttgctttggcgaagtcgtctcccttcggtatatactcttccccctgcatccttcgcccaagaggcctccggcttggcagagtacccgcacgatccttcgcctctcgccgtccttgttccatagtcttcgccccgactaactttggtgtctcgggcttggatccccactcctcgcatagccttcggcaaattttggtcgaagggcctcataccataccgccaacaatgttgcattataaactatatgtatttactcttgctacctgcatttttttctccttgttaaacatcgttaaacattgcgttgcaattgcatgttatatgattatatctaaatcataaattaatgtaatttataaaatacaataggaggatagatatatatggacttcttttgcgggagcctttgggcacatatatgccccatgtgtcacccaacaagttgtactacttgctcccccaaacagatatggattctctgcagtactgcatttgcagtagcggtggctgacaggtggacccggttccacatgtcagcggctgctactgcaggtgtagttctgcaaaaaatcaccactgcccccaaacagctctagcctgccaacaacaattattttttaaaccgccccttaattggtagatcttcaggaggaaatcatctaataagctgaatccaacggatccaaaccactatccatctaataatatagtgttttagattaagatgtcaagttgaagcttaaactttcaaaagggaagcggctgctttcagggagacatgaagcattactaaccacaaaattacaaacactcccccggggggagttgctagcatgagaagcttcgttttggctcaacaaaataatatgatgcctccgcaacatgtcagtatattgagtattgacccatctgattatgacatacctgctatttttcagaacccaagaaactgttctcttctttctggatagtcaaattgcacgagtcacgcgactaattgagtgccggccttcactgatgtgttgaatattgttcagtttgtcaccagtgaaccgtcatcttcttaacatggacaccgaggtctgcaccagtaacatcaggtggggaattgagacgattttaagaatgattcatatgcaagcattaccttagttgttaaggataatacaattttgatatgcatggagttgtttgatttaatttcatgtcactgtcgatcaatctgagcaccaatataatattgtttcagtagcaaattgtgccaatttcatgtcactgtcaatttgagtatcaattttgatactcaccggactaccagagggtgataagttagccagtgaatttgaattctagcacagtattgctttgctgatgcaagcaatgacaaactggtcagggattttcttcagcacacgaaacataatacttcctccgtttcatattataagactttctagcattgcccacattcatatatatgttaatgaatctagacatatatatgctagaaagtcttataacctgaaacggagggagggagtatggtataaaacccagatagaagtcaggtcatccagtccaagacttggactgctagagctcaaatttcagggttgacaggaaatttgttgtatggccagttgaccacgagatctcaagaacagaccaaacccaaaccatagctaaagggcgtagatcatcattctcttctttaggacaggtttgcgtgaaaaacaaaccaacatagaaacagtaagatttggaacaacactttagagtaaatttcacaaaactacacttccaatgtgaaagctaagaaagaactacactatcagctaaccctttacaaaattacacttcagttgctttgttccaaaaaatgtaaatggtttccaacgaaaagcgtagttatgtttaactgcttagaagtgtattatttgatagttgccttagaagggtaatttggtgaaaattattcttctatagttgagagtaactcatggtagatcaggtgactgattttacatcgtcttgttgaatcttaaaagacaacagtataacatggcagaaagctaacttatttgcttagccaattggctttcaacatcaggttcactagcaatgcatgtatcagatacttagtttgtagattgcagaaaattcagcgtataatgaactttagctttcagaaaacttgctctatttgtgcttttgcagtcacatgatttccccatttacattcaatgatgcaatctaggaacaagtatatccatcttaccttgttcaaagatctataacaaccaactaggagcttattttggacccaagtacatatgtagctccaatgttaagaggcttttctttttgtctgaaaagggaattagatgctagtcagttagtaataaaaaacattgttgggcaatagatatgcatactcaccttcattgcacagtagcaccggcagcacaccactgcgaagataaattgataactgatagcttaattatacaattggtaatctggtagaatagtggagttgcagtgaaatatataattagcatccatctgttctaggaaaaatttctgacacccataatcatgcacatttacaacaaaatcttaacccaaaatttgacaatacagatgtgttagtttatcttgaggctattaccctgtgttaaaaaataaacctagagcctgcaggttacaactagttcttctaaataccaactccagttaagagcagcagttcccataaatggtgcttcaagaaaaatcaccagatgtctgtaggtttttccctctattgaaaattacatgcctctgcattttctttgttcactccacatataaaagctcactctctgatgaatcctctgtatgtatggaatcaggaagtgtacggtattccttctctgtgacgaatctcactccaaactgttcactggttggatctgctctttctctgggaaggaaccctcgttctcgtgcaagtaaccactggtcaatgacaccacatgtaatagcatgtttcattgcagtatgcaagtaatccttgtcagtgaccaggtgagggttaattgccagcatcttcatcagagctgaagaacacattaaaatgtcatcagagctagttcaagatacacaaacaaaataaacatgaacacaaaatgaagtgtcactaaattattatcatgctggcatctgatgatataagctataaaaggctgaagctgtaatttttttaaaaaaaaaaacttgtatacagtgtttgaaagaacggatttgctatactagtgtcgacagttaacaggggtgaaaactttcaaattttaagccatctaatatgctttgagatttgtgctggtgaaggaaaacgggaaaaaaaaatcagacgcgtgcagcagggatctaacccaacacctccaacttggatgtttgttcaactaaccagctgctccatcatgcttttttgagttacactcgatttacatatcagttacatattagttacatagtagttataatgcaattatatagtagttacatttgaaagtttttcatcccaaaaactgtcgacagttctatagctactcccaagaaagaatttgtatgttcctgctttatgaaagtagaacacatatgtaatgatgcatttgctatcctttggtgtcattaatgaaaatggcatatcctgcagaagtagaaaaaaaaaagaacatcagatgcagtacctgcaacaatggcgtcacctgattgtgacatgtcaccggtgaaaggagtaattggtgcatcttctgtgccacgaacccagccatcatgctcttttgtgtaataatgaatcttagaagtgccgtttgtcacaaaaaggaccttgagattttcatgccacaatttcgtaacaacttctgggctgtagtgagtgaatttggatttatcattatccttcgtaccaaatttctcagatggtttaatgccacacaagaactcaagttcctgcttagtgatttcaataatatcagcagcttcccatgcttccttgacaagtgacttggtctccttactggacgaccataatggcagtggaagattgagatcaaagaatgttacaccaccaaatttcttggaaacctcaattgctttcgacaatgatgatcgtgtcgtgggctcaagcaaagctgaagaattgtagtaaaacatcttagcctgcattaacaaacagaaacaactgatttttacataagatataacacataagtggacagtattttcttcagggattgtagatatctttgatttacctaatttcagatatggcctgcccatagggacctaatattttaagtagttgctttttaatgttcatattattttgagtttgggaattttcagacattcagcattagcaaagatattatccaacaagttccagtacagagcagcttgtagtgccctaactgctaaaaggttttttacaaaaaattaagatcattatggtacaggtttatgtgtcttctgactaaaaaataaccatgctaagtgcaaacatgtagaaaaagcacagttgtgaactgaaagtgttttatttacttctttttctgaacctaccaaagcacggcaatgaaaacaggtaaacctcccatttgtttatagtacatagtatcattttgacacattcatggtcaactaatagatagcaagtttgaattgatagaaatcgagttgagtaatttcctcttattatctttttggacaagtacattaatttagcagtatagccctagttgttccttaagtcttttgatataaatataatgacttctgtattgcaaacaatgttgcaactgaattatgaattgcacatctaaacagtataatatgccatcagctgaaagcaacttcttcactttagcaagctcttcttgtgataaagaaaaatagaatctttctaactgtataaggaacagaattattcaacaaaatttgcttttatgtggtaaaatttccataccagattaattataactaacaaaacaatgtgtgacatacaaatcttctgatccgtgtagtactctttcattaactaatcatctctgacaaaagaaaatgcaccacaacataatgataggtcagcatagtaaaataactttaccatgtgaacatttaaacaatttattgttgccacaatgtgcatggcacaaacaaacttttctcaagaccaatcaagtgtgcatacagtttatcattaaaccatgtagtaatagataatattgtagaggataaggtgtaatcaaaatattgtttgatgtactcgtctttacctcttttaaaacagctgggttgatatcagtttggacaaaacaatcctctgcacaaggtttagcacagctcattttcaagctacccctacctgtgaccttcatcaaggacatggcagtaaacgctgaagggtccattttaattgcccgagtttgaactccattgacgttcaagtgatataatgtactttgaccataatcatcatcgcctagttttcccatgaattcaacccggccaccagaagctgctaaagcaagagcaacattggatgatgatcctcctggtgcccttacaaattgatctggagaccagaacatgtctttcattccctcatgaatttcatgatctatcagcctattagcaggtcttccagaaggaataaatgagtacttagcaggcccaaagcagcacacaagagggattaaattgttaatatcattatcatcagtatcttctaatagcaatgctgctattttactttctaggtcatttgctgaaattttctcctgcctgtcattggagggcactagatcttcacccagatcttccccttcattgtcactcaattcctctacagtcttaacttttcttctgcccctcttctttggttcttttgctttgtccttctcttccgatgagcttgcagtagttgcagctgcaacataggagagaagtcatgacttgctaagggtttacgataatttttttcttaagttattgaaggaagtactctactgaaaatatgcaagcaagatgtacctttcttgcggcccctcctttttattttcttagtcccttcaggggattcatcttcttcagtgctcacttgaccttcttgtgtttccccttctgatgcttgtatggtggctttctttcttccacgtctcggagctcttttcttggtttttgatgtctcgccgtcactctcatcatcacttgaaccttctgctacatcttgagagctcttctttgccatggaacttacgtttcggttgagcagcctcattttagctttaggcttagtcataatgtttcccaagaagtggggcttataatgtaaatggctcctgcacattacacatcggaagcaagtcactaataactgttggaatttaaaccataatgtaagtagtgatgtgttaaaaaataaagaataagtgaatgtaagatagaactaatgttatcacacgattcaaatatgaagctgctaccataccacgtgggagcatattcagacaaggctaggtacaagcggtatatatatatatttcatcgagtacacatcacaatttgatgacatattgttcatcttgtaagaatcaaatagttgttatcaaaaaatgaaacaaaacatagacccaagatctattggaaatttgggaccaaagaaagatgccacaatctccactccatgtgctgctcctttcccttccctaacctaggatccatatggtggcgactcaaacaatccgaaagagatcgccacacgcactcatatcagctactaccagaagaagaagaagaagaagctgcattacacagaaaaatgaagcattacatacctgattgagttggtactacaaggcagggagcaaagaaactgcggggggagaagaagagaagccattcggtgcatcaatggagaggagaggattcctacaagaatcctcgcctacgcctcttccgcctcccgggagaagaaaatccctcaaacgaagaagctcagagctgagcagaggagcaaaaaccccaggggagaggggagaagaagattgattgctgctgcaaactaaaattacatacatgcccttccatctatctcaagataaggggcagaagcgtaataaataatcgcatggtagaacacgtacttggggaatacgcttcatccatgggtttacgaacagataataatacgctagcactctcctctcctctcctcttcttcccccgggagactccgccgccgtttatcgcctcggcggcgcggaatcctctctcttggttcgcaaatggcagccgcacggggtagcttatagggatcttcttgggagttaccctggttgactggtccgctcattcatcgaatcaacgcatcctgcgccgtcgcctcgcctgttcttcaatttgccgccggcgccggcttcggcttggccatggtgctccggcctcacgggagttcttgctgaatgtttatcatggtatattaattgtttcttttgtgtgacaatgtgggaatctagtattctagtcgagtcctactgccgttctttgcaaccttctccagtttgtggcaatgcgttgcggcgctgtcagcgctatgcatgtttgtggtgatttgtggttcttctccgtttcacattataagttgttttatttaggtttgatcaaatttatagaaaaatttagcaacatctacaatactaaattagtttcattaaatatattttgataatacgtttgttttctattcaaaatgttgctgtattttttagaaattaggtcaaaattaaaaaaaaagattgattaggaaaaaaagtcaaaatgacttataatataaaacaaggtcgtaatggactgttaaaattgctggtttccatagcactttgcacgtcatatgtaccagtaattgttattcattcagccattgttccttctcatttgctccgcaacacatagtctgtcaagatagaaaaataatactataaatctacttattcagataagcttgattttttttttttgaggattggaacaaaataattggttgattccgtattgtactgtcttttttacttctattgtgttcttttatttctgccacgtcacacatttagtttctaaacacccattgctcttccattccggctatcagcttaaggactgttttatgttgtaaaacagtaaaagtactgttcctttggtagattagccctaaaggaagctgtttgttcagataccaattgagaaccttttcttctgtaatatctgcctaaaaggttgacttgtcatgaaatcttcttatattccgtaatatttctgtatttttttctcatgtctgaggttgcctgatactttgcaggcaatgtagagctgttcagcaacatttttttttttctggacaaaaatcaaaaccccaaaagggcattccaaccatttagctaagcatgatatatcctatggtatcgtgtactaaatcccatgttctctatcaaggatagagttaaacggctaattcctgctgcccaatgctactacttgaaaggaaaaatgctcagcatttttgcaacagtgttccctcatgtttctttaataaggtgctgctgtacccatgtcagcctgtttgttgactcacagaaatgcacaaacaaatttctcaaggtactgttctttttcaggaatcaggataatcatccaagacaagatcccaagagcaagcggttgtcatagctttagggagcaatgtaggtcacagaatcagtaactttatacatccctacagctcatgagagattcatgcattatcattacaccacatgcctgcttgtataaaactgcacttgcatgtgtcactgatgaaccattgtttcaaaactccgttgttaagagggacaataaagcttggaccacatgaattactcaggaagctgctaagatatgggccacattaaacaaagcttgagacagcaaagaaattgagaaggagttgggccactgatggaataagatatagtcctgggccaattgatttggatattattttctatggtaagcaccagataaagaaatggtgaaagaatagttcactttgtgctcaacatcacagttgcatatggttagcgctagacaaactctgaagttttgatagacatgagaggctattgttatggctctggtgatgagtcttccaagtttgaatactgaaactgatattggtgcaagttggcatccactctcaaaatgcagagatgtcttcgaactcttggagaatcttggacgacagcccttgattaaaaggcaaatactaagacggggttgcccatcggtagtgcgttgtttgattggcaaagagaagtttcatagcctcatgggtatacttaatatgaacctgatagttcaagtgatcgagcgaagtttcaagaagtagacgatgctattctcaggtcaagttgctattatgtgatgatgccccttgcatagtaatacatctgagagaggatccctccacaatacatgttatcaaattttgaattaaggagatgtttgcaagcaggtggccatggaacgatactcaagggtgtaatggcacagaaatgacacacctccctttgtggagaatgattgttgacaccggaattggtttctcaaaaggttctgaatgtttctcaaaagatgagtaaaagaagcatcggtgcttcacaagtgccaatgttagttgaatgaccatccatgaaaatatttctaggtgaaatatgtgaccacaccgatcccatcgaaagaatttcagctcatgctgcctcatctgcaacattggttggtcaacataatcaaagtgcacaatgccagatttggtgttggttctgcaaaaatatgtgacacgttgctaaagcagagtaaaactttggactttctaataacaagattaagcataagatcttttgaatttttcatgaaatccagaatataatccaaatcaattcaagtgtaggagttcatgtcactaagagactaaataaaaatgaggtgatcttgagctatcctctgcaatcgagctttaccctgctattttgattggcattcttctaaattgaattcaatgtgctgtctacctgctcaacatataaacatattcaacaacaaaattaaatacatgtgtttgtatttcttttagctttttctacagatccattattgtactctcttatgttagcattccttgtgttccttagatttgctctgtttgagtgaacttttgccttaaatctcaccaaaatactaatcacccattcctgcttggatgaaaattattccatattgctagatatgaactctgcactcttttacttctgcccatgtgtaatggtgtatgtcttgctccgtgcacaatgtcagtccagtcagtgattcccaaatccaatagtctggggaatatgcaatgcatctgcgaagtcttgtacttgtttcatcacatgggatgccatcatggcagtgtgccagtgtgtgtacatcatctgagaactgagatagtagagaggaaagtgagagaggcacatgtacttggcatatgctttcttctgttcaaccatgtaccagttcttgagtacagtgtcacgcttgttcatgcaacgtgtgtctgtctctacctgtagctacttctgatcatttatgttgtgttgcaaagatatgtactgccagaaactctattctgtcagtgcactacagagtggagtgtagcaatatgcatgtggctttgttgctgcatctccgtcaatctgtgcatacatgactgctgtaatcagtattttttttttctctttagttgttttcttgtgaatgtgaaagcatctatctaatccaggcattgcagttggcaatttattgaggtttgcaaaacaatgtttttgagttatatttcagttggagttacacctgttggtttcagaaccgtgcattgattctggacactgcacttcaggtggaagagtatgttatatacattatgctcacttggtcttacaagctttattacattaacttattgtagtagtaattaaagtgcaaaactgtttcaaatagatatagttgatagctcatgtcccatggaagtttatttccattttcaggtttattttttcattgtgacaattgagcataatgaacttcaagggcttattaatcttgccacaaaataacttgacaggctacttttattccaatatacaactcacctgagctgtgtagtcttattttagacatttcatggtgataaagaacgccattgatctgaattgggggtatcttccagaataaagggtgtttttttttaaaacgaagaagaaaagctataacagcaccacaaaaaagatgttttggtagtaatgtttatgaaaaatgtgacttagcagaactactagtttggaattggtactacaagttaacagaactgcattgtgttttttgtatcatttcattctttacttgaataccttgcatgccttacctagggttttggtagtccttcatttagaggggaatttcagtccttgagaaaatttgcctgtagcaatctggaaatgttgtccacttgtccctttgtataatctttggtatgatgaattatataatttataaatggtgtgggctggcacctctgtgtttacacaatgtagtttcgtgtcctatgaatagcagcaacagccaacagtgacacttctggatttcaacaactgttaacatctcctgtactagcaatcaatactgcttttcagtatgttgaggtgaggcaagttcttttcccgacatcaatatattgtccaaccaattgaagcatcccctgttcattaacatgagttccttggtatctatagggaaaactgagagccaccattgaagcagtttacttgctttagcctgttcattgaggtacacctttactgttcctctatcagtatttcctcttttacatatttcatatttctttcagttagtggacatgagaagagaaatttgaagtcttcatccctgtttctatgagaactcgtgtatcttgtcaagtcttcatccatgtgttctgttcttatggacagctggtgtctattaactctctatcatgttcagaagcatagaagccaaatgacacttctgttttagttcaacaattgatggaccaaaagaatacaggagcatctgatggcaatctacattagcttcctaatggtcctataatgcctatattatctctataatattcctattttcatggacatatgttacaagagccaaacggctgttctaatcctgtcatcagggcagcagcatcagaattgcactcttattttctatctgatttgaattcctatctaacttcgcaaaatgttccaggatcagtaatcttgaacgcggatatgtaacccgttgggagcttcaactcgggggaacttcaatattgtgttgttaccttcttcctcccatctgcaaagaaaagattaacaccatgtcttctttgtcagtaaagaaccagacatattctaagcaacagaggatttgacaagatgaacaaacctgtattgagtcacgaaatagtgaaggaatgttgcaatttctacggtgcctacttccttccccgggcacattcgactacctcctccaaacagcatgaagtgtggatgtgattccatgttcttctcctgttatcagtaagtattacgtggttagaaacttacaattcaatcaatagtggtgttattggtgtgctagtggaaattacttgattgctgttttacttaccagccacctccatggattgaatgtcatgggatcagggtacaggaatggatcataatttatttcccttgtgtaaacatatattctccaaccttttgggataacataccctggaagaaacaaataagcactgcattagggctatccaaagatttatcaaaaagatgctaattgcagcagcgtatatatcatgcatatctcaccattcatttcaacatcttgggtagttttcctcagcagcccattcacaactgtagctaatcttaatgtctcgaagataacctgcatagtaaaagtgcccatgagttcatcatgatcagactacactgttactgtggctgctttctgagtttatcatcatcaaacttacagctcgagtgaaggtcatggacttgaaatcattccagtcgatggcatcttcgggcgctttacctttcctgatatcaaaatgttctttctgcagaagtgaacagatcatcagtaaactcgaagtgtgaaatggttttcatcatgggattcaagtggtttgttttcagattatctataccctgagttgctcaagagctttgggatggtctgacaggtacttgacagccatcatcgaggtcgtcgacatggtttcatatccagagtatataagggtgatgatcaggtcaatgatctgctcatctgtgagcttctccctggtgccctcgacaccggtcaagagcgcatccagcatgtcgtcgtgtacctgaccggaggatcgccgttccgcgatcatctgctctagcattgcaacaagcttcttccttgcctgaaaaaaaaaagagtgccttgttagagtagttcttcagtgcatgagttttaactgaattaccatatcagtacaattctgcagtcagctaaccttgaagccttggtagtagttggttccaggaaggttgatgggcagggagatggtgccaagcacaagggtgtagagctctgccttgagagcgtcagagagtgggccagcggagacgccggcaatctgcctgagtgcagatagcaaggccatctgaaagtgaaacattggtgtgagctgccatgcaagtatgaaattcagcatgccaaccaaaagcaaaccaggtactcatacaatgctactgctactttaaaaaaaaaaaaaacaagttccttaggcatttgagacatgtgatggccataattatggatagatttcactttggaatgaatatgtactacttagtactaagagagtgagagagatgctgtgtctggtagagtgtcttttatttctggctgaggaaagagctcatgatagatcaatctctttcttttgttatccagcagtacaagtgttctagaaaagctagagattccccttttttgggggtccagagaggaaagggggatcttccttctcccctcctttcctcttcctttgctccattccccattttgcaagaggcaccatcattctgtctgctgccattgtactatcagcagtagagtgcggtaaagaaaggtcaaaaaggtaattactgtgtgcttcctactgctgctggctgctagtggtgccacccattctttgttgccaacttgcagcatcagtggaaccacagtacagtactagtgctaactaatgtcaacagttgagattttcttaatgcagggtagtactcgtagtagagaccaagattttcttacggtgggccccacacaaattaccaccctccccaataatttactactcattactgctactaataaccagacagatcgtaatgcctgatactgctactgttgttgttgtttcagaaagcaagaaaagaaaagaagacgatgatatccatgcaaggagaaggagaagtagaagtagaagcagagagagtacctccttggtcttggcctggatgtcgacgacggcggaggaggaggaggaggaccaggcggcgaggtgggagcgcatgaaggcgtcgatcttggggaggagggaggagcggatcatggcggggcggacgagggagagcatggcgccgcgcatggcgcggtggagggggccctgcacggcggcgatgttgttccgccccaggatgtccagcatcgactgcgggtagcccgggacgaacccgcgcccttcgctggccagcgcccgccggttcagctccgcctccatacacaccaccgtcgggcaccccaggatgtgcgtcctgaacacgctcccgtacctgcaaaatctttcgcttttagtactactgctactattgctgctactgctagtggtattagtgtttgattagttttctcgttgataataaaaggaaatggaggaatgaatgattgtgatggatgaatgctgctgctagtagtacagattctgcaacaaggagaagaaaaacaaatgcttggtttgtgctgtggatgttctcttttagttgatcattgaagggagaaaagtttaggagggggccaagtggggatggatgtaattaaaaaaaatcgctccttttttttccttgggatgaaaaaaaatcatatcttttgtgtaagagtgttagtgtgtgtgtgtgttatgagggtgggcactttttggtggactggaagggagagaggatctcccagctggaacagtgatgagtgtgagcttttgggggacacagctccgaggtccctcccttcctccagatcacctcctctctctctctctctctctctctctctctctctctctctccccacatcttcatcatcatcaccatcatcaaagcagcagcactgcagcagctccttcttcctctgcctctccccccatggccaaagcttcaagcttgctattgcagagcagagagcagagcatatgatggatagatagatatacacacgcatgatgcagagattgcaggggaaggaatgtatggcgcgtcaggtagcatgtcaaaagaagcagttagttgttgtgttgctttggtttggtgcttgtttcatagtggagtaatatagcatatacctgagcctccgggccttcatgaaactgggtccctgcttgaggaactcggtggtctcgccgaagagcggccaccccattgtccccggcggcaggccgcgcttccggctgtaccgcacctcgttccaccgcagcagcaggctgctcaccaccaccgccgccgccacaaccaccccaatcgccaccaacaccatcttcttcttcctcctctcttggctactctctgagtattctctatatgtataaatatattttatctatagatgtatgtgtgaatcttcttctcttcttcttcttcttccttctgtatgaggttgtgaatgagtgacctctccctcctctgctcccctgctctgctgaagcagaggaagaaggaagctgtggtgggttgcttcaagctgcttgcttgtgctggaagaggagaagcccctccctccccctttatataggcgagccagccagccaccaccacccccagcacaagaattattgcctgtgcctttttcttcttcttttttttaatttacttctcccctctcctaactttggcagtgtttaagttaccttcaaacttccaaaaattccatcacatcaaatatttagacatattcatggagtattaaatatgaaaaaaaaaatcaattgtacagtttgcatgtaaattacgagacgaatcttttaagcttaattacatcatgatttgacaatgagacgctacattaaatatttgctaatgacagattaattagacttaataaattcgtattgcagtttacaggcggaatctgtaatttattttgttattagtctacgtttaatacttcaaatgtgtatccgtatacttaaaaagattttggcacacgaacggcctttttttgaaaaattactgcttctactctctttttttatatgttgtactttaacctatctaaaggagaatatactatgtattgctattaataaacctatttactactctcttcgttacaaaacataaacacttttagattctttaatagagcaaaaaaaaagaccttgatacctcatattaaatgtgagatggttaatgtgagagagtcgtttggattaagatgaaaagaattaaatgaaagatgattgataagacaaataatattgtgtagtatctttcctgaaataatttatctttagctattgaagcccaaattaagatgattgaaaaactatggtttctgatgagatcaaggaacgaggtttctcatcaaggaacggggttgagaaacgttgtatgcttttttgcgtgaagtttttaaaaagtctggatgaaaatgttctttcgttctccggacgtggtggacgttcccgggccaggaacgctgccttgaacctgtgctcctgtgattatgatcaaaatgcatcttatacttggtaagaagtattaaaaaataaaatttgtttatgacgaattataaagattaaaaataaatttattttgagacagggctacttcctttgttaaaagcaagtttatttttaacttctttcatttattataaaataagtttcttttaaagaatcattacatcaatatttatgaaagtaataaatgtattagaagtaattaaagtaggcaagagatttgatagagtaataacgaatgagatgggtgaaaaataaatttactatacgagagtagcatttatatagaaaaaatatgtattttcatgttctgattaagggtccacattccaaggcaaggccttgactatgggtatgtgtcgagacaatggtcagatgccttgcagctgcaccgaggaaaattagttttttcaaacaataaagaaaaggggaattgaattctagggtgttagataggcataggtatggatggcaacggggcggggcggaccgggttgggctggaacgctccagaccccgacccccaacttcactcctgccctgatcatggatgcgggtcaaaaacaacgctcgtccctgacccctccggggccccacaacctgaccagagccccgtattagattctattgttatgttatgtgctatgtactaccaaatctattaaatatacacgagaaaattgcgggcacagtttcattcacaaggcacagttggaatcttggagatgtagcaatacctctcactatctgtgaatcgccacctgtgcataggtgaagctcgtcgtgaatcgccggccgccgccgcgcccgtgcctgtgcgctgcaacctcacgcggccgcgcctgttccctcgccatacccttgtttgtctcgccggctgccgcaacctcgctgtccgcgcctgttccctcgccgtgcccttgcctgtctcgcctccccgccgtgccctgtgcgccgccgccaccccttgctgactccggagggagaggtagagctgtggaggggacgggattcgtgaggccggatgccgaaggggagactggagaggaggggaggggagatggtggccagcgacagcgagatccagtgcgccctgttgcgtcgtcgcctgtgtgtctcacaggaggggaggcgcctgtgtgtctcacgggaggggaggggatatgggaagaaactgagagagagataaggcagaggctagggtttagtagctttttatggtgggttgggctttttgggccttctatgcgctatattttgagggtttatatacatccccatgcccccgagggtcaccgtcggtaaaatgtctcccccgtcccctgctcgcccaaatgcggggccctatccctgacacccctgcgggtcgaaaatcacacccgcccccacccccgcccaggccctgtttggggagcttctagctgcagcagcttctcccagaatcaaaaactccccccaaacagtttagcttttggtctagattctgagaagttgtagttgtagaatccagaaaatgaactagaagccagaagctgggaaacccagcttttctagattcttataagatggctaccaaccagctgcttttcagaatcttaagctccccaaaacaggcccataggtttgcttggagaagttttggatactcaaagcatgtacaataacagactataagttaactataagcatatgtgtaggagataagagaggagagaagagaagtgggctatagatttgtagccagttgcagcacggactctaaaatattgtgtgtatatgacatgtaagaccaattattaataatgtagcatatatttgaagttaaccattgtataaattagctattagattgactatagatgatttggagctagtagttagctatactattaaacttgctctaaacaagcatctaataagaattaaaaaaggctagaagattcggtttttgacttctaatttatctttgagctctacactacggtttaacaaaatttgattgaaaagctcaaatgtttatatgaaacttctgatttgggataaactgtagctatcataagcttcataaatactccctacatctacttttgatagtcatatttcatcttgacacatagaccaagaataagtaattctacttatcatccatttaaacatgctactagtcattcctcgtaaacaagcgattcattaatatttatatttttaatgcccatgtagccagtcatgtgtggaagaatggagagtcacgcattaaatccgagaaagttattaagatgataggttgttggattgaaatatacttatcaaaaataaatttttcagatttgaaaatatgactatcaaaagtagatggagtgagtacaaatgtagagagaagcattactacggacagggttcatcaaatcttttcgcatagggttatcatgatggttatccacatggtttatgtggcttttaaaaactgagaagattaacaggttggtaaacctagccacgagattcacatcctctgtcataatagcgctatcattatgaacactgacttatagggcaataaaagaataaaacccacatacagatgatcataagagcaggtacaatagcagactattagccagctataaacatattttaatgagataaaagatgagatagaagagcagcaggctacagatttatagccagctgcagcacggactccaagacgtaatgtgtgtatgacaggtgggaccatatattaatagtatagtaagcaactattgtatgaattggctattaaatcggctatagatgaattggagctactagtgggctactccctctatcccataatataagggatttttatattttgcttgcactgtttgaccacttctcttattcaaaaaatttgtgcatataaaaaacaaaaaattgtgcttaaagtactttgaataataaagtaagtcaaaaaaaataattccaaaattttgttaaataagaccaatggtcaaacaatgcaaacaaaatgtcaaaatcccttatattactc

SEQ ID NO: 41539 - DNA, 2804 bp, Oryza sativa
  unsure (1)..(2804): unsure at all n locations
atccctccaaaatctcttatattgtgggacgaaggaagtattaaacttgctctaagagcaggtacaatagcaggctataaaccaactataaacacatttcgagaagataaaagagaagagagaaggacagcgggctatagatttatagccagctgcagcatggactctagggtgcatgaatgtatgataggtgggaccagatattaattatgtagtatatgtttataggtaactattgtatgagttgactattaagttgactatagatgatttagagccaataatggttatgacattagagaagttacaatagcaggtacaatagcaggctattagccagctgtaaacatattttaatgagataaaagatgagagagaagaacaacgggctatagatctgcaactagctacagtgttgactccaagaagcgatgtctgtttgacatgtaggaccatatattaatagtatagtaagcaactattaaatgaattggctataaataaattggagctaatagtaggctatactattaaacttgctcttatggtagagaatcgttggtatttcgtacaccacctacataggcagcaggggtagcactggcctatccactggagtagtagtcggcgcggcgcggcgcggcgcggcgcatgcttggcctcgggagccgcgccgctgcgactgcgaccgcgactgcgtggtggtgggatggcaccgcgcgcaccggtcaaaaggaataaaacgcgcgcaagagagacagagatgccaccaccaccaccaccgtgcgtgcgtagaatagctgcctacaggtggcgcgtctggcatggccatgtgtgccgccctgcgccgcgcgcacgctcgcttggacgcatccccgtccacgcacaccacacacacccacccacccagccgccgcgtgcgtgcgtatgggcgtgcaggcgtgcagcctccttctgctgaaatttcttctgtactctactgtactgtactactcctgcgctgcgacgcacggcacggtggtgtggtggtgcatggggatgggacgacggatcgaggagcacacacacgagcacaacactgcacacggcttcagaccagtgggagcaaatcatggacgccggctgggaggactggggtcgtctggggatggccaaccttgcagacttgcacgtgcaccctgcaatttataatggccttcgtttataacaaaaggcacgacattaatttgcacatattaatgtgtgttcgtggtttattaaaatatatactaatataaggcatatcttcagtttcaaccagcactatagaacttgaattttagagaatgatctgtcgtattaatttctgctaatatttatagttattataatatattctacggtggactcaactaataatattttatagtgatcgacctatccaggagctgtctctctgatcgatcactaactatattttgaacttctagcagaggcaatcactagaagatttagcaagtattggatggctactatatgtgacaagattctcttaatttgccattggctagggcctattaggttcatcttcttgccaattttttcctccaatcattgatggatgttgcgtttctaaactttgacgtaccacatttgcacaaagtttggtaggaaaaatctagcaacaagtacaaatcaagccgcttagtagtctaaaaaaaagttaaggcttttggttctagttaatttgcgtactccaccattggaacatcacaaattttattggaagagatcacatttaatttgctcttggctttctctagctcgtttttcttttcctcaacgaaagatgttgttgtgtccttgatcttgaatgttgatttgtttgtgagtgggtcgatccaatcaatcatgaggtccgggatgtaaaataaagaaactgaaaagaggaattgcatgagtgcattggtgtcgatgaccggcgccatgtgcgcgatacatggtagtgtctagctactgattgatcatgcacagtgctcaatgagattttataggtggatgggttgatttcattataagtggagtaaacctatcaatgtctacatggtaccactagttattactttcccccatttaactataaggctcaagacattttttacagatttataaaatgtatgtaagattatattgtagaaaaggcaccacagacattttgaaagatcaaaatattatatttacatatgcatctttttaaatcaaacaaaactatgccaaatcaaacagcacattatattagaaaaaaataatggatgaggtaaatttatcaaaggataagtaaacaaaacatggaaagagaaggttgcattgccattgaggtggcacatggggtggttcccattggaggaccaggatggggcgtgcttgcatctgcacatacaggagtgtatacatcatccggggcgccatctacgattaaactgttatgtatacttaagagtgaaatttgaataaaccgttaaacattaaacctagcttggttagttattgattagcaatggtatgggttgggcattttatgccataaaatgaatacaattgatttttgcatggtttcgaacagaccttattcagcatacctccgcaacatggtgaaactcgtgccaagcaacactatcactactgataaaaatatattgccatacaatattgacaaaataattttaaaataatatattgttgacggtcaatatnnnnnnnnnnnnnnnnnnnnnnnnnnnnnnnnnnnnnnnnnnnnnnnnnnnnnnnnnnnnnnnnnnnnnnnn

SEQ ID NO: 41540 - DNA, 809 bp, Oryza sativa
ccgccaccaccgccgcataccctgccggcccgggccaccacccccgccgcctctgctgctcatgctcgccttcgcgctcggccgcgccccaatcataccggcggcacctctatcccaccgccgcgaacccaggccgcgccgccatcgagggggggagtggcagcgccaaaattgcgggggaattcgagcaccggtggtcgaaatcgggatggaaatctagggtttaggggttgaccgttggggaatcgggcacgcggaggcggcggagctcggaattcggagagaaatccaaaccccaagctggcgaaatggggagagggagacgacttgagttgactacactagcgagagagcgaggaggacacaagcagcagcggagagagagagagaggcgtgtcggctgaatgcggaatgcctcaacacaggaagatttcggccatcttccgacggcggggaatgaacggccaggattttccattctcgattcaggagctttgtcactcgatgggtggattatcgggtgcttctatggtctatacaaaacaaagtcaacatggaaggcatccacaatggttatttataggctctctacaagagatccatgtcagcatatttttctacttggaaggtattaaatgaagagagagagcaaagctatctactaacttatagatagtctatagagaaaaacgaggcaatgcatgagagagctatagataccaatgtagacatactattgaagtggtttactattaatcgagtctattgctgagatgtacatgttttatagagagcaccttagagcaccc

SEQ ID NO: 41541 - DNA, 1849 bp, Oryza sativa
ctgcacccctgatgctatactctttcgaagacaataaacacaagtgtatatcatagcatacaggtagaccaatcgtcttgtttaagagggcagctacaaaatagcatcccgttacaacgggatagacatgctaactattctcttacacgagtattacatgtatcaggttctaggtattataggtatatcataggtatcgggtaccatatagctggtaccacagcatgcatcaagtatcaggtaccgtctcatagaaaggtatcccgtttcaacgggataccgttgtctaggttttctacttatttaaaaaaacaactaagcgagatattgaggtgtgattttattagaatgctaaatttggtagtaaaatgagcatataaacaatagacaattggataatggttttaccgttgtagttagacttgtccaggcttcacaaaatttctagctccactattgctcatatataccatacacgatactataggtaccatgttgatgtcataaattgtaccgacatgatacacatgtccgatactagatctggtatcttacgatatcatgctactatcattttagcattaactgttacgttagaacggtataccgttttgtaatatgtagatgtagtacatacataattaactgttacatttgtatgggcctaattagacccagtgtgatctatcagaaggcccggcccggttacaagcccgagcatttcttgcttgcgagtggagttgaacggaccgcaccggcgtcagctcacgaggcaggaaagaaaccccaaacccgcgtcgccgacgccgtcgccggcacactcgccttcgcctcgcccaccaccaaaccacctccgatggcgcccggctcctcctccacctcctccccgggaggaaaagccgccgcggtgggcggcgaggcggggaaggagggcggagccgtgccctcgcccgcggcagctgcctccgaccacgctccggtggcgcccgacggctcgccgggaggtggcgcgctgccggcgggcggcgaagcggggaaggaggacgagggcgtcgcctcgaccggctcccgcactccgctggcccctggctcctcctcgggagaaggcgcgctcggggaatgcggcgaggcgaggaacgacgacgaagcgccagcgccagcgccacggctcatcgcctcgcccaccgccgccgccgccgccgccgccaccactgactacccacatgaaggcggcgaggcggagcaggagggcggcaacgcgtcatcaccatgtgaagagcaggaagaggatgacgacgacgacgaggaggaggaggccccgacgcatctccccttcgcaccctcgtcggaatcggaggtacgtgcgtttgccccctcagttcttgcggttcatcccctttgtctctcttacccgtctctccaacccattttgcgctgcattgctttcacactctcgccctcgtgggcatttcgtcaagcacctggtggcgggtggtgcttcgttactgtcatttaactcgtgggcatttcgtcaagcacttggtgtgcttccttactgtcctttaactcgtgggcattactgtcatctaagtgtccccaatgtcattcaagtgctttcacggagcgtatgtaccatttacagttgaaaacttatatatcatctttgcatgctcaaaattctcgtaatcaagtgttccatgcgaatgtgaaggtttaatccacaattccgcatggttctagataatttttagtgagatttctgtgtgttgcgagcttctgctttagctgacagttgacttattagaaatgacttctggatattttcaatcggggttccattgctttattg

SEQ ID NO: 41542 - DNA, 9845 bp, Oryza sativa
aactgtgggacctttcagttattgaacctcaggcagaacttatggtacttatctctatacttgatagttgatatcatgtcatagttgataactgtgcattgaatttaagttctacgatgagatattctgcataattattgattatgattgtgaaattttcggcatgcctctatcccaatagcatgccagcatcaatcaacatttgaacaggaagattagtatcttctactaggagtcgattcttatctattaaaatatattatttacaagaaagcttttcatgatctgcgggcatgtactatttgtaaaagattgtgctactgcaatagaaggtgaatcatcaattgagttctaagattcactgaaactactgcttgcaccatcatcgaatttttgtactgttgtattgtaagtctttaagtgcattgactgcttgcgggaagcgctaactgtgcggatctttaattcttgtaggttaacaaccttgtacttgaagtacttttggcaaaccttcatgtgagacaatttcttcgagcaaaggtgaagtggaatatccttctactactgcctccacgtttttgctagcaaatattttaataagtcttgcttctctgaattttgttctccacaggaaatctgtattgggatcataggaaacttagcttgtcataaatctctggccaatgcaatcacttctcataatggattaattgctactgtcgtggatcagttatttcttgatgaccctggttgccttactgaaacattcaggttggtattcatggaatatggtgaatgtgcgcgtaattatgtagtggaaacctggaaaccaccacataaaagtttccaaaagttttttaaaaaaatctcaccaacgaagtttgatattaaaattgtgtgtggttttctaatatcatctttactatatgtaacatttttcttgaaattttttggaaacttttacggggtggtttccactacatatttacctatgatgcacggcttgtgctaattaagactatctacatagcactttcttgtttgctctgacaagattaaaaacaataagcacgctattgtccctttgactcctttagcaaattgtaaattattgaacctgtaacaatatgtttttagcaatacaagttcttttatcacctgaaattaagcatttatcatgtggaaatgaatcaggcatcttactataatttatgcttacaacatatgttacatgcagacagatagtcatacattacacatatacagcatcactatttagtggattgtggattaaaatgcttgaatatacagctgttcttaagaaaaaaaagtaaaatgtaacttcttttagcacttgtaagtactccttattatgattccttattatgcatctccttttcttcatacacattcatgttatctttctactttttttttccttttctatttttgtatatagactatcatgacaacccgagttctgttctgaagtttactagttgtgcagtcatagtcacacagtctatttgtatacaggttattgagcaccatttttcagagcaacgcatctatgtcatgggctgaagctctcttacctgatgagattctttcacgtattatgtggataattggaaacacagtgcatgctaccttacttcagaaggtgaagtacttgtctatccagtcaactagatcctaataggttgataacttgtattgaccttagcttgatgttgaacattttaggatgatttatctatttgacattctatgtaataattgctacttttattcttttacaaatgatagttagttagatgtgtttgcataatttgttctttttcagttgatcttattatgattcagtgttagaagggcgttatgtaaatcatttctgttgattgttacatgtatggccactatcaatgtaatgaccagacctcttaatccattgtaatgtgtccaggacatccaaacaacttcttgattgcccttctgttaggagttcttatttatttcatcattattggcaactttgatcttacctgcagttgtttctcatgtttcccatgaggccatgagtctgcagacactgaagatataattgcaaactagttttgaccatttatggcctatgaactattttggaattcatccaaaaagctgtgcacttagatatttgatttagtataacttaatatatttgatttagatatttaatatagttatatggtgaaattgtggtacggctgaaatcatctggccaactgacttatggcattatcttttgaatcctgtacatgttcaaaatttgtgactatttcctttgtaaattattgggtgcagatactggagtttctatcagctcttgttgatgatcaagatgtcattaccattcttatcgagcccttgataaaagtgggtttagttgactgtgctattggtttgctattaaatgagcttgaaaaatcaatggatgggaacaatctagacaggtatgatttctgtgaattgaagtctgaactaacttcaaaattgcaaaagtgtacagttcatgtaaaattatctaagaaataagaacagatgactgtcaaatctagtgaactatactctatttacagttcataaagcatacaacatatcctcttgctataaatctaatgcatggataggtccataaatgccatctgaaatgcgggcacttgatgttcaccgataatttagtctttgtattttacagttttcatgttccttctgcttagtctgtttgcattaaccaggaattatggcatagtcatatttccttctaatcacttttttttgggttttcaaactttgagtgaatagtctagcacaggaatggaattttagtaccttgacttttttttaacacatttcaggtcagattctcttgattcaatccttcgacttattgaagaactgtccgccatagacaactgttcaaaagtaatgtcatcaaatgaccaattgattaaagcactaagtaatatagtcaagttaccagataaatttgaggtgagcatgatgctactaacagttcatttatttgattgcatgtcccatttaacgtcgtgtgcagttgaccctgcttactaaatagttttagtctgctgtactaattgatacaaattttaaggtatgccattctggattaaaagcatgaaatatatatttcaagaatatttttttttcttattgaatatatttcgggatcgtagttaggttgataagtgctattacttgtgagtcctcaatagcctcagttcttacctggattttagcacctgaaaatttatgcagattagatataattatgttccagatgagcatgctgatcatgttatatattcacaaactatgcttcaggttgagggctattgtgcttctgtggtaatcataatagcaaatgttttgtctgatggagaacatctcacacctattctgtcccatggtatgccacattttgctgagcaatatctcataattcttagccattgtttgcgagttgaaaacatgactatttagatacagtgtcacagtgtggtgttatattcattgtttcagatttacccttactggagggcctatttgacattcttccattgatctctgatgataatgaagctcgaaatgcattttggtgtatcttgacacgtttactgcaacaagtagaagaaggagaaaccatcacgaactcttcaaaactcgagcagtttgtgtctatcttcttggctaagttcaccctcatgaaagatgacattgaaagacatgggattcaaacagaagctgattcctcagttgagggtgtttctttgaagaatgggctacgcacatctgtatcctttataagaaaattcaatcctgataccatcatgcccttcatggagatacatagatcttagttttcattcccatgataaatgcatctaaacttaatatatcattgcttttcctatgctacatttttttaaaaacagctcaaggcgatctgcagtatcacggagagatggattgcggacaagtcctccttgggcaaagaagatgcttcactgaccgaaaacaccattgaaaatgctaaagagctgctgactttctgccggcgtgcaatgggtattgctgacctgtgagtttggaatacggaggttttgacgtagagggcaaccacgtacgtgaaaaattactaggagttttgctgtatagcacgagatcatccggaagtctgttaaaaccaactaggagttttgctgtagaggatcacagtgatgcatagatcatcagttgctaaagtagatcactactcacatagctctgccaatttacattgatgtggttacattattggtgctagcgatgtaatgaacgcgcataaaaatgatacggtgctagaggtttctgatcaacttgtgctcatggcttaacgagatgctggcaaacctattttgttgcgaccgttaccaaattgcttcttgttgtttcgtgtggtaacacaccaccacgattctattgatgcaaaatgagttcatgcaactccgtgatggtatgggctatgtaggttgaactggaaaggttactttaagttgggtatgaaaatttgggaatatttgatactaaatttgataatttgcaaagcactgtaaaacgtatatgcatcttcacgaaccttgtctcgctttagggagcttctagcaagtataattactcttacaatctccaactctttgaatagttcaaattcctattccagattgtatgacggagggttgttaatggaaccttaacagtgatggtgtttttgggacaaagttgcttgtacgatggtatttcataaaactcgttcttgtcgatgacatttcttgaaattgtgcgcatgtcaatggtattttttggattttctcaaaaatgaaatagacacccccattaatgaatgatggcgtaggatgtggattggggtccccagtattagaatacaaaatgcagaggtgctatagaaattacagcaggaaaaacctgcaccatctagcacaattctagacctatgattaacatccacaggatgaatgtgatagtactagctataagataaaatcctgatgctacaatacatgactgatttaaactattagtttttattgtgactgctcaagtgctttgtaaaggcaattgagtagcaactttgtattagcaattcaaactgcagaggatccggatcccgtaggaatctgctagtatatatacacatgcgtgaattgttcagtattgtcgtgtgccatctttgaaaaataccttttcttttaaggattatgagagattttgtgtgagcattgtgtgaatctcacctatttcctgcttagcctctccaaatacaaacataccaatgtctagtatgtacgttgggtgagttttattagcttatggactcggttactttctcttttattataaacatgattctcaaaggactcggttactttctcttttgttataaacataacatgattctcaaactgctagaagatacattttggataaaccaatttaatatagaaatttatttaaaaaatctaaataataaaatatttaaagtagttaatatttaactaattatatgttaataatccattttgatttttgcaccactaactaactcggccaaacacaacctaagatgaatccatagatttcaccatagcgtaaagccgtaaagttataacttataagcatatattcaattgcctttacaaagcactccagtttacaatggaaaaaacacatgctacaaaaccacatatttcgatggttttaactgaaaaaaagaggtgacctcgttttctttcctcaatgagagcagaggcaagagaaaaaaaaaagagtaaagtccatcaccggtccctaaactttaccgctgtgtcatcccagtccctaaactcgcaaatcgatcgttcaagttctcaaacttattcgactgcgtcatcctggtccctaaacttgcagatcacttatttaggtcctccaacttgttcggttgtgtcaccccggtccctaaacaggacggtctaaaaactttatatcaaaaaataattcataactttttcatgtaaactctaatgaagacaaactttatatcaaaattgtagccctcgacacgacctacaactttgtagttgaaaagtttttgaattaaaactgtttagggtcccaaaatattgttgaatatttatagattttgaaattttaattttaaaattacatattgggacaaaaaatgacttaaaataaaaaaattcaactacaaagttgtagatcgcatcgagggctacaaatttgatataaagtttgtcttcattagagtttacataaaaaagttatgagttatatttaaatataaagtctttagaccgttctatttgacctagatgatattcaaatccaaatttaaggaccagggtgacacaactgaacaagttggagaatctaaacgagtgatctgcaagtttagggaccgggataacacagtcgaacaagtttgaggacctgaacgatcgatttgcgagtttagggaccgggataacacaacggtacaagtttagggaccgatgatggactttacttaaaaaaaaaaaacaaaacaagtgaagtgacctcagctgctgcggtgctgcctgtccctccgcatcaccacacagcacgttccccgagctcggccacacccagtaccaagtgcacagccgcagcgccgcatcaccgccttccatttccacatctagggtttcagttgagtcgagttgagtccccctccccccacggccccacctcgccaccgccggccatgcccgacgcggcggccgccgccgccgccgcccaggacgccgacgccgtgatgcgcgacgcacccgccgacgcagcagcaggcggcggcgacaacgacgacgacgacggggatgacggcacagaagaggacgaggaggaggatgacgacgaggagggcgatgaagaggagctgccgccggccgaggatccggcggccccggagccggtctcggcgttgttgccggggagcccgaaccagctgacgctgctgttccagggcgaggtctacgtgttcgaatccgtgacgcctgagaaggtcggtctctttactccgctcatcacctcgtgtcgctttccttccgcaatcgtcctggaaatgtttagctcaaaaaaatttcgtgggatacgatgaggaatttgacgtgttagtgttcgtgcgccgcaatcggatatatgattggtatattgtggtttcttgtttgtttcgagtcattctgtgggtaggattcttacagttcaggaattctggattagtgctgctactcccacgaaatgtccctctgttttttttttaacttgaatctcctttgctactgtcacttcagctagtttacaatgttgattgttggatactgttacaccaaaaaacgcaacactagaaatgtactaatttattctatttggataatatggttgatttggtttgaagtataccgtcatgttcatgtagacttgaatattggatatacctatcttagactgttagtaacttagcgcagagcggtccagcctctgaattagtgtaagctcgcagttgcaatacaacaagtagccactattatcctctggctcatagttttagtaacggttaatatgattctctctccatcccaaaatatagcaacttgatactacgattagacaccacctatattacaaatctggacaagatgtctatccaaattcatagtactaggtggtatctatcgtattacttgattgctatattatgggacggagggagtatgtcagttcttatcactcacgtagattactagtaacacatggtgatgacttgctatttcctacaagttagtccttggaacttttcagttgtgcagtttgtgacccgagttttctgttgtttttgttcttggctggaatcctgattcatgtaaacaatatgatggcttgtataactgcttgctataatcccaagttaaatttattccagagttgagttttctgaatattcatttaggtataggtatttcttttgttcccttttatggtcctgtcttttcataagatgaagttttttttcccaggttcaagctgttctgttattgttaggaagaagtgaaatgccaccaggtttagctaacatggttttaccaaatcaacgtgagaacagagtatgtggaaataaatagttccatagtcgcttggcaatctgtattgttttcttcgtttatagttcatgttagaattatctgcagggttatgatgatttacttcagagaacagacattcctgccaaaagggttgcttcactcattaggttccgtgaaaagcggaaggaaagaaatttcgataaaaaaatacgttacgccgtacgcaaagaagtggcactcaggtttgtatctagtctgattgagtattcaccgatcttttgcaaattctaccacagaagaaggcatagatgaaccatgtggatttgctacagtcttctaaatttgtttagatcaatcatcattctttttcattcttctagttgatggaactgctttagtgtccatggggagcacatgaacattttcattaggggttctcaatttgattagcaatcaatgtgtctactgcttgattggttccatgatcataccatgaacatctaccaatataatttgcaagaaaaaaatgcaagctcaattttttgttgtccctggatgctagttgctcaatatgttccaacaattaattgcatggctccattagaataaaaatgtaacaaattaactgacttaagactggaggtctggagctgtacttctgtgtagctttaactaagagcaagatgtaccatatccattgtatcaatgagcaatggatggatgttatgagtcttttttgtggtaaaaaaaatctaatgatttatgctgctacctattactttctgtgtccgattgttttagccatcaccattgttgtcacctcaatctttccagctccatctcctttgtgaattttgtgtttgttgaatactgacagacaagaatgattggggccctggccagcagtgatggtacaaatagttcgcatacatgctaggcacagcatcaatggatagaagctaggctggagatagattaggcataggtaggaggtaaaggatgggatgatagatcccgtggattacattgtttgcagacccaggcgcataaaattctgcacatcaagctatggaatcaactagcaactaaattgtatgactagataaacattacttggcttgaaaaaattgatgttgcttctacttactctcaggatgcaacgtaggaagggtcaatttgccggaagagcaaatatggagggagagtccctatctccaggctgtgaacttgcttcccagggttcaggccaagattttctatctcgagaatcaaagtatttcttatcttttgatagtctatatactcgttctgtctaattattgtttagtagaagacttatcttctttctgtaaaatacttgttgcaggtgtcagaattgtggcactagtgaaaaaatgacaccggcaatgcgccgtggtccagctggtccaaggactctgtgcaacgcctgcggactgatgtgggctaacaaggtattgttgcatgtattaatgagctagtttattgtttatctttctttctgataactaatgggcttctcttcatctttgttttgaggacacctatcccatttcataaattgatagcattagaatacagtaatattctcgtggaggtggattg

SEQ ID NO: 41543 - DNA, 2476 bp, Oryza sativa
attagggggtatacgaaaaaaataaaagtaaagagagcctaccattgttgttaattaagccgcttgtttcatgttattgttgactgattctctgtgcaaggaacatatctcaaacatcactatgtgacttcttattctgatgtttgcaatttgcctttgctggcactagtccctgtgtctggtaattgcctaattggtatctgcagggtaccctgagaaattgccccaaggcaaaagttgaatcttctgtggttgcaactgagcaggttcatttttttaataattattatcaagagtttgaaaatgaaatcattgctgaactgtcaatatttccatacccgcagagcaatgcagctgtctctccgagtggaatcgacaacaaggaattggtggtaccaaaccctgaaaacattaccgcaagccatggcgaagtgtaagtgccacatttcccgttccaaattttgttcaggcagatgatttgattgacagtggatcatatcctttccagcatgggcgacagcactccggcaaatgaagccgagataggagcgccaaaggcgcagtcacaataagtttatgtttaacctgtcatgattgaaaccaaaagattctggattctttgcctacaggctatacagctaaacatcacaatagaaggtctttttcctgaccaaagtatactgattctcctcaagtgtacaattcttgcttgccagcacatgtaaatgtaattgtaattaacataaagagcctgattggtgcctgttgtgtaaacccctcattctcatgacatctaagatagcacatcaagcagactgtcatgtacttccggctttggagctgcttctgaaggggagttgtctgatggtgcttagtgtcccttcctaactactacgcctgtaaagttgtaccaactgatccttgtacagtttgtattaatgtgtcgtctctgtctttcgttttccgttttgctttgtgtatgcctctctaaaattggcatttcgctgtcaagatgggaatatgggatgatgccatcgcaaaagggaaggagcccctgtgatgatgcgacggtgcctgctgggttacgaaatccctggggaaagaaaaagcatccactcacagggagctcgtgctacggttgatgaattatgatgatggctggctggttggctgctgtgtgtagagcaccccccctgacccaaacgtccagggtgcatcctcctatttcgtttgtatccaacgacgttttctttctgaagctaaacacgttacacggacaaatattgtaatggtacatatgatcttaacagaacaatcgatcactttaaaaaaaagaacaatcaattttagtactctctttatctcatattatataaaacttttgtattataaggctgcattctttcaaaggagattggggagagattggggagattgtcactcgttttccgcgcacacgcttcccaaactactcaacggtgtattttttgcaaaaaaatttttatatgaaagttgctttaaaaattcatattagtctattttgaaatttaaaatagttaatacttaattaatcatgcgctaatggctcacctcgttttgcgtattttcccaatcttctcaatcccctcaccctcaaacacagcctaagttgctttgattttttaaagactttttttacctttaaccaagtttatagaaaaaaattagtagtatttacaacaacgtataagtttcattaaatttaaccaaacaaatatattttgataatatatttgtttggttgaaaatattgctatattttttatacatttaattagacttagaaaatttagctaaaaaaaagtcaaaacaccattgaaaataccaaaagtaaactcgaaatagagcagtaacaagaaactgaaaagtaaccactctcactgaaatactactaagcaagtctaccggaatactgttacgctgacgtagacatgagtaagcgcccagattacatacacacacctatccaaaccccatcatccagttacgccgactttggggattattcgcgtcttcaccgacctaatataagcgtggttacaaatctcaaaaccaacaaaacgaaccatcttcacctaaacccgtccacacgccgggtggccgccagttcagcgagtgacgacgacgaccccccacgcgcggcggccgcgcccatctccgtcgcctccccgccggccatgtcggtgccgcccgccagccaccgccaggttccccctcttctccacgccatggtagattcctctccctccgcatcgctctaccgtggctgattttttttttgtttttttctggttgctgtaggtgtccctgaggggatcgagcgcgagggagatcacccgcgacgcgctgctgcagaaggtctccgaggagcgccagctccgcagccacctccgccgcgccgccgccggggggctctccatccaggtacctctccact

SEQ ID NO: 41544 - DNA, 19081 bp, Oryza sativa
agcatgggtgagaggtctgacaggtagagaatattgagaaacccataattgctcagtgcctttctagatatttcattaacaaagtcctgcaaagatactgagaagcttataattagtttttgcataaataatatcagcagctaaccaagtctgcgaaccaccttatgtggccatttcaaaaagaagtccacagagtcattaggcatgtggctgttgttcatatgtgggtatgagaaacacaaaaatgatggatggttaaaacataaaagtaggatagaagtcttcatgatcctcttgttgctcgatgtggttagattggcaggatggttttggtgctacagttgtctgtgaggtggagaaatcatggatggctactagagtactagacaggttgataagttgattagtggcttgatatgtaatatatttaacgattttgtgtttgcacgaatttgctacattagggtaagactttcaatttgatgcaaacttgtgaggagtttgtgataatcctgtctttgtaggtagccttaacacacaatagatgtgcagatggtcaaatcaaatggattaatttattgcaggttcaacatttaaaattaggtttatatgtgattttccctcagtgcaaacagcaccgggagttctctgacaagaaacttgatgcccttgcaagctgctggagtacttaaaatatgtcttgattattaacgtgtttggagatcagttagtcgattgttatctcctttctctttatagacacaacctcagacagtagaatttttttaggatcatgctaatccactatgtttctttttcctgtgtgtgggtcgttcttctgaccattaagcttgatgcagaaatagttatttttatcatgggaaatatacatccaaagtagacataaaggccctctcagtgctcttgtatatgatctagatttctgctgtacttctttcaaactactctactgttgcacttgtacacttatacaattgatgcttttgttttttgctttgttatgccagcgtgtttggagaagatactcagtcataagaattgtttcagaacagctccatgaagagtgggaagcattaataaaccagcctgacattaatctgacaaaacaatggatatcaagcatgatgcttagaccatttcttttcttcgttactcaaccatcaagctggtacaagggacaacaggacaagactctaaactcgatttcggcatgcttcaaaatcatcttgaatagcataaactcaatgggtatgcctttttcataatcaaagtttgactttaccgacttccatcttgacctttttgtactttattttctcctccttaatgaaatgacacgcagctctcctgtgtagtttgaaaaaaaatgttttactttacccattccactagttgtggttaactcctataaaaatttatttatgtaatacttccttttgctgtaaggattataatcctttatattattcaatccttgtatggcgatgacctaattgttagttctagaatggaattatgtacttaacagaaaagaaattgcagtcgacgtgagataagcagatactccctccgtccctaaatataagggattttggttggatgtgatgtatcctagtactacgaatctggacagagactttaatatatatcatatatttagtactaggatacatcatatccaaccaaaattccctatatttagggacggaggtagtatttgttttgatatatatatatattagtactgtttggttgagcagtgcaatatggaaggaatattacagtaacttttttcttgaggctcttgatccactgagctggcacaaatgggtagtctcttctcggtgagatttttttttttttttttggggggggggtggaatgtagcctctagatattactgtttcaagaaaaaagaagttctttgaatttgaatgtaaagtgcatgctatgctttgatagacaagaagtatgaagtgggtctacgatatgtaaccttgtttaataatggacagatgcatgctaagctacagagcgaagctcccaaccagctggcctccatgtttaaagataatacaaatattaccacataactagtttagaatgcataggtccataactgtccttcaattatcatttggtagatgaggttaaacacaaaaagcatgaactatcttggagagctagctttcctttaaccattacagtaacaataagaacagcctttagtcccaagcaatttggggtaggctagacaggaaatccaagtcaaaccacatgaaccacaagaaaaaaggaaaaaaaaaactacttaaaccacaaaaagtgattttctaggccatagttctggcacatggatagctactttccacaaactcttatccaatgccaaatctttcgatacattccaagccttcaagtctcttttaattccttcatcccatgtcagttgtggcaggtcatgctttgatttaaccattgcaccttccttttcaactgacatgtatctttcctctgtagatgcaagcaaaaatttatgttcctttgctgtgggcacgccagaagaaaggtctatttggctttatcaggcaaaaaagttgatttcactgtgctcattcattcttgccaggtgtaaccattcttgctgtaaggatggaaacatggttcagattactgacactgctatgaggttggctgtgtctttaactgattgcaaaacatggaaaaaaattacaagtgaggatactagagctgctgatgcatctgtggagagcttgattgaatttattggtgcaagccagagtggtacatatagttgtcttaggagatatatagtaaatcttggttctcatgccttggagaagaaaatttcttcaatctcaacagatgatcagttcctgattactgctagtgcagtcaccattgcgctacgacctttccattctatgagagcagggaggggtgctgatctaaatggtgcttcaaaggaatactttacacttatactcacaattccggatctttgcaaacgcttgccacctctgttgttgcctgctataaagcacatatctatactacaaccatccctagatattttactggtaagagtttcaagattttgatatggacaagtcactctattgcattttgtatagtatagcatttagctgccgtggaagccttgactctcctagaagtcataggttcaacagttcttttgctgctaacatgataattgcacactatagttgatctactgattttcaaatgactctcctagaagtcataggttcaacagttcttttgctgctaacatgataattgcacactatagttgatctactgattttcaaataataattaatttgttaatagcaggtatttattaggtttattgatgtaccatcataggagattgattttaaaatattgacatattgtgagtgcgaaactgatcaaggcatggcaggtggtagcagatctccaaggacaaaatatttgaggaaataactaaattggagaagtcaggggtttctagtggtggttctggtaccattccctactgtggatgggctcttggaaatcttgtaactttagctacagagcatgatgatttatccaattcagggtgctttgttcaagggctagattgttgcctatatgttgatgcaattaactgtgtttcccaaagcttactgaaattttttgaggagaacaaggaaatgcttcttagttttggtgatagtgttgatacatctttcatcaaggaaaatgataccagtgacagctgcagcagaacactgtttatggatcttctgaagccaatttaccagcagtggcacctcaggaaacttttggtgttggcaaaggaggatgctgtgtgcaagaggcaaaataatcatgacccagatacacagacccattcgcgtagcctaaaattgctggacattgtatgcttttactatcacatgctccgaattttctctttactgagtccatctattggttcattacctattctcaacatgctctcattcacccctggatttcttgttgatttatggggggcattagaaatatatatctttggacaagcagtccacaaattacaaggaccaaaacatgaaagagaatcagctacaagtagttcaggtgagcatgtatcctccatgaggcaaagaagaaatttcaaggatacatcaaacaagtggtcgaatgtgttccagaagattacaggaaaatcaaatgacgcagaggatacaaatttggttgacaatcctttaaattctgagcagaatggtgaagcattaattttatgggatattgaagccatgagacaaggatctgagtgtattggaaaggatttaatgcaaatgttgtatctgttttgtgctacgtatggacacctattgcttgtgctagatgatattgagttttacgagaagcaggtaaagattggctcacaaccacaacctacttcaccccacctccttttctgcacatcttggttatgtatttaaacttctctgaatccgcaggttccttttaccctagagcagcagcgaaagattgcatcttcactcaatacgttcgtatacagtactttcattcagaatggtggaagcagcagcaaaccacttatagatgtgactgtgagatgtcttaatctactgtatgaaagggacagcagacacaagttttgtcctatttctctgtggctggcacctgctaggaatggccgaattccaatcgcagcggctgccagagcccatgatgcagcatttgctacattgccaggaaatcagttttttggaattcctatccggagctctgtacttactacaataccacatgtatatccatttgaggaaaggtatccaactttgtttagctcttgaaaaaaaatctaaacattctaaactcaataagtcattactgtatcatttagatattcgattattgcccctagtggctacttccatacaccatttgtagatctaacagcaatacttgcataacctaattcctgcagcatcagttctctcttgccagttgccatgtaaatctcgtgtttcataccgtgtaaaatatttttttaattattatttttggaaagttcagattgccaagaggcgatgcttcatttgatcaaaaagtttagatttttttaattatcatttttagtcttgctacatttgttggttgaggagagttgattagcccatttattttccactagcgatgcttcatttgaccaaaaagctcatctcaatttcatcacgctatctgaacattttcacttgcataactgtttctaacattttcgtctgggatttcttaaatattagctcaaatgttagcccttagcaggacatgttccatcatcagaacttatctagaggctttatttactaatattacagttaagcactcgatgcaatgctgttctagcttagcagtagtactttaatgcacaacacctaatttattaaatattttcaaagagtcaatccataaggattgattcttgtgtcaaatcatgctattcaagtgaaccaccctattagtgaggcccatatgtgtacaaaacagggaactccattaatattttagcacttttctctgttacagaagtgctatttgctcttaacatatttaatggcttttactcagagtgcagatgtttagagaatttattgagttggacaaagcatcccgaagagttactggagaagtatctgggccaggtccaggatctattgagatagttattcgtcgaggtcacattgttgaagatggatatagacagttgaactgtcttggatcaaaattgaagtcttgcattcatgtgtcgtttgtcagtgagtgtggccttcctgaagctggtttggactatggtggtctatcaaaggagtttttgacggatctgtctaaagctgccttcagtccagagtatgcctactgtggaaattttagcccttcaatattttagttttccacttcagaatgtttatatatgttttcactgacttgttttctgtcccctcacaacagatatgggcttttttcacaagcatcagcatctgatagcagcttaattccaagcaattctgctaaacttttggataatggcatcgatatgattgaatttcttggccgagttgttggcaaagcgctctatgaaggaattctattggactattgtttttcacctgtatttgtgcagaaacttcttgggcgctatagttttttggatgaactatcaactcttgattctgagctttacagaagtctaatgcaactcaaggtactgtttttttctttaagaaaaagattctgctgtaatcttgttctagacccaaaaaaaacatttgaattattatgctactgaaagtagcaatttacatgctcttagtacgttgatgaatatcaattgagctatggccattgctgcattgcctgttttttcaatctcgaaacatcatccattctttatgttcaagacatgtcattagtttcggctgactcaatataaaacatggatctaaacctcaattaagtttttgtggttttctgttgactgatgtttaccaagtatatcacttctaatatagagaccatatatgatatttaattttcactgcttttgtgtatgatgttgtcacgaccggtaattcacaatacagaattccagacaatatgtgtattaaatccccatccaggactagccagggacccagggaacacaagagacaaggttcactgtgcacctccctccagcctcaaactccatggaggaaagttatgcttatgcagactctccaggcagcaacaatttgacatgacaagtctcctcctctcaatgggatctaccttcgtgtacttagggatacacgctggtggaccccattagtttgtgatatgtaagacgtgcattgtataccaactgtctcttttgtaccccagctggtcctggacggggatttaatacacatatagtctggaattctgcatcatgaatttctgggtgcgacaaatgttatggggatgctatttttgtgtcatcttttttacacaaacaatctagtgcctttctgatgttttcatccttatgttttcaaactggcctttccttgaaacagcactatgaaggggacgttgaggacctatgtttggattttactctgactgaagagttgggtggtagaagaattgtccatgaactgaggcctggtggtaaaaacatctcagttacaaatgaaaataaattgcactatgttcatgctatagcagactacaagctcaatcgtcaggtttgttacttggtttgctttcttgtatgttctaaaaactgttgttctttatcaataagcagcctttttgataataccataatctcttgcagatactgccttttgcaaatgcattttacagaggactcggtgatctcatttcaccatcttggctgagcttgtttaatgctaacgaatttaatcaggtaacatgaatactgaaacaaacttttcctttacaagtgatgctaaaaaggaatttaaaatatttaagttggaaccataaaacatagaactcgtaaacatagaacttgaagactcaaatattgtgaagtccacatgatcatattatattttgaaattgaacttggtctaagcaacagaattccaaacggaacaggtgcatgtgctgacgtgcatgtccttccattcacacatgtaataaaaacagactaattttcacacagccaaaaacccaattatatcaggtataacccaaaatgtactgtatgactgacatgcagttcctgctatttcctgctatgtgctatcggctattagtttgtatttgctatactgtttcagaaataaaactatgatagtctgcacttttggaaatactgctaatgtatgactatgattgccacatacagctgctttcaggcggattacaggattttgatgtcgatgatcttcggaacaacaccaagtatactggtggttataccgagtcaagtcgatctgttaaactcttctgggaggtatatattcatctgaattcgttttttttttctcctaatgctatcagaaacatcaagtgcaaagttatgtataggtagaacatacaaactaatatgtggatatcagttggattttcgtttgtgttggagtctaaaaattacataatctcaatgtttagcctatacacggtcacctctgcttaatgcggaatactttgatctactgacctgcttgagaagccatctgggttgaagttactctctgttcttccttccctttctaattcttttcttcctttgactttccttctttttcttgcgtcaatggaaattcccgagatcgccgaatcccttccagcgctcaagccgatcaggcaaattagggttttagggttttggcagagaactcaaagtccctttcctttgcgttaagaattaattttacccatcacaaaactaactctacctctttgttatgaaatggatttcccaattaactaaccggcaaatagctgataaaatcaaccaacaatttggagtagacatatctacccccatgctatttgttgttttacttgtaggtttataataagggaagtttttttttttacttatcatcagcttgactgccaagatcgatgcaaacacatgtcagatttggaaattgcttagttcatctattatattctactgtgtggtgaggactgaagtcagtattttactgctgcgttgcaatctcccctctggttggaggaagttggttgccagatgcccagacacatgttgacaattggtattgtttacttccaaaaaaagagaacaattggtattgttctagatggagaaactaatttagtctgtggtctttgcaatcatttttactactatcctgggctgccgggggcttaaaactgtcacatttttttttccttttgtaaaacagtatctccaggctatttgcttgtggcgtatgcacttgctcgtacatttgttgaatatgatatttttctctcttttctttttgtggccatatggtcttgctctttagtgtctgttggcatgtgatgcacaaaatcaactggtctttagctaaatacaactatttttgtttttttttaaacaagaaacagcatgggagggcccctacagttaaatttttattgataaaatcagaaggtacaaaaaattacaacgacaagatccaatctttcatttaatctaagaagaagagatctcccttgaaaaggtgcctccaagacaaaggatggaagctactcgtattagcttattatcaaagatgaagctatttttactgattgacaataaacaaaagaaattttggtgaaggctgaagtggaatgatcataataaaaatatggtttttggaatgtgcaggttatcaaaggatttaagccaacagaacgttgcatgctactgaagtttgtgacaagctgttcccgagctccattacttggattcaagtatttgcagccttctttcacaattcataaggtttggtttttatagtcctgtgtgtacattgattgttttgtactgctcattgttcaattttttatgttctatcgtttttgtctaggttccatgtgatgttacactttgggctacaattggaggccaggacgtggatcgtcttccatctgcttccacgtgctataacacactcaaggtaaaaactatattgcttttatctatgcaccctgctaatatgataatttttattacatgtttctcatcgcatgttcctaatttcttataggcatcgatgccaaattgctgcattttatttgacctgttctgttcattttattactttccagcttccaacatacaaacggtcaagtacgctgaggagcaaactgctatacgcgattagctcaaatactgggtttgaactctcgtagaggtatgaagattttatgtggatagattaaaaaattgggtttggcacgtgaattgagtgccatagcctagataatgcacttgtaattggtatgtgcatcgctgtaaatttatctgcctattccgatgataacctgcatattcgcattgatttaatatcaaacttgccatcgaaactctattgaaagttgtatgtaaattttggtttaagttctcaggaaccaaacaatttgattttattaatagttcctaaaatcaaaatcagtaattataaaattatgtatagtatcatgagtcatgacacagtgatgccttttgcactagctttaaagttttcttgatataataattctgagattaggtttaaatcgtagtttttttcttaattagtaaatagaaagttcgtttggagtgttaattataattttttttcaggagtcgggatttcaaaattcggaattagtaagcatcgagtcgtacttgtcttaaaattgcaatgtattaagaaattcaaagttaataattacagagttgtttctaacatggtctcttgttttaatctgagccattataatctggtccatggatagccagattttccaattttctcctccttggagcatccaatcagcaattcaagctgttgtaatttggtcccacctaaagggattaatagatttattacttactattttttgagtaactttctgaaatcccctgttttatatggtcaaagttacacaagttacacaaaaccacatgtattatgacgtgtaacacataaacacaggtttgatggtatatatgttttacaaaacctcacctttattaatgttaacatactaccaacattcttctttaaagtagcgaagagttaaactgtcaaccttattcaagaattttatagttaacaattttatatgcacattttgttttagaattataagtaaatttgtgctcaatgtatatcataataccgaggttgtgccatatgttataacgcctgtgttttttctggaactttaaccttaaaccacagggttttataaaatttactcttacttttagattaacgcatgaattttattagattagaatgtctaattagtatatataggtatagaataggtagagcaataatctcattagttagcgtggttgtggagttaagcacatatatgttttcacttatcgtctctcaaatcgtagtgttcgtgattgaactgtcacgacctacgtacgtacacgtgattgcgctttttatgaggctcaaccatctatgtgatcatggatttctcatcgcgtatccatggtaaaacacgccacatatggatcacaaggtaccaaagcacacagctgcaaaacacccattgctagcgggatagtacaatccaagcgcatgtacatgacatattacaccaagcaagcagttcattcatactacagcaaaacaactaagcccaagcccgtgcacatgactgcacgatagagagaaaaacaaaactaaacaagcagggcaaccgaaacagcagcatgcagcacgtacggcggctactcgatcgatcgctagcaggagaaacaaatagcaacttaactaattaagttcacaggagtagagtagagtagttgagaagcagaagcgagagcaagaagctagtagcgctgttggctgtgcatgcgtccgtcattctcaggaaacggatggatggatcaggagatgagctggaggccctggaggaggagggcgtcggcgagcaccttgttggcggcgtccgtggggtggaatccgtcccagaacacgtaccccgtcgcgttggcgcacgtccccaccgcaccctggttgcacagcaccgacgtctcgatcgtccccgtcccgcagcacgctctccgagactcgaagaaacctagttaattggagtagtacccatcatcacataattaattatcagttcaatttctcactctcacaacatcttcttcaaaacaaaaaaaaagagagagaattcgtgcattgctgccaaagaggaggcgtgattaggggctgtaaatagctagcctgcgaacccattcatagatagatcgaaacaaacgggtttgtagtttgttttgatctataagtatgcttcacggttagtcacttacacctaaatagacgtaattacgtgtacgtaccggcggcagtggggttggtgacgaggtcgaggagcgggttgtagatgtcgaagacgacgagcttgaggtccgagtgctgcttcctgatgctgtcggaggccgcctccagcttcgcgttgaacgtccgcgagtcgttgttcagccgctccacgcacccgccgccgcttccgccgccgaacagcgtcaccgacgccgggaggcaccccatcggcggcagcgacgtcacgccgatccgcctcgccccctgtccgtacagcccctgcacacacaccacgcgttcccaaaaaaaaaaaaaaacccaagatcaaaatcgttgaattgattcggtaccacgacgaggccattttcactgcacggtacacatgaatgcatttctacctcaaataatatgaaacgcgggaaaatgtttgtgattttgtacctatttactccccccgttcatctttgtttgtttgacaacagatagtacgtactatgcaagtacagactttgactgctcatcttcttttttttaaaaaaatacgaacatttgaaaacatatcattatctatgtaatttggcaatttgcatgctaaagaactggatatactactacttgtatttatcaaaacatcgtaattcagaaaaaaaatattattgaccaaaattaaaattatactagtcaacagtgtcaaataaaaaaaaacagagtgtacttggtgtactggctgtttcagtaaattcaaagaagtaaaaaaaatgtcctgcgtatgtgagcttggtggatcgactgcgttaagtatgccattacacccaacagtagctgctagctgtggcattgtgtattgagcagtgaaatcggtggcaagcaagatcgacaacaccggccggtgcagtaataaagagagagattcatgcttgtcttgaatctttcatccacccacatccacatggtcaagacagatctgtgaaatggcaggcagcagcaataggttttctgccactgccactgtccaatctttctttctttccttttcagtgaaaccactcactatacatgcatatggacaacacggcctagcttggaactctagcatggaaatgggtcaatttccatggtgcatttactagaggggattggtgtgagggaattgtggatttactagcttggaaactctagcatggaaatgggtcacaatttccatggtgctgaaaatgttacattggcaggggcagatcagatcagtccggaatgtcactagctagagcattgtattatagggggaaagcctctagttgtagctatataattgcaacttttgtagtaatctcgtttagctttctctcgcaaaaccggggtcaatttgggataggactatagtaaaaatgtctcttcaacaagggctaatcaacaggcctctgacccccttaattagtttgcctttgtgccaatgaccagattagcaattttaatgtactaatgtagcgattgctggcaagcaagcattcgcattggatgatctccctacatgtgacaccagcaacagtagtactccatgtaaattagaaaattaaatgtgtatctgcgtgcattaactgatgctagctacaacaacgtatgtactgtggagaatggcaggaacatgcatgttttggaagaaaagaaaaccatgggaggttgaagaattgagatgcaggccattgatagctaccggtcctacccatagaacctgtgaccttttgatccatccatttactcctctaacctcctctgcaaaggctattcaattgcctgtctgtccgctcaagatcgatcgatatgtcactgtgcactacgagcagggactgtcccatgccgttactcctatagaagacttctttagagtgaagtaatttttttttctaaacaggagaagtaattaccatgaaaattctactcgtaaacaggaatactagctacttacgagttctaaacttgttgctaatggccaatgggatgaacaatctgacactacaaatattgctccatgcacattttacaaaacgtttagctatttcagttatcctgggattagcatgcggtttcatgaaaagtctaactgtaatttggtgcagtaaaagataaattgactgtgcctttcttcaaaaaatggaaaaaaagaaaagaaactgattgttaatttagctgggtttttttttgctaccttacatttagattcatttagtatagtacccttgcccattgtgtcatggcaatggcatggaccattgtggaacaaacggagtataatgacttgatgcatgtaagcatttgcatgcatggttgcatcatttaatcaagtgatagattggagaaccaaatgtcaagtgctttgcatgctgtgcttaatcaatcagtgcttagtggtactaatcaattacaataatatatggatttgattacctcgatgaaggtggtgaagggctgcatgaggacgtcggagaactggtcgggggtgtaggtggcgcccagcatcgggttgacgtagtagttctgcacgaagtcgctggtgccggcgctgaccacgtagatggactccgacgtcagcgccgccgccttcttcccgccggccaccgcctccaccttcgtcttgtactccttgaagtaccccagctgccggctcagcgatatcgccccctgcatacgccacaaaacacaccacatctctgatcatcgattaacatatagtgattttggtttacaagctagtattatggcttaattggtcccgtttgaactggctggagataaagattaaatgcgggcaccaaaaaacatcaacatgtaactaattaagttttaattattttaaacttaaaaaacaaatttatctgatttaaaataattttgtaatacaaaattttcattgaaaaccgaggtaaattttgtatcttaattagaaaagaatataacaatttgaaacatatcattgagcacattgtttctgcagaaaatattactccctccgtcccattttaagtgtagccatatttttccgcgtcaactttaaccatccgtcttatttaaaaaaaaattaaaaaaataaaaacataagtcacgagtaaagtactattcatgttttatcatctcataacaacaaaaataataattataaaaaaaatttaaataagacggacgataaagttggacgcgaaaacttatggttgcgattaaaatgggacgagtgagttacttagactgaacaactaacttaataagaaatatattgaagacgaaaatgcattttttttaaaaaaaaagaaaaaagaaaaaaacgtgaagcagataaacaaaccgtacgtagagggaggcggtggtgtcgaggtagccggaggcgccggaggcgaagttggcgccgtggaggagggagcggttgtcggactgggcgagctggccgaggtagggcggcgggtaggaggtgagccccaggttgtcgacggtgtagtcggtggccagcttcccgttgcagaaccgccccgtgggtgccccgtgcgtctccgggaagtcgcggccgtagggcgggaagtcggcgcgcaccagcgtcgccagccggttgttgttcccggcgtccaccaccgagtccccgaatatcatcacccccggcaccagcgccgcctgctgccccgcagccgccgccaccagcagcaacgacaccaacaccgccgccgccgccgccatcgcggtcatgatgctaataatgctactagctgcgttctctctctggttagtggagtgaggtggtgatgtggtgagcgaagtgaagtgcgtgggtttcaatttgttggcctctgttatttaaattgagacgtgcggtcaagtgaggccgaatttagttccaattttttttttaaaactttcaacttttttatcggattaaaactttcctacacataaacttttaatttttctatcacatcgttccaattttaaccaaacttccgtcacaccgtttcaattttaaccaaacttctaattttaatgtgaactaaacacacctaagttattgctggctggctgcctgctggaactactacagtaactactgcaacaagttacaactattacaggcatgtgcgcattcaatgggctaaccaaaatgtactagtgcgaaacttatcttcctatgcatagtgctccaatacaacgaaataacacgtactggatccaactttccacctacagcgtcatgcatatcgtcttgccttgttttgccttttcttttccccctacgtgcgtgcgtgtgctaatctggagcgagtaaatcgtatctaaccctatactgcttaataaactaccccaacgataaattaacagaattattatgttgagatttgtgaaacggcttttaatttctgtgtgagaccgagagcttcactcgaataaaaccatttttatccgtgaaggcttttctgctactcaaataactagtactttttaaaacttcccctgtgaaacagtgagacctcaagattgatccagtaggccagtaattatcaactaatatccattagaagatcaaacggaagataaacgggcaatatttaagaggttaagattgcttacgacggctcaagaaggctttacagccgcatgaactgttccaactcaatacggttcatagtactagatcgtacggctgacataactccattaccacggctgatactttactacgggtcaagctgggcaaaaccttgaatagctgatttgagtgcggaacaatagcaaacggctgcgaagtaaatcacttcatcgacttaaaaacagaaacatcacaaaaataagctagagatttgtcaaacattcgttctgttcccgacatttctgatcatgatttcacataatcacataccaccaaaggaccgaatgaaacaaaaaaaaaggataatctaaaccttccatggtctaaagcctaaaacagccaattaatcaggccaaatgtaccagaactagtgtataaatgctgtactgcaatcagtgggcatcctagctcctactgttaataatacacaaatgttacatgaacttacaagcaggggagcggatactggacacgatttccaggtcgcaaggccaagacgcattccattggctgtacagtatccgaaaaatccagttggttttgcaaatcaggtggcaggagctgagctgggaatcttgaattgcttcttcacatagtgcgaagcctccgaatcatttctgtggcaaaggaccctaagcagggttttggaatcggttccaaacttacttttagcgccctgagtaacttctcgtaggtcatcgatgagcacacgtgtctggtaaaaacatgcagaagcaaaccgttacagatgatgattatgacttggcacgcactagtcttttttgggaaataagagtttcctacggctaaattttactcccttcatttttaatatactagaaaaattgtacgtgcattgccacgggtgaaggttattttaatcatattattgttagatctttttgtctaaaaagtatatgggatttttattttgataatattgatatctaatttggaactcttattaggcctggcaagaattttgtagcaattaggagtccgactcttgttccaaattaacatgcgagttttttaaggatttcttatacgactccttattatgtattcccaaaagtgaacaaacttaaaaaccgactcaaatacaaatgacgtaccaaagtatcaacagaaacatctttaatttttataataggagagacagagataacgccattgacattttaagattaaccttttaagatacgttgactattcattttattcaaaaactttatgtagttatcattcattttgttatgtcttatttatcgtacaaggttcttttaagcgtgacttataagacaaatggacaaacgtatgtataaaaaaaatcaacgatgttatatattaaaaaacggaggtagtgtgattttgggactgatttctgctctagggcaaagggcatggaacaatgtggcacgattacatgcagcttgggttgtaaccagatctgggcggaccagctacctgaaatcctgaattggtttgtttgctgtgccaacgacttaggctgtgttgaaccccttctccccggcgcgcaaaacgaagctcatattattgcatgatcaattaagtattaactttttttttgaaaaatagattaatatgattttttaaaacaacttttatatagaaagtttttgcataaatcacactgtttagcattttaaaaagcgtgcgcgcggaaaacgagagaggtgggttgggaaaatgggggggaagaacacgtgattaattaagtattaacttttttctttgaaaaatggatcaatatgactttttaaagcaactttcgtatagaaattttttgaaaaaaacgcaccgtttagtaatttgaaaagcgtgcatgcggaaaacgagagaggtgggttgggaagatggagtgccaaactcagcctgggataactagctaatggaacagagaagttccatctaaacgaacaagttatacaggtgcctataatccaaacagtgaagattctactttttttttaccaaaataagaaatgggacataattaggttcgtttgagtttgacatgaagctaatgtgtgttctgtgcctacgacttagagataactagctaatggaacagagaagttccatctaaacgaacaagttatacaggtgcctacaatccaaacagtgaagattctactgtttttttttaccaaaaataggaatgggacatgattaggttcgttgttgacatgaagctaatgtctgttcactaacaactgctagacacctatgtaaccattggagctacgtcattatgttacctccacgatctggagttccacaccctaggttctgttcaccggtttacccagtg

SEQ ID NO: 41545 - DNA, 1243 bp, Oryza sativa
ttcttccaaaagagtggcatcacttggagagaagacacgcgtaggacctccatccaatatcacacggagtaggccatcctgccaagcaaggtaactttaagataacatatagctcacaagctgtcacaacaatcctacagaatttattatccggaaagattaccagagatgcttgtagaagccctgtaaccacacgatcccgtagttgctccacaatgacattacaaagctgattaagcacctaaatattgaggcgtggaatcaaatatctccattagttcaagcgaatcttacaaaccaaatcacaatatatatatttatcaaaaaaacactaataaccagaggtacaggattcaagattgattatcgatttttgtgatatagcaaatggtttgcactttggccacagataattaacttatccatatcttttgaggaaataaactatattcataacagaatacaatatgtgttctgtgaaaagttgatcatctaagtagctaaccagcattagtacatagataaatggtaggtttcatgctagctgtcagatcatagggttttgtttctccaatttaatgttcctgaaaggttgcacgattcatgagcataccgtatcaagtacttccataatagcatccagtcgagcttgagaaacattgtttttgtacaaattatcaataaatggctgctgtaggtcccagaagataacctttagccctaagaaagaaaaggttaacatgttaatagatatctgtcagcttccaagaaagcactggggcatgtatattttcttacctgtaaactcacatatccgatcaattgcagcattgatttcttttctgctgccatcaaattgattcttctgactcgagacagcactctttgatttttcactcattgatcgtcctgacaaagttcaaatattttcaatataacagatttagtctgatgttatctataaggggtagatcaaatagattgatttgcaaacttatcagaatattcaacagataaattggcaactaaaatattttttttctaaagaaaatcataacagtatacattttttttcttgaaaacgcataacagcatacttactgatgttaatgctctcacttttcctcctagcccaccgctcatttatgctgtcctccagcttgcttagctggctgataccatactgtttgacaaaaaaaaaagtgcttctggttcaaaactaatgaaaatggacacaattcaa

SEQ ID NO: 41546 - DNA, 9617 bp, Oryza sativa
caggctggaaggtgaagatattcacctataggttatagcagcataattatcaacacacttgaagcctagaaaataattttaatgagatacatacactgatccccaaatgtcatagttttaaattaaattttttattaagattggcatataaagaagatatatcgttttatatctcacagaaattgctcgggaacttgacaagtcattctagtcaaagcaacaaatccatatagcagtgctctgttgtaaagactcacatataggctgttaagccgtacacaaagctttggcatagtaagttgtattatttcacttgctttcctctcgtcaactgttctaacttcatgtatttccttttttacgaaagccttgattccaagctcctttttatatcgagtaagaacagggacaggtggaattaaatcttctctatcaactgcaagcaaacaaaaccaacaattacagaaaagttattctggcgtccacatccacagtaataacttttaagttatgatcttggaagcgatgcaccatctacagcattgattatttgccatatactcatgtaaaagagaatattttcctttgaaatcactcagacaaggaagaaaggaacaaaaatatgatgaccgaaagatatacagaaagtacttcacagaaaaagggtgccatgcaaacctatcggtcctgtaacaagttgtgtgtaaacttgaaatgccttgtcaaaaccacggcagaggctatttagttctccagttctcatggggaccttgaatgcaaaaaattgatctgcagtctgcaatagtttgcaaggggcaaatgattgctctttagagacggatggaaatcaatccataacatattcaactaccaagcaaaaaaaataaatctaaagaaaactaagggcatctttgggttgcaacccaaacgaacactaaaaaaatttggtaatgccaaattttagcacattttggtaatgccaaattttggtagcattggtggatacatttggtttgaaaccttaccaaataaaggtataaatttaagagtggtaagcttccagaattatggaattttgttatggtagcaattgttgggatatgtttgttttattgccttaccaaaatttggtaaggctgaaggtggtaacaaaccaaacaggccctaaggcatgcaaatatctttgaaatgttgtggcataaaaaaatctctacatgaaaacaaaaacagactttatcccgtaagataatattaagcaaaatttattcaaggagataatggagtgagggacaaaaaggagcacctcttctatgattctgtagacttcgacaatagaagccccatggcgttgttgaggggatataggatcccaagtctgttgagcaaaaaaaagtttggcataaaaaagatgacagaatgaataagataatgttgtatccaaataatgtataagaagcgatggcaggctttgagagatgtaacatgacatttatgtttgaaatatatcatgaaaaatagatcactttcgcaatataccacgaaacattctggttcacttcactacccgaaaagcatgggattgaaaggtaataaaatggatataaataactttaggccattcgtatagcatgtggaatagaccagaaattactttaggtcattcatatcatggtaagaaagaggatgttggatatagataaatcaaacatactgagacagtaagagctttgtaaaaaagtaacttgagtcaaatagtgttacctcttgttcagcagctcttttaacccaagtttcaattctctcaagctgcccatttacccagcgtaatatcaacgtgccagatttactttcaatctgggataaaacaaggactaggatgaacaacatatgaactcttaacacaaaataaactaacagttcattgctgagcatcgtatgctggatgataaaatggcaaatactgacataaattgataaacacatcatgtcaaggtgaacaatcaagcaaatggattggataccattttgcactgttgtgagtgctgctacttgaagaagatacagttaaataagcaaacctgataaggagctagcttttgtctgcatatgctgtccaaaccatcatctcccacaacagaagccatcacagacattatgtactgctccaaagcatcggctgccggaaatacagaaaccacatcctccgtaagatgctccgcgtgctcaagaaacggtttctggcacaaatgtcatgcaagcattaagaatcctatggtggtggatatacagacatttcagataagagtgtctgacatagcttaccaatttgcttccataaagtttatggagaagtgaagcagaaacaactgcagactgtgggtgccactttgacaaaaccgatgaaaacacagttgtatctttcttcagaagcttctttgtctcctcagctagagatgctaaaacatgttcatgtgatgtgtctgctttagcctctactgagtgtgccatctgaataaaaaaagaaataaatgtttctttagtccatattatagatataattcataaggggaaggaactagacaagtctatgacaactccaaattgcagaatcttgacatggatgatgctgtccactttaggtgcacacagtgagtgtccaatccggtaaacaaaacaaacaaaaatattggtttggacagagcatagttacaaggtttagatcccggagtttctatctcttgatatgtaaaggacagccatgtactgagattttgttatatgaatgtggcatagtaatattgcattcaagacatttcataatgacttttcaggaaggtagtggtaaaaaagcggaattcagtttatttaatgctactaaaagatatagacaaaaagtaatttggaaaatataaaaaactgaaattcaatcacataaaccataacatccaccaatatttaggcttggacatctctcatcaaactatggtcatgttataatttctaatacatgaaatagacatttcaataattaaacaccccaactacaaagaaaattgctaacgttgacaataatatggtatgatgatttcctacgagcgaacatggtcagatacgacattactggaacttcaaaattgaagtacatgtacaaaataacggattgagactgaaggtttcacatacatacaagcatgattatgtaagcgattttacatccatctcaattgcgaaaagtgtaggaggcaaagtgtatagctctgctatcaaaagaagccgctaagaaagtcacctttacgaaagcacttttgacagaagaagtgatgtaacggtcaatctgatctcgatcaggcgactccattccctgatgtacaaaacaaataaagcgcgacatcagaattttccacatgtgcagatggtagaagtattgctttctacattccagatggcctgtatttactatttagaacagaatttattatatcctttttttttgtgagagccacccctgaattattatatagcggaaatgacttttgctcatgaaatatctagctacactagtgcacgagccggcaataaacgatctaattttagattaaaaatggtgtaatagatgaaaaatgaagtgaagtataaataccttgttattttcttcaccaagaattctcctaataagcattgccactgttacaatatcagccatcatgctagggccctgtaaatgaaaataaatattaatatgggaaaataatcccttgttgcaaacaaagtccagatataatggttcagtgtgatctatggacttggtttcagtaaacaccaaatgttgaacggctgaagtctgaacagaaacagcagcgtgaaaagaggaaattgattagaaggaaattacagctccaagtcatacacataaaaatgccctaagaagaacaattgaagaaaatgataagcttaacagtgaaagtcaaaaccatgaggcacggaaagtattggtacaatatgaaatcgaggatctaaaaaagacaatatgcatgaatgactaaatagtactcagctgtaatgattgactgccttatgcatatatgagttgcacactaacaaaaaaaaaagaagcaaaagccaataccaggggatataattgatctacactgaatgataaatattttatttataaagtacgaacccaatggaataaaaaagatgactgtgaaagagtaaaggagatcctttccacaactcatgcatgttatgaagcacgtgagcaaaccaggagttggcaaaacaaacctctgagaagtgtaggtgataatcattcaatttcttgtccacccatttctgaacgggagataggaaagattggaaaaatgtgaagtcttgaaagctatcctcagcatcaacagaactacgcaaacttttcaagtgtaatctttcctgtggaccacgctgttccttcaaaggtatcttcctcaaatgctcaatcacaactttcaagagtccttgctcacctgtaaaaacaaactgtattgcagaacatccattaaataccatactattgagaaggttacttagtttataagctaaaaaggtcaattgcacaccatgggatatggtttacaagtatatatgggccatattgttagtgaagcagtctttatgcaagagcacctatggtatcaagagacaaatgatccactggcaacgaacactagtgatggatcatcctacttcatgacatgcttaactggaactacacatcaccatttccacaaaatagtaaaggctaaccaagattttgcaccgatctccttttcagatgaccgtgtctgacattatgaacagaaaaggtttgaaatcatttcataaaaaactgtttatgcttgaggaactcacttgcttttggcttatttgggctattaagagaagaacattagatatcagagtagacctcaatcagtggttatggaaacacatagggttattgcagaatgtagaggtacttagggcctatcataaatccataatgcaaccacaaaatattccagtaagggtaacctcaagtaatagtactgcttggctagagctatacctgtctaaataatacccatgcataacatgtatcatgaatcgtctctgtaatgcctagtatccgccaagttgattttaggagctccaggatttcttccacttcctggtagattgaagcaaaaatgttaagagaaatacctgcaactgatagtgtatctagacagaggaaaattacaaaagatgattttaagtactggcctctgtaagctttccctcatccaagatatcaaaaacactgccgagcattttctcatacagtgccacattcagatggtagccatcagaccaatgacaaacctcaccagtaagatcaccccgtgcaggtctttcagagagagaagtagcaacttctctcagtgatcttaggcattcagtgcgttgaacctccacagcagatggttgcaaggactagcaagtaaaacaccacgatgagcctcagtatactggatagttttacacaattgttctaaaagtcaactataagagtattcactgagtaatctctaaataataaaacctcagattcttcaatctttctgaagaggtttcgtagctcattgacctttcgacctaactctccaaatccaacaacaggatggtttataaggccctcctccagcatgtttagctaagcaaagatacaaatgaaacatataatgttaaggcatgatagggtggccccaaatactgtagaattcaagatcatttaaggcacaataagatggctaacctgtctcttctgccaacgaagatatgctttcatgtctgaaaactcggctcttgagatacagcatagtagttccaatggaatcaagagattgtccatccgttttccaactttgcctaccatagcattgagcaatccttgtctagttctaatatccatggattctgttatctatccaaaaacagcagggaacacggaggtcaatgtatgtaagattagcatgctgagatgctttaaaaaacctggatgcacagaaacataatgaagggactgatggccttaaactcaaagagttgtagtttatggactttcaagcgacaaaagaagcttataagctgctaacactcaaacttgctaatctaatttaagttgtgtgaagcattaatgaacatcagggaacagaaaggtgaacttcttttattcgtttattattcagtcaccagaagcagaaggctaagacaatatacctcaagttgtgctcgcatggtttcaagcaaaccaaccaaacctggttgccgctgagtttgggattgagtactctcactcttactacgtccgagtttcctcattaatttgtttctcttctctttcttcttttctttctgtggaactataagtcccctgtaggtatggaaataaggtaaatgatatggtatacctggaagactttcaatcttctaattggaaaaaaaaatgagcacaaagaaatgcataagcctaccctgaagcaccagcagcagcaacaagaatttcatatgctgtttcacggaggtcatcatctgttatacctggaaaaacagcacagtttccgttgtcaataactttcttgacccaatgtatgtagccataccagcatgaagacttctaaagaaaataagtcatgaaaatttcacttctatctgttattggatatctgaataccataatgacataacagtcatcactattacctgtttcaaatagtggtaaccgcaatgataaatcattggcatcactttgatgtcttctagaagcccttcggctatcgaattcatcttcttcatcctcaaaatcttcaatgtcatctatggttaactccttctcagttggagaatcaaatgattgtgattttgataaatttgtggtagagactggtgagtgcacagcaactggtggtggatccacaattggtgccggtatcacaacaggtgatggtgcaatagcagggacagggggtggttctctcgctggagctggtccagagtactctggttttgtaagtaaaaagaattcctccacagttccactgttattctgacaaaagtataatgtcaaggcattcaaaatcataagaaatgaactttaatgattctgaaatgatgtgcacagcatatcaactaaacatgaaacattctctattaaaataggaaaacacatattaaaatgtccatatatgaacataattgtatccatggagtttagtggaatggttaggtcttttatcctggagctttaaaatgggcaactcaaatagctcctacattgcaaaatggctgacaaacttttcaatgaaacaaaataaatgcagcagctactatagatcagctcaccacgtaagggtagtcaaggctgtcatgaaaaagccggatggcatctccaaggtcaagtgcttcacctacacggtcgaataattttcagaatatacatatgaaaaatacagagtggcatacttgggtaaatctaaaaccacctcacctttcttagcacaattgaggacgtaatcaacactgacttgatctatatccacatcatccaaagagatcgcaccaggaggcattacaactttcttgatcaagttaccagaaagcatgtagttgagcaatacatgacggtcacggcgataacgttgcagcagctcaacaacattttctctggttaagttgatatatagaaaaagcttagctcacaattgaacatgcatatactgatctataatacctattctgaaacgatcattactcgtccatatcgtgtgcaggggagacagcaatctgagttcagaaacactgttggaagcaccccaagtcgctttcagccagcatcgctctcctgcaaaacaaaaggggttaactacatgaaaaagtgctggggtgcgtaaatcggttggggctgaacagtttatgttgaaaatagctagtgaatcatgaatctgatcctacaatcggtccattttgcctgtacaaattcacaaactctcgctattaaaaaggaaatggaaatgacagccatgcagtggccaactgatgattcattcaagaatgcacaaactgagatgatccatgcctcctctcagaccggccaactcaacctccctactaaatcacatccgacatccaccagtgacagaactgagatcgcattggcccgcagctcccagatcatacatacccgatccatccatccaaaccgaattcgccacaccacagcgcccccgcatttcaaacaccgcaaaaaccacaccaccgcaacccaaaaacaagtcgagccgaaacgaagaggaagcgcatatccaagcagctccgcccaccaccaccaccaccaccatccaaggccggagggcgagggcgagggcgagcggctcgggggctgggtggatctgggcccgaggcggaggcggaggcgggggtgggtggctcgtcgagctagttacctgcgcgcgcgcggagagggagatctccgccggctaccgacgacgacgatgccgctggtcactcgccgcggcgcttggggagtcgggcaaggtggtagctggcggtggtgggcgcgactcgctttcctggtggtggtggtaagtggaggcgaggagaagacggccgcggccggggatccgtgcgcgcaggctgtggacgcgcacgaggtggcgaggccacgagggcctatttttcttgggctacaagggtttctttggcccatctcacctgccctgggcctttgggcctaattttctacgaccccagtcgccaagctttccttgtcagaataagtccactttgactccttaaagttacccgaatctagtccgtaacccacaagaatgactcctgaactattcaaaccagtgcaatttgactccctcagtggttttggataacggttttgctgacgtggcgatgttgacttggtctgtggtattgacgtggcgcttaggtggcattagaattaaaaactcagtgcgccccattcgccattcacacaaaaaaaaaattgtgggaccatatgttatccctatctatcccttcttcctcctccctctctcccttctctgtctgtttctgcgcaggatctggagcgacggctgcaccggcgccggcaccggcggcaggacgaggatcggagcggcggcggcggcactccttgctgtgtggcagcctctgcttgccggtggcgtcgtcgtcgacgtcgtagagcatgttggggtcggacgacagcgccgcggcaacgaccgcttgctccatgcggcggcggtgacggcggccacctgggtgagcggtctccagaccagcttcttgaacctgtacttcctggtccccgagaggaacacgacgaggccggcaaggatgcccacggcgcagatgtcgtacccccactggcggccgacattgtcctgcacgtacactagcacggtgattgtgagcagcgcgacgaggctgacgaagaagtagaaccagttgaagaatcgcatcattttcttgctctcgtcgtcgtcggactcatcgaactggtcggagccgaagccggagatgctttacttgagcccccccccccc

SEQ ID NO: 41547 - DNA, 2275 bp, Oryza sativa
gcccccccccccccccccccccgtgcccagcgctgtcaggtagagcaccctgagttgtgtcccgttcgtcaccatgcaattcgcgctcggccccttgagtcgctgcacgccggcggccgaagccccaacatgccgtcgagatcgtcagtatcaatgtatcatcagttcatcaccccctgcagcatgagccaagatatacaatcagtatccatccgtcatcgagcacacattagcttggttgaacagaggagtaagaggaagacacgaacagtagcttggacagcttcaaagatggcgatggttaggtagcggccgaggtacgtattggcacagtagcgtgcgggaaatgggccccgactagtgtggcgcgttgctctagcaccgctccggccctcgccccgccgccgccccagatcctgcaccgaagtggggaaagagaaacagagaagagagaaggagggaggaggaagaaggatagatagggatgacatgtgggtcccacaatttttttttgtgtgaatgacaaatggggcccacatagtttttaattctaatgccacctaagagccacatcaacaccacagaccaaatcaacatcgccacgtcagcaaaaccactatccaaaactactgagggagttaaattgcactggtttgaatggttcgaggagtcatcttatccggttttacggttgagggttacggattagattcgggtcatttttaagggagtctaagtggacttattccttccttgtccggtggagggaaaaagtacaccgaaggtccctcaacttatcatcgagtttcaaaatcgtcccccaatcacaaaaccagatatatgacatccctcaacttaacaaaaccgtttattttaggtcctttggtggttttcaccccggttttgtccgatgtggcggctgagtcagcatgggacccacatgtcaggatgccacctcatcacttctcttatttcccctcttctccctttctctctctctctcttctcaggccagcgacgggcgatgctgtggggaagaggccgccgggggggaggggagaggaggaggtccggcggccagcgtcgcgccgatggaggaaacgccgccgtccgcatcctcgttgccaccgtcgtggcacagcgtcgccgaactcatcctggaagctatgcgcgagcacgtagaggccgtagaagtcggtgggctggcgatggcatcgcaccaagtagccgtacagcgtcatttgagcgacggtgaacccctctgccaagtggaagtcctgcgtcatcgtgatcgacccctccgtggggctcgtcctctacctcgcgccgccgtccacagaacctgctgacttcggcgagctgtagtcctagactgacgtcgacggcaaggtgcacacattccgcatcaccaccatcccgacatagcactacttcatatgcgacatcgccgcccgcaccgcctcctacgtccctgactcggagagacgcgtcttcaacaactatctgagcatcatcgtcgcgccaggaggtgggggaaagtacctggccgtcgacttctagttcatcgttggcggcgacgaggccaccctcctatgcttctcgtccgagaccagcctatgggaaaagaagcacgccaacaaccccctgccccgctagatctggagattctttgacgtcgtttcccacgccggcaagctctactgggtggacactgcgacaggcatcctcttctgcaacccgttcgttgacgagctgcacatggagtacgtcccaatccccagggtcgacctcccgctagaacacgacggagactgccacggccgtggctactgcgccgagagagcgctcgcctcccgccactgcgtgcagctgagcgacggcaagttcaggtgcgtggacatgggctctgcaagcgatggtgttactaccaaggtccccatgcacacgcagattgatccagggaccaaggtgtggactcttgagtacgccgtgagcttcgccgacatctgggccagcgagagctacaaggcgactgggatgtcggagaaggccccggtgctcgcgctcgtccaccccaagaaccccaacatggtgtacttcttcgtagaagtcaccagcctgcgcaccaccgacttctacggcctctatgtgctcgcgcacagcctccaggacgagtctggcggtgctgtaccacggcggtgacaacgaggatgcggacggcggcgttgcctccgccggcgcgacgtcggctgccggacctcctcctctccccccc

SEQ ID NO: 41548 - DNA, 25568 bp, Oryza sativa
aaataagagagaggtggtgaggtggcatcctgagatatgggtcctacgctgactcagccgccacgtcagataaaaccggggtaaaaaccaccgaaggacctaaaataaacggttttgttaagttgagggatgttatatatctagttttgtggttgggggacgattttgtaactcgatgataagttgagggactttcggtgtactttttcctccggtggagtaataaagatgaagtccagtttgactccccaatcataggtcgagtctaatttgtatccctcgaaagaacggttataacggcttgttcaagtattaaaaccaatacgctctctcggcactgttgaacaacgtttttcgctgatgtggcacttaggtgacatgttgacgtagtcttcgtcctaagtaacgcggaatcacacttggcaaagaaaataaaaaaactaaatgggaccacatgtcattgataatttcacaaaaaaataagaagaatctgtggcccccctctctctctctcccttcttcctcctacctagcgaacctcatcgaacccaaccacgctagtctatcactgacctccgtgtcggagctctatggctctcagtgaagagatagaggcagacacggagaaaggaaggtagcggccagcgaaccccatcgagctccctctgtcgttgacctatgcctcaacattagagcagcattgaccgatggatgacgcttcgagcaatgcagtccccatcctagcgctcctcaggctccccgccactactcccacagcccatgggccaatagacgaggagcaacacgatgtggtcaccgtccatggggaagaggaaagcaacacgatgtgttgtggcatggagaagcttagggtcgcccagcactacggtcggcgtggttgaggtcgcgagcactgtggtgaagctccgtcaccggtgcgccactgccattttttcttcccctcctacggctgagttctctctccccgccgccctaggtgccttcttctcgtcacctccccatcatcgctctctctccacagctgcaagtaactctgtatgtttatatttttataatagtagatgtacagaaatagagttatatgcccagttgaactttggttcgcccagtaatgcagtttattttcttcgtgcaacaagcacacaacacatgtacataaccattttgtgcgtgaaggtgttggtttttttttttcattaatgcatgcaatgctgtctaggacatgttacatgtatgtacattccgatcgatcaagttggttgtacagagtgaatcacgaagaattgattcataaattttggatcaccatatatcgagcgcaaattcctaccggaaacacataatgatgatcgatacggagtatgaaacggatgacacacatcacagaaaacggaacagcacatcacatataattaattaagacaccagctaggccgatctcctgctggaagtagcccagaaatgatcacgacggtaacttttgccgcgcgctaacacaacgttgttaacccctgttcttctgagtgacgatgagttaattaactagagatctccatcagagtatcccatcgaacgggggctcaggtcgggcatggtggcgccgcgcagcaggtgatcccggaacgccaccccgatgacggcgagcgcgtcctccgcgctgccgatgttggcgcgctccctcagcacgccggtgaacggccccccccacgcgccgccgccgctcctcctccaccgcgtcagctcctcccacatggcgtcccagtgctcgatgtacggcaggtgctcgtcggcgacgcgggcccccagcccgccgaacaggagggtgtccatgaccggccggagccgctgcgcctcgccgatcgccaccgtgagcgtcgccagcgcccgcttcagcgccgcctcgccgtcgccgccggcggcggcggtggccgggtcgtagccggagagcaccgtggcggcgcggttcgtgaagggcatcgagatgggcaggccgcgcaggttggcgacgccgccgacgaggtcggcgtaggtgttcccgaacgggaggcgggccgcggcgagcccgagggcgtcgaacaggtgcccgttgccccgcagcgcgtgccagtggccgctccggttggcgaagccggcggcgtggatggtgtcgaccctcatggccagcgtccccgcgccgctcccgtactccagcaggtcgaccatgatcagcttgcccctactcgtcgccgccgactccacggcgacttgccctccgccggcgagcaggatgagcgggatcagaaggacgaagaagagcgcggccatggcggcgacggcgaggcgagtgcgcgcggcgcggcgtcgtacgtggtgcaaccgcctctgcattgcaagagaggcgatttttatcgacggtaagatcgaggcggacgggtagtaactagtaagcaggtgccgcgcgcgatcggcgtgagcgagcgaaaatttctggtttatcggatcacccggtacgaatgatttcggtttctcgtgttttgaatttggcagaaaattgtttgaacttgaccaaatttaatttaaaaattcaaattattttggaccaaaattaccgattttcggccatatcggtgaccctgatagaaatagcgaaatcgaaaaattgaaccctgccgggaatcgcttgaccggcgaggtgaagagtagagaggtcctcgtcaacgctccggcgagacggtggggggcagggcggtgccgggagagaaaaaggttgcaaagatttgcaggtggtgacacacacatgatcttttggtgtgtttgctgtgccaggggctaactgaaattcatactgctgtgcctgtgctgatcgtgtttttttaactttacgcagctgaaagtgggacagacttgcaggcggtcaaggatggaacatctccagcagcgggatgccgaaccaagctaaccgtgatcaactcaccacctacagcaatggccgatacagaattacagacattcattcaggctgtgtgttagatcaggggtgaaaagttttgacgtgtcacatcggatatacggatacacatttaaagtattaaacatagactaatgacaaaacaaattacagatttcacatgtaaattgcaagacgaatttattaagcctaattaattcgtcattagcaaatatttattgtagtaacacattgtcaaatcatgacgtgatcgtgattaggcttaaaagattcgtctcgcaatttgcacgtaatctgtgtaattaatttttttttcgtttatatttaatactccatatatatgtccaaacattcgatctaacagggtgaaaaatttagccagaggatctaaacagaccctcggacatgttcccattcctcgggaaactgctttaatcacccattcctctcagaaactttggatgggacacaaagtagtaaagagctttaactggcaggaaaatcccttaagcacctatgtgcagttgggaaatagatcccctgactttatgcagtctacagttgtgtcactggcagggcccacatgtcagtggcacaactgcaaattgcacactagaactagccaccacatgtttgcatgtggattcagatatatccaggtgagaaaaacaatgtcactaggagaaattatagcatgtatcagagcatttccaacaacctctccaaattgaactctccaaatacccatatagcaaactctccatccgatttggctagccaaactagttgttcactccaacaacctctccatctaccctctctactttgactctatgacatcgggacccatatgtcagcctctcccttcttcttcctcctatttcttcccctcttccccaccaaactcctcttttatccctttcttggttcttcctcctctcctctgctcttgtacgcctgagattgggagggggtggccggcgcatggtggtggggggttagcgcagggcggcgcgctggggaggaggagtccagggcgccggtggaaggaggctggggccggacggcgtggtgcgcggcggttcgatggctgagtgcggcggcgcggcagggcatggcgcgcggcggcggtgtaggatcgagatgtcgactagaggggggtgaataggcgatttaaaaactaaatgacacctaaacaaaactaacctaagttgctaggctcggtgagggttaagtctaactaagtaactaagttatgttttgcaaacctagggtgatagtggctcaattaattctctaggaaagtaaatcacactcctatgtcaatgttttgcaatcctagggtgatatgatctcaagtatgtctctagaaatataaattgcacaaatgtaaatgcgacaatcaaatgagataaggagacaagagatttttcaccgaggttcgaaaactcgccggtttcctactccctgttgaggcgagcccaactccaccgctcaaccatgaagccaccgcacgcccccttcgtcaaggggtgggcaaggtggaaagcaggcccacggggaggactacccaagcctcgatcactcgtggtagttcttccttcactccgaaggtggtgaaatccaaaccactcacaaaccggcaccgggcctcctccacaatcttctcggagaggtcaccgggcaactcctccacaagccgtctaggaggcggtaacctccaagagtaacaagcgatggcgcggctcggagatgatcaagtgccacactagctctacaatggaagcaattgcacttaactcttggctagaacaaccctcaaacacactagaaggatgaacacaaagctcaagtgggtgtgtgagagatgaaaggggtgtatgcaattgaagtggtgccaagagagtccccttgctgctggagagggagtatttatactcccaccaaccaaaactagccattgggggagaaatcccctaactctgtgtactgccgctctgaccggaggtgtgtggccggtcagacagtgctactctgcaacggctagaaaactagccgttgtagccctgttagagggccccattagcctggccggtcagaccgcaattgagtggccggtcagactggcctcggcttggtcagaccgccctcagctcggtctgaccgaatatggcttcatcggctctgtatcggccaccttgagcaacaccatcccagcctccagggggccggtctgaccgcacaagtgtcgtcagtcagaccgaccttgtgcgccggtcggaccgcccgcttggggccggtcagaccggacagggcacgccggtcagaccgtcactaggtggccggtctgaccgcccctggtcaggccaaaacacagtgaaactgcgtgtgttgtgaaaagtgtgtgtgtgtgtgtgatgaaatgtgagcacaagtctaaatgcataatgacctaatgtggcaattaagatcatctctttgctaggtcattacccctcttaatagtacggcaaagctataaataaactagcacaattttgatcgcccaacgcctcgatcaatttaaaaagaaaaacactagttaaccgtcttctattccttttgctttgcgccgttaattttaatccatcgataatcatccatgcgcacacataatatgaatctaacttaaaatatatagctcaaagacaacagttagtccacaattagtgcttgtcattaattaccaaaattaacaacgggggcctagatgcttcaggcagggcgctacgcggtggggcggcgtgtggcggaggcggcgcagagggcagcgtcggcacagccgtgcccggctgcgcgccggccggcgcagcggccgcctgaaggcagcttgtcggcgtcgaggaagggggcggaggcaggagtgaggggcgccgacggtcgcggcgagcgaaggatggcggctggccggcgagcggaggccggtggctgcagcgccgcctcgctgcaatccgccgccctgccaccgccgctcgcatgggagaggatgcgcgcacggatggcggcctcgtcgttgtcgtcgccgttgtccaccatcacaaggggtggccctctgctcctcgccggccttgcctgctcctccgctgcctcatcgctgtgtctcgtccacgacacctccgcctccaccgatgatgactacttcttgtcggacgacgtccacgatagcgccttcctgatccagtcctcctcctcatcggtggcgcgccaaggaagccgaggcagagagaatgctgagaaagagaggggagagaaaagtatggtcatgggtcccacaatcccaaggttggcgaaccagttttggctggccaagtttggccagctagggagcccatttagccagtcaaatagcttggagagtggaatagctagtctgttggagctcgtttttttttttcaaaattaccaaattttagcttggagagtgagatagctatactgttggagatgctctcatgagacgagaaagacaacggtgtgggggctcctcatcgcggccggatcaagggggcgtgcggtggcgatggaggagagggccacactaaggggaaaaggaaaagagaatgaaggtattattacttgtgattatcaatcaaaaattgaattgtcaatcttaaacttagagttgattttgaggttttttttatcgaagtttattttttaacctttgatttaaatcgttaagaacacatatatagaagttttattcacaagttacatatcagttacatattgttgttacatgcaagtttatattacactatagttatactatatttacatttgattcttttttttaaggaaatctgtcgataaaatatcgcaaaatctatttcgagaggcatctcgatttaggcttaacgagcgacgcggacaattacgtgagaagtactaatagcgctacagacatgcatgcaagtagtttttgctattaggttatacattttttttcttcttatgaaattttctcttaaattacttatccgatctatgatccgattacaccgttgtgttcgtaacaattaaatctttacaacaagatctcacatgattatattttgatgaaaaatcacaaattacttttataacatgtctaaattacttttagattccactaagttacttcttagacatacaaaagtaaattcagtaaaggctaaaaataatttacatatattatagaagtaacttagaacaaaacaaatgtaactttggcatgtcatttgaaataaatccgttgtagagataaaaacatgactctatctagaaattaaattaatcagcacaaattataaaattaactaaaaacaataatgaaagtaatcacctcagagcattatgaatgtataggaagtattttaatcaaatctaaaagtaacttatatatgataattatatatatgataatttgttcaatgaaaaaatgtattaattaaatttactttctttttgttataagttaactctataatatatgtgaattacttttaagctttactgaatttacttttgtatgtctaagaagtaacttagtgaaatctaaaagtaattaagacatatcataaaagtaatttgtgatttttcatcaaaatataatcatgtgagatcttgttgtaaagatttaattattacgaacacaacggtgtaattggatcgtagattggatgagtagtttaagagaaaattgtgtttgaagtatagctaccattagctgtgtagtgatgtctatgaaatatgtagtaaaattttaaccggtgcttgccggtaggtgttggcctgttgggtgcgtaacaaaaagtgcgtgactgatcaacgaaccaatcacattcgttcttctccacccagtgctacaacaacctataaaaccttctcctcctccgcacgtacacatccagaatggcgctctttctgccactactagtggcggcgtcgttgttctcgccagcagcagcgctgctcgccggcggcgagcatggcgtcgtcgtcgtcgagccgaggcaagtggagatcatgttcgacctcgccacgcagtcatggtaccacgagctctacaggcccctcaaagccgcgctcaccgacgacggggccggtccggagctcatgggccacgccgtcgtggacctgctcgacgacgaccagccgccgtcgaagcagatcacggtccgcctgttcgccagcggcggcggcggcgacgaggcgaagctcctcgtcgcggaggacgacgcctacgtggccggcttcgccaaccggacgggccactggcacacgttccgcggcgggcgctgccaccacccggtgatcatccccgccggcggcgcggcgccgtgcacggagctcccgttcgggggcacgtaccgcgaactcatcggcggcgtggccaacctgcgcgccgtgccgctggggagggcgtcggcggagagcgccatgcgggtgctgtcccgctacgacccggcgaccaccccggccgccgacgccaagatggtcgtggccaagttcatggtgatggtcaccgagcccatgcggctgaaggccgtgtcgcgcgccgtcggcggccggtgggaggaggagagctacctgagctccgacgaggccaagtacgtgccgtactggggcgagatatcggccatgctggtggagtggaacagcaccggccggtggggtgagctcggcccccggagcaagatggacagggcgcggtgcccgcggcccgccggatgcgaggacgacggcggcgacggcgacgacggcggaggcaagctattcatgatataagatttcatgattgtatatgcacggtctggtctgatcggttcattgtcggcacttccataatctggagtgattaggttgatctgcacctgtgtctctgtgtgctctgctgctaattaataaagtctctgctgtgttttggttgatcaagtttgcttaattactattgttgctctaattttacaagctgtaatggaagaagttaattaaacttggtcttgccaaagatgtagaatgaacaaattaaatgggagggagaggatggatacagtggccgttagatctagtatgctcggtccagattaaggcagcaagcagagatgggatattaactatatactctctgtcccataatataagagattttggagggatgtgacactttatagtattatgaatctggataaagtgcctgtccagatttaaagtatcacatcccttcataatcccttatattttgggatggagagagtattgttaaagtattaaactcgtgagaacaagttaaccttaggacatgtttgacgtataatatttgaataggttttaagtcaggttagcttcaccgaggtatatataacacctcttccacaatgcaaggagggtgtgttaagctaagccgcacccatcttttaccatttcaccttttagtaagatgagataattaaattaagttgcagcacataatagtgattttttttattttttacgagtgatccttagggctaatgggatcatataaaggatcagtataaggatcactctataatatacatgtagccttaatagaggggacttaatacgtccacctattttcacatcatcacaaatttgtgtcggctttccttgtgagttgtgacagtgagactgtgtgaaaagcaagctataaggggtgctttactaactacttggcggaatgtttggctagaaaggaataggaggatttttcaaaacaccccttgctcggcaagtgaagtagctcattttgtaaagcaagacttagcaagatttccgaaagacggccttagaccaccttgaggttcttttgattgcttgaactcctatcccttcaatgggattgtaaatgcttttggttttttcctcctttcaattaaattccagtagttctcctgccggttctgccaaaaaaaaaaaagacagtgggactgtgcgagtggccacacgaaccagcagaatcacacatacagctcgggagaacatgaagggctatagctagcttaggtttcctcacttcctctggccaatttcactgtgccgctttcattgatgattattagatcatggttgtctcattggtgttcaccgatggatcagcttccattgagtacaaattaatttgcatcatattatctcaaaatttttcaatacgaactgcccttctcaatttatatcagagaatcaagtttttttaaaaaaaaattgaagaagcaggagctcctctactaaattaggacgaataatttggtctagaaacgaagaggagacagcgcggtgaaaagaccggcagctgcctcacgcgcggcgcaccgggatatttaactttttgctacactttcataatagagtaaactatacccacaatacataatttggtagctgtgtgtaatttggtgcaagaacatgagaaatgagctagtgccttttataatagagtaaattgcacccacggtacatagcttggtaggtttgtacaatttggtgaaaaacatgacaatgagcgttttagtgcaacgactcgacagatgggtataatttagtataagaagtttataagtgatcgtataaatacaacaactttcaaggtagatacgattttgatacaataagttaagaatttatatgataacttaattatttggtgtattttttatacatgtttaatttttaagtacttattttgacaatttactagtgtggatttgtttaagcatatttatatttttatcgtaacaactaataactgaaagtcaatataagtggatgtagaaattattatatatatttcggttgagatttaaaaaggtgaaggaaacaaacattattaaaggtaatgggatgtaaattggatgtgcaacgtaatttttaaagactaaaatcaatattatgatgtaatatccgtaggattgctgtgtaatggtatattgatatcgtgaaaaaaaaactcacctaagatatacttaactaatacttaactaagttgatgcaccaaaatactaataacttatcaagttcttgtactagaatacacctgcttttcaagttgttgcacttggacgttcaattctcaagttttgcactatatcacgcacacctgccaagttattgaatcgtatgtgcaatttatactctaataggtcctcatatgtgtgtggatctaatggtaaatttttaatggaagtagctatatttatggcgccatatttttcaccaaaagttagtcggcatgtatttatattgtaaggcactaaattacatatgtaattttagtgtatttacaatgtaagtcccaaaattacatatgtaagtactaaaattacatatgtaagtcacaaaattacatactaattacatatgtaagtagtgtgtaaatagggtgtaactactgtctaaatatactactaatatatactaattacatatttatactttaattacatatgtgtttcgctggtcggtacaaatactcatacttgatcgagtgcatgcagtgaagaaaaaaatagtagcaaagttctccagtagaccgctaattagcaacctgtaacctatgaagcacaactagttacgcgtaattaagtatgcgagcacgaatcctatgaccgatccaatggctcaacaagcgactgtaatcaaccagaaaatgtgtcgccaaaaatttagcaaaaccgtttttaattaccacgttaataaaaagtttaattattcccggcgcgcttgcctccgggctccggcgccgctcacctgccaagccactggaccgcgctataaaaccgccgtcgcactcttgcgaacccgagccactgtgctgcggcttgcacgccttcctcgccatggccaccgcgctctccgtctccctcctcctgccgctcctgcttcttctccatctcgccggcaacctccccgcggtcgtcgtcggcaagccgcacatcgagggtcccccggggcccgagatgatgatggtggatctgcgggactacgggagcggcgtgggtaccttggccgtgaggatggacggcctctccgtcgccggcttcgccaaccggagcggccactggcacgccctgcgaggcaacgagcacctgttccgcgtggcggcggcgacccctctcccgttcggcagcagctacggcgatctcgtcggcggcgtcaagaacctgccggacctccccttggaggaagaccccgccaccgtggtgatctccgcctacgaccccgccgccgccgccgccgacgacgacgacgaggtggagctcaagcgggcgctggcgacgctgacggtggtgatctgcgagacgcagcggcttcgccccgtcatggacaccgtcctggcgacgggcggcgggcgccgcggggcggctcgcgtcgccgccgagcacctgccgtacatcgagcactgggacgccatgtgggacgagctgaagcggtggcggaggaccggcgagtggggcggcgggccgttcgccggcgagctgcgggagaggccaagatcggcagcgcgaaggaggcgctcgccgtcatcgggtggaccttccgccatattctgctgcgccgcgatggctccatgcctgagaggaggaccgaggacgtgccacgctatgggacattcgtctgacctctaactcgcgagtatgacgttgtagtagcggcaagtttatatcgttgacgtgcgtgctgtttacaagagcagatcaggtggctatagcctatatattgccttgatgaatttttttgagaattaatattatttttatggaaaatcgcaaaagtagtggccaatcggggaaaatcgcaaaagtaggtccctgtcgaacgggtgcaattcgatagggcacctatcgaacgacgggcagtcgacaaagccctgtcgaacggctggcgttcgacacgctcacttgtcgaacggagggaattcgacagggcccaccacccggcgccgcgaggcctgtcgaaccgggggcgttcgacagggccctccaccgaccctgtcgaacaatgggcgttcgacaggccggcttaaagccccgtccacccaggccgcgagttcgatttgtttgaggaccacatcgccagccgccgccgagagtcgccacatcgtcggcgtgagcgccggagggagcgaggggaggggatagcaggccagagaggaggctgaggaggcgccggccgggaggaaagggttggtgacgccctccagcagtgaagttaaggtatacattagtaatccctaagtacaatgcatatgaaagtttaataaaaaattggtttaagagttgttaattgtttcgtattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgtcttccatgatactagtctgaatgcaccggagcatatgggtttgaacgacgtgttagggtggttgtataatatatttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctagcaatagtggtgtagaagacaacatgtgttgatcgatcgggggagtcaagtcatgccgtggtggaagaaactccgttggaaggtggacaagctgaaaatgtttggcggatgagcaaggtcgaggggaagaagtagtagagggtaataccaaggagaggtcattgttcgtggtactaatcgtgaggccaacgactcggacaatgaagcaccggattcgcctatgcgtgttgatgcagcggaggagaatcaggcggtagtggatcagatggaagtggtaaacgaggaataccttgcgcttggtggaaggagaagatacaaccctgtagggcaacaaaactaacatacccgatgattggacggccatatcaatgagttgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatttccttggagagtgcatggttacaagccacaacatgacactttatgggtagcttcgagggttgagcaacatacgtgtttgttggagaatacccgtctggtgcacagaaacctgacagcggcatttgttgcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaatagaccaaatgtgtgtgttctacatgaccgacacgccggtttgctatcagcgatacagaagcttcaagaagatgtcacacagtccgtgccatggccagatttacatagcagacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggctcttcgctgccactggcgttgttcgagtcgcgtgaaccattccttatctccatctgaaggagataggtagaaatatgagaaaaggaagaaaaacagggggctcagaaactaatctttcttatgaatttaagtgcaattatcttaatcttgattaaaacactgaaaaagaggcacacaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgattttatgcatagaacaacatttttcacgaaccgagacaaaagacactaatgcaactgactaaacaataacttaatgcatgaaatagatgcatagtcatactgatacgcataaacttaccccacctgaacatagacacgacctaatgcatatcacccgacaattcccgaccgactgccgaataaattccgaataaacttttactaaatccctagactgtcccaagtcgagaaatccaattaaataagcgaccaagatttttcccacaaatcaaaagaacaaaccccaaaattttcccgaaacaaaatccaagtgcaaaagggcatatgcataagaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccaaggcacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaaaccaacctctctgagacggctccaactgagaagaacttcaactctggtgtgggggaaaagagagcaagactgagtactacccactgtactcagcaagtcataccggaagatgaggtatgatgcaggatataaccaaaggaagctaggggttcttttgcataaagcaggcatttcaaagcagtagttgaaagcagtaaaacagctgtagtatacccaagttatcaatggcataaggtaaccaatatgtggctgaggaataggacccatcccacattacattgtaaaagaatgcaacatttaatagaaatgcaggatgttggtaaattgggtacaatatgatcaaacgtattgcatgacttgccttgctctcgaactgatgagacctcagcaacgtcttcgagaaaccgcggatcaacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccagggggacggtggcgccgacaggcggggcccatgggtcagcttctcaaaggggagaggaagggggcgccggcacgtgggccccacgggtcagcggctccaaaaggagggaggtggcgcctagcaggtgggccccaccgggcggtggctcaaaggggaggcgagggaggcgccggccgggctcggctcggcctcaagaccgaccggccgaccaaggcgaggcggcggcgaggcacggccaccgacggcggtgaccggcggtgcgggaagcggcggcgacggccgaaaggcggcggcgcttggccgaagcagcggcgtggccggcgctcgcgggaaggtgaggaaaggagggggagggaggactcaccggcgacacggcggccggagcggaagacgaaggcggcgacgacgacctgacgagaggaggggcggacgagcggcggcgacacctagaggaggggaggagaggagttagggatggagaaggcgaccgcgacgaccaaagtggctggccggagacagaggggaatggatagctccccggctcacgagggagatggggttccggtggggttccggcgacgcgaggcggtggccgagatggcccacacggcggcggagctagcggcggcggcggcttggcgcggcggcggccctagtggcaacggcacgcggccggagatgggcggcggcgacggagctcggcgagcgtggcgcgacggcggtagagggcgtgggagaggacggtgaatgggggaaatgagagagagagctcgagtgagggtttttatgggcgagggaggggcgaaaacggccggggatggcccctatttggccagcgacgtggagaggtggaggagagagagagggtgttgggggatttcaaatcccccaccacttgcgggcgcgcgcgcgggagatgcggggagagggcggcgacgtgggcgccaggtgcgggcgcggagtggaggcgcgatgtggagcggagaaggcggcggcgcgggcggttggagctccggctccaacgaccggaggtaggggacgaccgacaggtggaccccacctgtcggcgcccgaaagagaaagggagggagggaggacttcggggaggggaaaggaggagcgggccggcccaggaaaggggtgccgagcgcggggagagagatgggccgacggcccatctagagaaaaaggaaggaaaagaaaagaaaaagaggagaaggattttcctgggattaaatattgcactttggtgatttttaattggttaaaattatttccaaggctatgaaaattccactaaaaatcttgttaatgcattggagcatgggaaactcaagaaaaattccaccacgctatttccgattattaattgcatttattaactagggatttagctctaggttaattaagataatttcttcgggcaatttatttaaccaatttttaaagcaagaaaagggggaaacttctgggcgtgatagagtagctgtgctgaatttttctggaggggctttgcaatggttacagtccactagagctcatgaaacgtgtagaaattgggaggagtttgttagggcagtgtgtgcaaaatttggtaaagaggaatttcaaactctgattcggcagttcaaccgcctgcaacaaacgggctctgtggttgaatatgctgagaagtttaatgggatcatgcatagtctccatgcacatcattgttcatggagtcatctcttttttttttactcaatttattgatgggctgcgagcagagatcagagctgctgttattttacatagacctatcgaattggatactgcggtagatttggcttgtttacaggaggaggttttggaatctgttcgaagggaaaatcgtagagccgaggttgtgggaggagcacgcggcagtttcaaatctgggggtttctcttctgtgtcagctcgtgcaattcctggtgttggtggacgagcggatgatcggcgtagtcaggatgatcatcgcacacctgaggacaagattgcagccctacaagcctatcgtcgagcgaagggtttgtgtcacacatgtggggagaaatggagtaaggaatacaagtgtggaccaacagtgcaattgcatatagtggaagaattgttgggtatgttccctagtgaggctgctgatgggtgtgacagtgattgccgggaagatgaagttactgaatctgagggagttctctgtcaaatctccaaagaagctatactcggtacttagtcagctcgttctgtcaagttgcagggattgatacaacatcatgaggtgcttatgttagtcgattcgggcagtacgcacagttttgtttctgcagaatttgctgataagctttctacccagcaatatttctgtccagctattaaggtgaaagtggctgatggaggggtactgagttgttcccgggaattgtggaattgtcagtggtaggtacaagggcagtcctttgttacaactttgaaatttttgccactgggttgttatgaggtaattcttggaatggattggttggaagatcattcccctatgcaagtggattggtgacacaaaacgctatcattccaacacttgggttctcctgttactcttaagggagttcagtctcgggtggatacttgtccggttatttcagcacttcaggtgcaagggttgctacaccggaatgccattgtacaaactgtcgaactgtgtatggtcagcactgattcagctcaggttgccttacctcctgaaattgatgccctgttaaccgaatttcagtctatttttgatgaaccacaagggttgccaccatctcgagtgtttgatcactctattccattgcttccgggtgcaaaacctgtcaatttgcatccttatcgctacaacccagcacaaaaagatgaaatcgaaaagcaagtacgtgagatgctgcaacaaggtgtaattcagcccagtgccaaccctttttcttctcttgtccttttggtactgaaaaaggatgggacatggcggttttgtatcgattaccatcatttgaatgctattattgtcaagaacagatatccccttccaattattgatgagttgttggacgaattgttgggtgcttgtgtgtttactagtttggatcttcgagcaggctttcataaaatccatatgaagctggaagatgaacacaagacagctttcaagactcacaatgggtattacgaattccgggtaatggcttatggtttgactggggcagcggctaccttccaatgactcatgaacaccattctgtcaccattattgtgcaaaggagtgcttgtgttcattgacgatattttgatttacagtaagacaatggctgaacatgtgctgcttctgaagtcagtgttccaactgcttgctcaacatcaattgaaggttaagcgctcgaagtgtacctttgccagttcacaactcacatatttggggcatgtcattagtgatgcgggtgtgtccaccgaccctaagaatattgcagctgttgttcgttgggcagtacctcaaaatgtgaaggaagtgcgcggatttttgggcttagcaggatactaccgcaagtttgtgcgccattttggggtgatcagccgtccccttactgatctcctaaagaagcatgtcgtgtttgtttggactagcgagcatcaagctgcttttgatgcgttaaaggcagctttgacttcggcaccggtgcttgcacttcctgactttactcaaacttttgagattgaaactgatgcttcagaccggggagtgggagctgttttgatgcaaggtggtcaccctttggcttttcttagtaaatctcttgggcctcgcaattgagggttgtcgacttatgaaaaggaatgtcttgctatattattggcagtggaccattggcgttcatatttacaatttggggagtttatcatccgtactgatcaaagaagccttattcatttgggggatcagcgtcttgctaccctttggcagcaaaaagcactcaccaaattgcttggactgcagtacaaactggtgtataggaaaggtgttgagaatcgggcagctgacgctctgtcgcgctgtgactctcctgagattcttcagttaagtgctttatctgtgtgtgttccctcctggttggatgaggttcgggacagttatgctagtcacccacatacatccagcttgctttctcaagtacttttgcaaccagaatcagctcctcattttagtgtaacagatggagtattacgttacaaggggcgcatttggttgggccataatgtgggactacagcagaaggttcttggagcattgcacaatgctgctgttggtgaccattctggagtgcaggtaacctatacccgattgcgcagactgtttgcttggcctggtctcaagaagtcggtgcagctctttgtggattcctgttctatgtgtaaacaagctaaggcagaacgggtgcgatacccgggacttcttcagccattacctgtcccagaacatgcctggcaagtggtgtctttggattttatcgaaggattacctctctcattgggattcaactgcattttggtggttgtggataagttttctcgctatgcacactttattgccttggctcatccgttcacagcttttgatgtggctttagcatatatgcaaaatgtgtacaagcttcatggtctgcctcaatctatgatttcagatcgtgactgtatcttcaccagtaatttatggtctgaattgttcaaattgactgatactcagttgcgcatgagttcggcatatcatcctcaaactgatggacaaacggagcgcgtgaatcagtgcttggaaacctttcttcggtgctttgtccatgcttgcccgcgtaaatggtttcggtggttggcgttggcagaattttggtacaatacaactcctcactctgctctcggtaccactccttttgaagctttatatggtcatcctcctcgccacttcggtgtacgttatattgctgaatgtgcggtacctgacttgactgaatggttgcaagagcgtcagatcatcactaatctcttgcgtcagcaccatcttcgtgcacaacaaaggactaaatctcaagcggacaagcatcgttctgatcgggtcttcgctgttggggattgggtttttctgaaggtccagccatatgcgcaaacatctgtggctgcgcgtgttaacaacaaactttctttccgctattttggtcccttttaggtgacggcgcgtgttggtccggtggcttaccgtttgcagccgccttacgactgtgctatccatcctgtcgttcacgtatctcagctccgcaaggcttcacctccacaatcagctgttgcagttcggcctcttcctcttgttgagtctgaagaattgattccagttcagatcatcgctcgtcgtctgtacaagcgtggcgcggctgctgtggagcaagttaaggtgcgttggatggggcaatcgtcttctgatgctacttgggaggatcttgctgtgctgaagcagaagtttccaactgtgccggcttggggacaagccggttgcccagaaggggggcatgttacagctgatgataaccctatcaagactatcagacgctcagctagagagagacggcccaacactcgtgtaactgggccggagtgggtctgaaagtgggtcttgggtatgtgtctataaatacccaggcgtgagtgggaagaggtaacgaatgagaaatctgtacacagaactatccctcaatctaatacaaatcctcttcctgctcatttgcttctctgtctttttcctatctgcttcccttgttcttcccgttcttccacgcaaggtgttcgacgaaattcccttgagaaagatcgtaacactttaatagcaagataaaagagcaaagcttcgatcgatcagctgggatgaaaacagaagcgatgaaactttaattaggagttattaccttcatacttgtaacatagaaataaatgttactcaatctagttcttcgaatctagattatggttataaattttattttgggccaaaatctctatgcgccaaaatttacgaacaaatcagtaacttctatacttttttgctagaaattatttgcaaattcaacaaaatttgattgagttttaataagctttgaccaattttttttaaaggaaattaaaaaccaaaaattccgggtgacatattcgcttgtatgtagggggtgaaactatcagaattaacaaaattttgctcagaaattgacaacctgatcttggcatgattcatattcctacaatcctttgtttcgaatgcaaatgagaaacgttcaggggttttttggttagctccacagagtagtgggctagacgatctgggttcaaatcctcactccttttaattattgatattagatcatttcctaatattcccatatttgtttgggatgcaaactaaagttgttaatttagaaacagggcggtggcacataacgaagcaggattaattaggtgtaacgtagccgcctttctaataaatcagttattatggaggatatagctacctaacattatctcttgtacatgtttatagatataatgacaaacttgattttcttattgcgcgtagttaattggtagtctctatctacacacgcaaaagttgaccttgcgtgatcgagtacgacatattttttttcttactttatcacacaaaacctgctagtataatcatatggaattggccctacctacctaatccaaaaactcactcaagctgattcaagctagcagtccaactctcactctcgtaactcttgtatgcatgcatgcaaaataccaaacaacaattaagtaatattaagcacaacagtaatatgtacgtggtgaatcatttcttgctaattaattaagctactacacaaagtgacttagtgacacacgggtagctagctagtaggatctcttagatacttatatactccatccgtcccaaaatataagcatttttagcatagtaataagtcaaaaaatttttactttaactattaatagcaaaaaaataaaagatcaataatgtaaaattgatgttactagatttattattaaacaaattatcataatatgcaactcttattatttaaaacatttacttttatagatattgttggtcaaagtaacatctcggagaccgtgtaagagtctaaaaatacttatatttgggatagaagagtacttttgttgttcttgttaataaagtttgatgtttagagcgagagctataagaaacctgaatgcagaggtggatgagagagaagaggagaaagaagagaaacaagttgtaagcatacaaccggtttaggcacatgaatcaaaaaaatatgtgagactgacatgtggaccatatatttatagtaaagagttaaccactatctgagtaagttgagagatagactataaagatctatacaataagtagccggttatattattagtcttgctattattaattatacctttattaagcagtattattttgtgattaactttttagtggcaagtatagctagtaactaaagctaggcgatgttgtagcaaatcttcttgaactcttctagatggttctcgaagagtggcacgtagacgtcgatgctgccgtcgccgaggaaggaggggacgaggaagatggtgccttccatggcgaggtaggacggcatgaagtacagggggcagccgccgccgaagtcgaggtcgtagaagctcatgcccagccagctgtccacctccatgtccgggcacaccaccacctcgccggcgtcggcggtggggacgaggccctccgcctcgacggcgccggaggacgcgaagtcgacgaacgagcggaagtaggcgtcgtcgatgcccgccacggcgcggtggatgagctccgcggcgtggtgcgacgggcgcgcgacgagctcgccggcgtcgcagcgcgggaacgcccagagcaccaggttgccgaagtagtcgcgcggcaccggcgggcgcatgcgggcgcggccgttgacggcgatgcggaccctggtggtgg

SEQ ID NO: 41549 - DNA, 9588 bp, Oryza sativa
cccgcgccgtgacggcgggagccccgacgaggcccgggacttgagccgcgccacgaagtccttggtgtagtgtaccttgtgcatcttgatcttgtcgtgcgccggcgccgcgccgagctcgtcgtcgtcgtcgtcctcgccggcgacgccgctcttgatcttggccggaggcggcggcgccttgtactccgtctcgcggtgcgggaactcgacgagcggcgggtcccgcggcacgaaccgggtggcgcggtcgcggacggggacgcccacggcgggcagcagcccgccgcggcgcgtggcgagcccccacgccaccaggaagcccgccgtggcctgcccgtcggcgacgcggtggtgcgccgcgacgccgagcaccatggacccgcacgagaaccgcgtcacctgcacccgcagcagctcctcctccgcgggggcgccgtcgacgctcgggtgcagccgcttcacctccggcgacggccgcctcctgatgatgaacggcgccgccgcggcgagcggcgcgtccacggcggcctcgtcgagccgcgcgccggcgtcgctgagcagcaccgaccgccgcccgtcgggcccgacgccgagccgccccgcccactcccggtacaccgccagcgtccgcgccaggccgagctccatcgccgcgctgggcgggttcggcggccggaacgcgtagatgatggcgatgctctcgtcgtacgtcgccgtgtcgaacacgctcagcggcatccactccggcgccggcgccgccgcgtcgtacaacggcttgacaatcctcgagctctcgaccttaaccttcatgttgctgcatgcacgtagaaagctagtgaagtatcttcttttgcttgtgcgtggttgcaaactttgctactactatggttttttttggttggttttgtctgccaaatgtggctcaaaccaagcatatatatagtgcaaatttgatgacggatttacgtgaaatgaagtgagaagtggtaagtcaagcaggagagatttttgaggttggatctgggcttgaagccttgaacgaccggttttgctgcactgggaattccataggttggtatatgggttaattagtacttaattatgtgatcatgacatggccgatttctggtcaagtcagctaatggccatccggctagagacaaaaggggaaaatccgagatcatccaagtaacacaaactacaaaatgcaagggaatatgttaatgagttaaaaactcagctgattagccatttcagcgaaaccttacctacctgctgtatatcgagagcctcatcagttgcccatatatgtaaaccttttatatatttactcatagtgacttaaaatctactgctaaaaagttatgtttaaaatgtcttaaaatcaacttaaaaaatcaagtttaaatgttcagattctgcctttttactccaacttagaaatcacatttaaaagttcaaattttggcttttgcttttacttgttaggttaaccaatgggatctaagtgatcagagcatgtaccactattaggcattagccattaaggctctgtttggaagattagcccagggctaattttgagagctaatgtttagtcatgaattggtagactaaacattagcctagagtggtatatttggatccatgagctaattcaaagctaaaaggtggagagagagagagttgaaagagaggagagaggagggagagagagctgctttttgatggtccctacacaaaattagccccattagcacccattggagggactaatgttttgaggggggctaattcactttagccaaaaattagcccatctgtttagatccttgagggctaatttagagctaaaaggtggggactaatgtttagcccatggaaccaataatgccctaactcatggagaaacgctattagccgattagatttagcggtgtcggaggctttgtcattgctcctggccggctggatgagcatggattctgtttgttggaatgctttattattgaatctggaaaacttgtaaaattgttgcggaatacgaaagatctttgtcactaggctccacaatagcgccggctccagtagttctaaatccaccatacatcctaatcctttgtgtcgagtgataggagtaggttgcgttgatcaatctcatcctcacttccacaatgccggccgttagatacaaatgcaactgcgaaaatcaaacacaagttcgtcacttcacaaggtcgccatctcaccgagagggtacccaaagaaaaaaaatatttatcttttaagccttcactaaaataaatgaaaaaaaaccatgttaattacttgcaattctgaaaaaaaaacggaggccactaatctacgggtttaactatgtgccactcttaaaatgtgatgataacagatttgtcactcgctatctatgacatgtggaccctcatatgtgtatggcatgtgggtccagtggcaaatctgttatcatcacttgtaagagttgcgaaaagttaattattcctaacttagcagtcttttgcaggcacgggtccttgcctccatgccatgcatgtatcgatgcacgtacatacctagtttgtctggagagcaatcttatagtacttggggaggtaaaaaaatttagcgaaaaatttggtacattataatacctaagtaccaagaggtataaaattataatagaaaaagtggtatctcatgataccttcttaaggactgtaaaattgctcttgtatgtaacttctactcaagcctagagccagaatgaaatggagaggggtgctactcgcttaatttattctattttagaccaagtttaaactgatatgagtgtttgagtttagattgaagggtgcatatatgatgaaaataaatatacttaaaaaaatttcttaaccaaatttttgggcacccctctctccacccaagctccgcccctgcctactctatcaatagcccgccctttcttcaaaaacataataataaaatggcaacactttaaaaagttttttttttgaacatgacactttaaaaagttacacatcgattttcagagtaagcattggagaagttaatgactgtcaaagtttaatcaaactttatcctaaacgcatcctactatattaatactgcgtatcgaggatcaaatgtgtcatatgttctgctaagaatacttggtacatgcgtgcgcgtgggttgcacatgcatatatgtatgcacaccgcacacgctttaaacctgtagtggatccgaacatttaatattatgaacatatattgtttacgccacgtatgactatcacatgattaaacttttcaactcctcgtgaagatcggatatgttctccctttgtccaacttttatttcatttttaacccatcccgcacggaaaaaaaaaccctactttatacaaatcccaatccaattattacacactttagcagctttgaaaataattacttctccggttccacaattcttaacgtcttggacaaaattaaggtcaattttttataattttaattattaacaactttaaaactatctagtttaaagaaactagaacaacatatataaaatattgtatttattataatagaaaataaattcaaaagatatattttagaaaccatgccatttgtccaaaacgtgaagaattatgaaaccggagggagtattttctatttcaaaaatttcgatacaatgattactcaaaaatgaatttattttaggacaaatgagatgagtaaaaaacgaacttattatgagatggaggaaatattatagtatgtttgaagaaagagtaaaatcaataaaacttcacatattacagtctaagttgcacaaaatcaccgaaatttaacacataaccctaagtataatggtactaaaatttcataaaaacaaactgttaactatttttacatactcctatattaaaattttaaaaaacgttacttgcacactgtaacatttatatggtggatgaaaaactcataaatttaaaatgtgattgttgaacttaaaagcttagcagatcaaagtcaaaatgatcaatagtgtgttttctaaaactttatagcgataatactcggggttaagtgacacgtgtcaaaagccccgtggttaattttgtgcaaccagaccacaatgctttgggttaagtgaaatttactcttgaagaaatttattcctacctaattttaggaactgggattgttgttcattcatgatttatgtgtgcatagataggacaatcatttgcttaaactgtgtaaagttttcaccacatcgcttttggtgcaggttaagcaaaaggctcatggtgcacattttttgaaaccaattcgatcactgaagaatcagtttgaagatgacggtacagattttgcatatgaattagactgatggatatgcttaatgagttttcgcactatggaaaagccagcttatatattctggctaatctaaatagagaatagttagaggtttgggataaaagatatatcacctcaattagaagttaattagcgataacctctactggtattttttagattatatggaacaagaatagtcaaacaaaatagatagtttgggttagcttttgatgccaaagtttcacaatgatcaatcttgaaccaatctttacctccgttagagcatctccaacagcctctccaaatcaaactctccaaacacccatatagccaactctccatctgatttggctagtcaaaaaagatactcactccaacagactctctattaatcctctccaaataaaatcggacccacatgtcagctcctctcccctcttcttcctctcttcctccccttctttctcttttcttcttctccccttccttcccgtcgaggcagccgacgcatggcgcggtggtgcgacggcgctgggaggtgggaggcggcgctaggaggcggaaggctgcgtggggaggcggccgggaagcagcgggaggtggcgcggggaggtaggaggcggacgaggtgggatgcggtggtcgacgacctcgacgacgaccccgacgacgacctcgacgacggcgcccccgatgacgacctcaatgacggcgcccccgacgatgacgacggtggcctcggcagtggggcggaggtgcggcgctggcggaggttgggcaccggcgcggcggaggccggaggggcagcgtggggaggcggccgggaagcggcggggaaaggcgggagacggcgggaggcgtggggaggcgggaggcggacaaggtgggaggcggcgctcgacgacctcgacgacgaccccgacgacgacctcgacgacaacgatggcggccctgacgaccccgacgacgacgacctcgacaacggcgacctcgatgacgacgacggcgacggcgacgacgacgatggcgcccccggcgagacgacgacggtggcctcggcactggccactgggggcggagggtgggaaaaacgcgtggggcccacgattagagaggcgcttttggcttgccaaagttggccagcgcggggagaagtttggccagctagatggcttggccagccagttagctaggctgttgaagtgtgtttttgatccaaaattgctaaaatttaacttggagagtggaataaggaggctgttggagatactcttatactttaaactgccaaagtttatgttctttctctcacttctccaacttctaccctcgtcttccttacacacgtctcccaaactactagacggtacgcttttaaaaagttttctataggaaaaatactttaagaatcatattaatttatttttttaagttttttttataaataattaattaaccatattagtactaatagacaacactttttcggtgaagtgagatggagttcctaactccacctcaaagaaaccaggaactcccttctccaacatatcatcgccctgtacaataattaactccccagctgttcattgataagaagttgcacgtggaaggatcagtgaggagtgaggacagattactttcaaattccgtttacttttagtggtgtgaagggacacatcccttcatctacttttaataggtatatttcatcttggcacataaactaaacataagtaatcctacttatcatccatttaaacatgttactccctccggttctataataattgatgttttggacaatgttgaggtcaaattttataactttgaccatcaataactttaaaaatatttagtttaaagaaactggaacaacatatatagatttgtcttttaaagcactataataaaagtagacatgcatttatttattgtatatattataataaaaaataagatcaaagatatattttgtagaccgtgccattgttcaaaacgtcaattaaaataaaactggaggaagtacttgttattccttataaacaagtgattcattaatatttacatttcttgatgcctatgtagccaatcttatgtggaagaatggagagtcacgtattaaatccgagaaagtcattaaaatgataggtcgttggattgaaatatgcctattaaaaataaaatttttatatttaaaaatatgtctatcaaaaatagatggagggactgccattgtatttttttcagatttttcagagtatttctttaggaactcagttgtaattttttttaatgcgctttatgttcatagtcttggtttttcgacaacgtaatcgaagaggcacgtgacctgatcaataattactccctccgtttcacaatgcaagtcattctagcattttccacatttataatgatgttaatgaatctagacatatatatctatatagattcattaacatcaatataaatatagaaaatactaaaatgacttacattatgaaacagaggaagtattatactcccaactcctactcggtaggactgccattatactggcaacccgaccccttccccagttcccctgccccccagcagttgactcgcgcttaattattgcatctatagaataaataagtacttattcttctcttaaactaattaatatctcacgcttttctgctggatatgtgattgatagatgtatatgtttaaataatgtaaaaatgatgtgaaaataatgatttaatattgctggcatcttgagttgtaaaagacaacaaaattataatgatatataatgtttgcatgatttttaaaatactctagataataattgttagtatgtgataatgtgttacatttacatattcaaggtttagaagtcggtgggcatcaactttatatagtaagataaaatatcttgtttttaatccagtctcaaataaattaatatgatgtaaaaatacgaatatatcattacatcattaatactatatatatgcatctcttagctttgatgtttggttagacctttgacataccaagctctaattaacgacgtttatatctgacgattggaggtgagaatggtgatgttataactcagagtaaagtgtacgggtggtccttaagctaggtccttactctatactaacttataacaaactctatactaacttatatcaaagggagagaaagtggaccccgaaatatttgagactacggagaacagatcagtacttcataaagaatactaattatcatatatataataatggtcatcaatattccatttaactcctcgaccagttgacacctcaatgtagtacagtatatgtgatgataccagctgtggagtatacagccgcgatagatcttccctagttgatgccgcgatagatcatccctaattattgatgccgtatacgttcgcagacctagaaacggagtgtctgattctgaatattggtaggattatgtgctcaattaattatattatctgtgcgttttatcaaattaactgatggtccaggcccaactactaccgattaaaacaaatatgaaggacgaaatatctcaaaaagatcatgaaagtaaacttagggaagaattaggttttctgattttccccccacttttaaataaaaagggataacatacttagcacacgaacaaaaaaaattatggacaggcaaaattgattcgtagaggcggttttcccagccgcctctaacaaaacagatagggttggatttttacaagcagaccactttactatgtatgaaaatggatttcacatgcgaacaagtacattaaggctctgtttcgccattcctggttcccaacgggaatagtacgcacaaaaaacatagcgatcaattagcgcatgattaattaagtattagctttttttcaaaaatagattaatttgatttttttaagcatttttcgtatagaaactttttgcaaaaaatgcaccgtttagcagtttgaaaagcgtgcgcgtgaaaaacgggggagaggggttgggaaaagggtgtgccgaacatagcctaagaccgcttacgaaaatgcatgtaattttcagtttcacaactcaggcgcaatatgcgcgcggcatatggattcaaaccccaagacccctctctccatacatagatttcttaccatttcgtgcacctatcatttgttggctagattcaagatattatggctgtgttcattagtgctggctgggaaccttccctttcgacatagaaacggagaagcacattagcacatgttaattaagtattagctaaaattaacttgaaaaatggattaatgtgtttctttaaacaactttcctatagaatttttttttcaaaaaacacaccatttagcggtttaaaaagcgtgcgcccgaaaaacgacagggggagttgggaacccatacaaatgaacgcaacctttttactatgttgtttttttaaccttacttagggtgtgttcggaatccccctttcctaactcacacaccctctttttttgcacgcacgcctttcaaactgctaaacggttcgtttttttcaaaaagtttctatacgaaaattgcttaaaaaatcatattgatccttttttaaaaaaatagataatacttaattgatcatctgttaatggaccgctccgtttttcgtgcgtagaccaaactccccagcagcgaacgcagcctttaaccttcaaaatcacaatatataacacatgaaaggtccaggatggccaaattgtcgttgttgttgtgcgtgtgcatgtgttaattttataattagtatgctcaaacactgttaaatgctccttttaacaaaacaaggacacgttttacatattttgaataacataagaacttcaataagtcatatttatccatagcaagtagcaagtgaaaaaggattattagcacacaagatgctgtgcaggttgtcatggcaaactactgtacatgctcaaaaactgagctactgttttcttacgaaaaactaaagtgcaaaaggattattaatctaaaaatattcttgcttcatatggtataagttgaatgtgaaatgaattgtaattaattttgtcaagacattgatctcccagcctcgacaggattagacatgatttggcaaaaagtgtatagaatcataatacaatgccaattggg

SEQ ID NO: 41550 - DNA, 5086 bp, Oryza sativa
ggttgatccctcacgaaaatttcatcgaaacatagaggagataaactaaagaagggagaagtcaacagcaatgttgttgtcagacactgatgaatacaatcctggactcgaatgattgatacgtcgtgtaatctggggttgaaaaattttcaaaattgatgataacacaaacttttggcgaaatgggtttttgattttttttttcatgagcagcagtatatgtatcagtaagcaagacaaacattgggcctggcttgtgctaattattctaaatttgcgaaaagctgatattaagaaactgatcatatcagagtgaggataaatgcataaatcgtgtgctaaaatgatcagatgaaaagtgtggcaagaagttgatagattgctgtggttccaagcctaagtttgccggattttggttgctaattacacgataatgttgactggacttgactactattcggttcactgccaaaattttggcgagattccatccactttggaaacatatcgagttctcgatttcttccaaaatttcaaccacattttggcacaaatcaaccgtttgacattgctgcgtgctgtagctgtcttgggttcttggctatggcgtgaaaagaatgcatgcagtttagctggtaggtaagatcggtgtgatgaggccagtcgatctcaaactgatctatctgctgttttgtcagtcgtcacactaccaaactgtttcttttaatgaagtttttgcacatgaaaagctaagctcaaagctctacgaggtcaaacggaaaggaagacaaacaattatccacatataattgtcgccaaattgagcatattggctatttatcttcttttgatccaatgtataagatgatgtatcaccactggcgtcactagaatttagagcaaaatgtggtttatccagatataaggagccaaataaaaaagataattcatatacaaatatttatgatgttaatcagtaattatattgtgtcaagttctagggtggtccatgatttacggtgtcacctaactagctcctatttatattaccatgaaggagctgaccttcaccttgagagtgaaacagctaatatattgtcttgccaaaaactggatagtttatgccgtataaaattgcctatggttatttagtaacgtcaattaatttatatattctttggaacaaagctttttttttgaaaagaaaatgtgtgaattgaattcgtgttaaaattcttgcttccgaaagggcccttaaagaacaaagaaatttcggattactattcattttgagttactgaaatgaaacacatttcaatatttttgccgcagcgtgttacacatgctggcacagagtcgtttccaggtcaaaactgaaaataaacgctgttggagagcttagagattctagtgcagctgtgcaggcgatttcagaggagtactacatttgatttcagtggcctaatatgacttttggtttagaaaagtgcggtcttttccattggcctaatatatactccgtactacagagtcagaagtttggaaatgataacgagttagtaaaattccacggttcaaaagttgttggagtacaacatgacaacaattgcatcatttggatcttcaagtcaagtcagacctgttgcagatatagtgataaaaatccttaccgtatattactcttaggttgtgtttagttcctgaaaaaagttgaaagttttaaaaaaagttaaaagtttatgtgtgtaggaaagttttggatgtgatgtgatgtgatgaaaatttggaagttttgggtagttagggggtgaactaaacacggccactatttcggcgagataaattttatgatggtcttaattggtaatcatccaatggatcatatcaatttttactacacgaactattggtaatagaatcaaggagattagttattttattattagtagaatttataaatcaatacagtagcttattttgtttctattgataataatattggtaatactcccaatagatcgtttaattacctgccttttggtgttgcaaaagttaaacggttgatagaattcatggtcaattcttcaggagttcaggtgatgtattgtcaagttaacacacgcataattggagttttataatacttccttcgtattctaatgtatggcgccgttgcctttttttaatcaacgtttgaccatttattttattcaaaatttttgtgcaaatataaaaatatttatatcatacttaaagaatattggatgataaatcaagtcacaataaaataaataataattatatatttttttaataagacgaatggtggttaaaaagtcaacaacgcctagttggagaattgtcaagggaagaaaaaaacagaattcgtttgatgggctgctgctacatcgggctgggctgggctgccatggctcccaagctctcagcgcaaatcgatctacgagtagctttgggcccacttcacagggcccaaactggaggatgcatcgtctctccggacacgattcaccacgctaaaacccattctcgttcccgtgcatcactatcttggtgtgtctcacggttggaattgctggacactcgtcgactccgtttttgccccctttttgccgggcttttatttcctgttgcgtttgggtctttggtatcgaggaatcactcagcgtgctccagagttgagttgagacccaaagtgtgagacgagtatcatcattgcgtcttttgcaccgtaatggctaatgatcagatcataacactccttccccaccgttttcctttttttaatttaatttgtaatctcgcaagactgatatgactacctccgtcccaaaataagtttagtcttatattgtttatgtctaacgtttgaccgttcgttttatttaaaattcttttatgattaatatttttattgttattaaataataaaatataaatagtactttatgtgtgactaatttttttataaatttttctaataagatggatggtcaacgttgaacacggatacccatggatgcacttaattttaggatgaagagtaatatttggatgcctttgcctccttgtacagtagggttgaaagtgattaggatagtttctgtccgaccggaccttttttcagattcggatagtttcagtcgaatatatctaaaaaatttcaactacggaaatgaattcagatttttttttgttagaaataaaaacgaatatgaaagtaaacacaacattttctatctcccccttgcccttacaaatagagataaaatttgaaaatgttgatgttttgtttttaaaactaatggctacatctcttcctcgatttaagaagcttactttgaggggtcttgatatttcgataattattttataccgtattcgtttcgattcgagttcgctccatatctatattcgataatattcgattccgttttcgtatccgggtttccgattccgaattcgattccgagaaaaaaaaatataaaaacaaatatgatagagctagtttccgatcgtattttatccgttttcatctctaatgtacatttgcgtggcataccaggtgggtggatgcaaaataacgtgccctgttttgacaatgttttcccaaaacaaaaactttttttacccatcacatcgaatatttggatacatgcatatagtattaaatatggaaaaaaaaccaattacacaatttacgtgtaaattgcgagacaaatattttaagcctaattgcgccatgatttgacaatatggtgctacagtaaatattttctaatgatggattaattaggcttaataaattcgtctcgcagttttcaggcggaatctgtaatttgttttgttattagacaacgtttaatacttcaaatatgtgtctgtatatccgatgtgacatcaaaaacaaaaatttttgccatctaaaccgggccatagtgttcgctttgccccacgggcaattttcggctacaccatgcatgtaggtcattttcaaccataccattttttttttggcaaagttactaagaatgtgcctacgtttagtttgttgccaaattttgataaatacataagaaatcatgccaaaattttaacaatattatcaacttgctaaatttttggcattgctataatttggtaagatcctctgtaaaatatagtgaaacaatccttgtactgacaattgtgtcgtggtgtgttttccgaacaaaccctcgttcctttaataaagggactgtctatatatctgttgatagaaaatctcacatcccgtctgtcgacgggggatacccgtagaccgaatatagagggtattggggcacgctggtacgaggatctacgtagtacgacatcaagcaaacaggaaacagagattatactggttcaggccccttggtaggtaatagccctaatccagttgatatgggattatataatggaaaccacagattacaaagggattagtggaccttgacgataacgacaagatcgtagtcgagttgatccgactagatctcccggcgacttggctccgataagctccggcttcgtaggctgtggtggatatgttggctctgagattcgatgccttatgtcctcccgtgaggtcccttttatatcgcaggtcacctgtctcccagtaggactcggagggaccggaccgaacacgacacaatgacgacccatttctgaccgagtaggactccttccatctgtgaactctgtgataaatttccttaacgtatgccgaaagcgtccgtatacgcgtgaacataccatatcgatatgtgacgtatatcgaaggatagagggtataccttacccgtaaccctgacaccgtctttcaaattttggaccattgaatgtgcttttaagattcatgcaaaggcattaaccctagctctcctcctcccgttcccctcccgtcgcgcgtccgcacccctcctcccatcgctattcctccgcccgatcccccgccgccaccgtcccaccgcaccgccgcccgccttgccggttggccggaggatgtcaacggcaccggcgagaccaccctagccagcctcct

SEQ ID NO: 41551 - DNA, 2990 bp, Oryza sativa
cctctccccctccccctcccacccctaccccaccccgggaccctaacctgtagggtcctttatcgaagtctagggtatcaccggcgcgggagaagacgaggaggttgccggagttggaggagaaggcctggagtacgaatctcgaaactcatccggtggcccaaaatctgcaagatttggggatacaatttctatccgcatgaggttagcaattctgtttaataaatactctctccatctacttttgataagcatattaacaaatctgaaaaaattatttttgatagacatatttctatccaacaacctatcctattaataactttctcggatttaatgcgtgactctctattcttccacacaagatttactacatgggcatcgagaaatgtaaatattaataaatcgtttgtttacgaggaataactagtaacatgtttaaatagatgacaagtagaattacttatcctgcaaggatgaaatagagtagatggggaagtacaatgaaaaaaagacaaaattccgatcgtaagggtggcgccgtaaacatgtaatatacgtggttgtttttgcaaaacgtccatccccctcaccaagcccaccggccgcccctccggccccctccctgccgcctcgcacgctcgcatgggcgccgcccccacgcacgcgccccgcgccgtcgcctacgcctctcggcgcctcgccgcctccctacacatagcaagctgccatgacggagggttcgacaccgatcgacgccgtggcagtggcaccactacatgcacacgcgcgaggccgggtgacgcgtcggcgagcggcgccgctatccccctcccggcgaaaaaggtaaggcggagcgccgcccatctggggcttggttgccggaggggaagggccgggggcgggccgcgactagctcgaagtccagctcgtgtgcgttgtttcctactttcctgtgctagcttggctgccctctttgccggcgtacgttggccctaccgcttcttctgattgctctgcacttctctgcttgctggctactcggggtgccttgacttggcggcggattcaggccttttctgtggggtcagcacagctttttgaaaaccatcctataaatctcgattttcatgtataaattcaaaataatttagagaaatgcctcacttatagtaattgattctacaggcttaaatttctggctccgccgacttactatctttggttggtgaggggatcgggtcgtgcaagcaaccccgcccggcggcgtagtgcctcgtcggacgaggcctggccagagcaacgccattggaagcaggtgttctgttccctgcatccgtccaatccccagccgatcctgtacctcgcatctgcatctgccgtacgtccactccgttcactctacttgtttattcgttcccacttcattaacaaagtaactgttgtcggttccaatcctggttcttgcatatgcactaacattttgaattttttttttccaggcttgagcatccacagtgtgttttgtttggttctaatccttatttttcttctgagttctgggcttctggccttttcaagaacagagaggtggcatcgctttgttgtcaccagatgagttgaaacagactttgcatttctgacttctaagtctgttagcaccctttttttcccatgttctagctaaagagtctatgttcatgtcccgatttgtgatttttgtgtccacttgtgcatagccatcataattcgaagacttcacaatccttaattcgaagacttcacaatcctgaaaaaataatcacatgcttagtggacatgtatgtagccttttctcatctgaacgacagaatgatcttggttaatttatcttgtattgttctcttagtttttaagtgcaaacaaaatttaacacttctttattgatcatctagattagccgtctcctctgttcgcaattcttgtttcttcattcctactacttggacaaattaattgttgccagttctaattcgaagactgctgctctacgtagtcctatattcagatatgtgttctttcttggcaggggcacaaacttccgcttccacaggttaagcaccagagaaggtctaaggtgtagattgtatacaaacaagcaataaggccactaattttatagtatgcttgcagatcagtcagatggagtattgtagtagtattttgttgaaataaataaacattctaggatatatatcattttgtagtcattttggacaacatcactaggtgaatggatgtagtaccatttttcaaatgtcaaaatggaaatataatatatacatcattttgtaatgccattttggtttatggatgtatatagatatcaggatatatcattttgtaaatgtcattgtggaccagtgaaatgagaataaatcatttatttcctgaaaaatgtcagtatggagatgtactccgtagtataaatttcctgtacaaggacacctcgtatatttgatattttgctattttttagggggggggggggggaattggttattttattcttcacccttttttattattatctgaagtcagtgtttgtgttttggaatgtcttttttgacttggtcacccttttttttggcagatattcatccaattcttccataccaacacatgcacaccattgttacatttcttttttcatctcttgcagctgcccttctgtgcaggggcggaggactcggttgggcaagggttggcgcgcgccatacctcgctcccgacgcgagtacccccacccccgatggcgcaccacacggctgcaccgccgcaggcccgtaggcagtagagtcactgccgaccaagagagctaggggtgacggcgagcatgcggcgcgggcgtacagcaccgtggcgcgccagtgcagacgcaggtggcaggacgtagatggtcagctcttgaccggctcctgccatggcatccacggaaacagcaagaaaacg

SEQ ID NO: 41552 - DNA, 11400 bp, Oryza sativa
  unsure (1)..(11400): unsure at all n locations
ttgttcatacttttaatctagtacacttttgcttgggttagatttaggcattggcaaaacatatctaggcagattactgtagttgtcactttcaattctcaaaaaagaactagaaactaagttctgttgttgggcttcagccttaagacgtacaagcacttaaacattacccactgcattagttttcctgaggactcttatcagcatcttgcttttaacgactttgaacttgattgttgcaggtgcataagctagtcgatctttccgcgcagcccgaccgtgaatcaatgtggtacatggaagtagttgaggccttcaacttcttttacttgcagttctcggctgctagcccactgatgaagcgctagtgtccctgacctcttgttctctccagtgctcagatgcttcgtttggctgtaggcctgtaggctgtagcccttcctaacacttgtccagtgcctatttttaacgggtagtttttgttagggctaatatgtactccttcgagcatctcacattgtggtcgttcatgtcgtggatgggtttatttgggagacgtaaacttttatcccaaagaaacttgtccagagtaatactaacctttcatgttggtaaaagagaatgaattctcagatgcactcagaaatcctttttgtgccattgataacatgaaagaaatctgcaaacttttttatggcgtatacctgaatagtaagtagggttcgctttagcatttgtctcacctggttgctttgtagccaacaaaattggcattgccaaattatttggcttacttgaatatcaaaatactacctccggccagttatattcatggttttagagaaaagtcctggcttattttctttgtaatttcagttcaaagggattttccagaaattaccgctcattgagttgaactactcggcatcgggagcattttcattttctttgtaatttggatatttggttgtcctaaatgtcaattaattatatccagagggagtataacttcttaaagttggtaagcagaccagacaaatcatagctatttttcgccaaaaatttgaggaggtgactagggatcggtcgtccgatccaaatctccaaaaatcgggcgctgacgtcagtgctacccatatgtgtaaaaccactttaaactaatttttttctcttctaaaattttttttctcttaaattatttatccaaatcatgatccgattgcaccattaaattcgttgtaattaaatattcaaaacaagaccacacatggatatatttcgacgaaatttttttagcttattattgactttttttaaaatgttgcacgatgttccaccagttatatcggaattgtttcactaagtagaacggaaatatttcaatcgttagaatcgggtgttgtttcaccttatataaaaacaatgtttcagcaaataacgaaaaaaaagtttcaattcactgcaacattagaaccgtacatagtgaaacattataagtacactaagtgaaacatttttttggtggaaaaaaaagaaacgaattccgagggtttccaaaatatatggatgatttgttgcaatggagtatttcaattcactgcaacattagatctatagatagtgaatcattatgagtgtagtagatgaaacattttcggtggaacaacaaataaaccaaattctcttaacaaagggtttttaaaatatgtgggtaatttgttgtaatagggttgtgtgtgtggacacgtggtggaccagggaagagcgcgcgtgcatggggtgggggggggtgcccgagttctgctcccccgcccgatcacccgatggcaatcattctcgaaaattttagcaaaaaccaatttttgtccttcccaaaaaaatccggcaaggctgaaaatagcatgaaccaaacaaacaagccgagacgggacggggctaaatatagcgaccctccgccgtcgctatacgacgtcgacgctacggagtactcaataactcaaacgacggtatagtagtagccagatcatatctaatccatgccggtggacactgccagtgggacccacatgggtcctctgatctccagtaccttcatattccgggctggagaagacgacgaaacagaggaacagctggcagcccaccccaccatgaatagaactgggccccaccagccagaagtaacggacaaacgtcatcccaccggagcatccgcccccgtccgatccgcgatcggacggcccagatcgcccccgcccgcgcgagcccgctcagccaccagctcatctactggatagcattttcccttgccgcttcttccttctcgcctcgccgtcgtcgccttcaacttcgaggcgagaagcgcgagatcccaaaaaaaaaaaaagaaaaaatagaaaaaaaaaacaagcgaggaacaggagaagcgccgcggcagctagctgccacgtggacctcgccgccggcgtcgccgccgccgccgcgcgtggatgcccccgcggagcccgcgcccatggcgtccgtttcgtcgtccccgtcgtactcgtcgcaggccgccgtcctcctcctcctccaccagccgccgcaccagcacgggcacggcggcgcgtgcctccggtaccgcggctcgcagtcgcaggggagggggaatgccgtagctacgtcgctggggctctccgcggcagggcggggcggagcggggggcctcctcctgctgccgccgctgcccgcgctgcgggcggcggaggggaaggatgggcgggccgtgaccaaggatgaggaggaggaggcggcggcggcggcggtggaggaggagggggaggtggaggtgaggagggaggaggacaagccaggggacgatgggtcaagggaggccgcagcgaggggatcggggtcggggcgattctccgccgactacatctcgctcggcatcagggagcccgtctacgaggtaaccgatcggcgatcgaacgccttgtaatggttaatggtaaattggagacagcaagggactcattcttatgatcatataagtcaaaatttaaattttagaacttaattttgaatttgattttttttcattgtagattattcgccgcatttgtttttttagtcactaaggatacgtatataaaagctttactcacaaatgattttttatttgctaataagcgattcggataaggttgcaaggtcgtgcatcagctaacttctgttcctagtcagaattatggattgcaatagctcatgttctcaaggtcttaagtccactcaacaagccaaatggaaatattgcaatatgatcattgtgagtgtccaaacgtaaataaacaatacattatatgccgttaatccaaacgtgtaactttggatggagggctaccagtaggcttcatgcataataaatctttctctaggttcagattttgctctctctttttttcaagtcatggggagttatgtccctcgttgagatcattttctttgcaaactcaaatggccgtgtgcatcctagatgcagaggctggggatgtaatcatctcccttatctaaaataaatctgcaattgtcatgctaatttgatgcatgtttctgtaagggtaggtttgctttggaatgaaatgcctgttacatattctgggacttctgcaaattgcaagatgcaaattaactttcccggatatcaaattttactcaggtgatagaagtaaaatctaatgggaggatgtctaccaaaaaaataagccggaggcagctattgaaatcaagtggtaggtagaaagaatatgtttctcaaggactgtaaaaaacatgattatgtagtctgtaccaaactctcatatagtgcttgataatttactggtaacagttttagaatttgaaaatgctgccatttcttgtggttttgttcattcttgtgaatgtcaagctcattgacagtatttatgttgatcaccgaccttttcttataggcctccgcctacgagataccagaagcgttgacccatcgctatggctaatgaattcaatgccatccttgctggtaataagatactttcaataattaatcatgtagactttactctgtatatgtttcccatcttttcctacaattttcagttacacaaacaatggaatgagtgatgctaataattgtgtatgtacaagagtctgaagatagtacaattgctctgttacaagtatctcaggttgcctgtcaaaattacctatgttattatagtcaatcacagagtcagagttcaattttttttattcaaagatagaagtaaagaaaaaggttttaattctgcaatattttccagctcacatttcgtttagctgtctttttcagtaacctgcattgtgattgtaatcttgacaaccactgttcattactatgaactgataacatacatagaatatttgtgtatagcttttcatgtaaacttccatatcaatatatttgaactctatgtttgcatggttactagattctagatttatgtagaagttaattttttgccttatcaacctgcttcacagttcaacatattgcttctatgtaccatttcatataggtccgtgaacaagccatattagtaaatcttggttccttgcgagcaattgctatgcatgaacgcgttcttatattcaattacaacaggtcagtttgtacactagtcattttaatataaattgtattttacttggtgaacatcactattgttatgaaacttatcaattattttatctgacttgagtagcccaggaggaaaggccttcttagattcattactgccacggttaaatccaagaaatatcaatggtggaccagcaatgccatttcaacttgaggtatcaggcatatggatattcttatattaatccatatttgtggtctggaacagtcttaatatgatgatattttccttgtcaattgtttcatttatatttgcctccatggaaggtttactttgttttcaactcacataggaataagattgtcatccatgagttttcctagtttctcttaacggtcgaatggaatcttgaacaagaataggattatcatctttgattttaaaagttctttttgattgtacaatatcttttttggtctcattagttattatattaaatcatttaacatatattgctgacaaaaaacatttttatcgccatcatgcatttgccaacatgtcatgctatgcttgcattttcacccgattattgagagtaccatcctcctgccaaatactgggccaagatgatctggttatttattgccttctcttatattcaggttgtcgaagctgccctgctttctagaatacaaaggttggagcgaaggctaatgcgtatcgagcctcgtgtgagtgccagaaaagtccctgctagctctacatcttgtacaagattgtatatcctgatgttgttagttctactttctggtgcatattcaatttatggagcaatctgatatattgtcaataggtgacttaagacacttacgaattcctgttcctgtcctctattttcttgatttcaaccttgaaaacttcattcaaagcacatatatacagaactgaaccaataataatgcatgttatttccatatcctgcaccctaactctttcctttggcatttagaagtccctgactgcagatttgcacgccttcctctatatttttatacatctttaccaaatggactaattgaagcacctgatcttcacacaagtcaactgcacaaatcataagctactgtcaatacctagctttttgctgagcacttactaagtttaacactagggagtaaggatcttcttgaagtcccttgtaaatcacagacaagacatagaccagtaccatgtgtccgtgccacatgatcactgcagaattccttcttttttaaaaaaaatgggaaacagtcggaaagagccctaccaagctgaccctgcattttcatgtggtattttaggtgttgtcgtattcttgtgtttgtgtttcagtcatgtatggatcaagaacatgccagtgttcaaattgactctatttataatggaaaaaataataatttgggtatctgggcttatatctcaggtgggtgctttgcttgaagttctaccaaatcggttgacagctgatgtgttggagcagcttcgtctaagcaaacaagcattggtattaaagctgcgctttagaatcatttcctggacttgtttgtcaagtttaattttgtctctattcatgtgtcaaggttgagctgggttcacgagcaggtgatctcaaacaaatgcttattgatctcctagatgatcctcatgaaatccgtcgaatatgcataatgggaagaaattgcacgctcgacaaattaagtgataacatggagtgctccgttcctttagagaagcagattgctgaaggtatggattgagagcatcattggactttttatattttggagacatattactgccttcatggatttttttttgtttccaagcatggcatgtgcggaattcacaaggagtgttgcaatcacttatttgtcagtagttaactgtttgattctgttttacttgtttcatctgtattttttttgttttaacagaagaagaggaagaaattgaaatgttgttggaaaattatcttcaaaggtattcatctgcaatacaatcttttcagatgtcttgtttctttcttgcagaccttcattgtgtattcttactgtcagatgtgaatcaatccatggtcaagcagagagacttcttgattctgcaagagaaatggaagattcaattgcggtcaacttaaggtctgtctactctcacagaccacatgatctcacaaagtttagcttcatcaatgcatgtgttcttataatttataacaatgctcacttttgtgatttttttgctcttgaatataattggacagtaaaaatatatgtgtaaatgtatgaattttaataaaaactatattttgaatttaataaacgatctaaggtgacaaccgaacataaattactagttcaaccagacaatcaaccattgttttctactcttctctctacatttatattccaaatcatgtgcatggtccataatttgtttaacaccctgaagtcactccaacttggactaaaatggtctttgatttgcaagccctgcatctaaacagacatcgcattttatttgctgcctctaaactgtttctagcagctactatttctttgtgaacccttcatccaagcgactgagtccaactgtacttatcataaagctaggctgcgtgcatctagaagatcatgtagcatggtagcttttcagcaaaaagaaagagaaacacgttctccaatatggaaatagaatttatatccatcagataactgtaaaatgatctttcacatatttgcagtacaaccaaactacaattagcatcactacaaatggacatttcagattcttaaattttatagctatattgtggcgactagcgagaaaataccaattaagagcaaacaatacactccaagtctccaacatagatgaaattaagaaagcaaatgcaagaattacttggaaatggaggacgcaccaattatgtaccggatacgtacatagtactagtctcaaaattttgcaaatgttcttttgtgggttggggccttgggggcatgacttcattatcctccatcctttactctctgtggtgtgcgggtgtccacaggccatggcggtgtgtactttgcaacataaaatgccagcattatgtttcaggtttcaattatcaaagcataaccagataaaagaaagggggactgcttgagtgcttcaaattgcattcccataattttatttttttagaactgatttaagatgaaattatgagagtgggtcttggtataaggtggtgtgttcctgcacctctgtttgtgtagcatacaatcacaataaactatttgagaattgtgggatcttgttctttttggcggatgtgaaatttatgtgaactagctcaacatcacaaacatttcataaattatgggttttcttaattcttaccacattgggcatccttacagctcccggagacttgaagtaagcagagttgagttgcttcttcaggttggaacattctgcgtcgccataggagcattaattgcaggtacaaaaatctgtcagcgcttttgtatctagtgattttcaaatttcagttcctttctatcactctttattcttgaagtaatgctataattgaaccgttgtatttgtttcctgtaggaatatttggcatgaaccttaaatcgtacctcgagacaaacgcggtatagcattgcactcttgagttcaattctgctttctgccacgtactggcactacttgatatagcatgagttgatgacgagtttattttggagcagtgggcattttgggcgacaactggtggaatagtagttggagcagtggctggatttttcatcatgtactcatacctaaagactagaaagatattgtaaaactctgtagcattcggtactcctaggaatgtaaataattcggttttgatctcattttgaaagctattgatggaggcacgtacagattcatatgagattgctttgatgctcccacgaatgctgtcgtgggcgtcggttctgaactttggaccaagcgttcgctgcacgcctgatgaagctagcagcctagcaccaagaccatagtatttcgcatctcttacataaagccgtggcggttttcatgactgcactgggtgagagtgctgaacagtgtaactctagattgatcaatgttactgattatctttgaaaatatttgcctggatccaactttgtcccgcgttgacatgcgcatggatttccccttgtgctttcacttttcatacaggctgcctgtgtcagttccacgtgtaattaagatttggctcatcgtgattgaaccttcctccgtcataaaataagttaatttttagagttgaaactttgtctcaagataagtttatttctactttcttacctaggttctccacaaatcacccctttttaatgtactagttttctattaataaggggttttggtcttttttcctcacacacactaaagtttcccgggatatcagtgattcactaatttcgggactgaataaggatataagaaggtgcctgtgatgttagaaatgcagtgtatttccactatgaagttttgcaagtgacatccctattgagtgttatcggagaagtgggaacaggggttcccctcggggcgttgtggctcatactaagacctacaagatctacatcttcaaagtgtcaagaagagtatgagactcaaaagatctatagtttcaaggtatcaataagagtatacagacctatgagatctacatcttcaaggtgtagaagtgagcatagatagacatagggacaattggaacgaagacttttgcctatctaatccacttgttagtctataggtgtgattgtcacatctggccaactagcttggagggatagcgacaaggctaaacatatcaagtttagtggagtgggcgccactcctacatgcatgcatcggcattgacgaccccccccccctcacgtataaaaggaggatccatgccaccgataaaagggctcgtacactcatctaatctaggttagccaaacattgggtgagaaaggatcttctcctcctcacttaggctgcgttcggtagaacattttcccaactccttctcctcgttttccgcgcgcacgtttttcaaactgctaaacggtgcgttttttataaaaagtttctataggaaagttgcttaaaaaaatcatattaatctatttttgaaaaaaaattagcaaatacttaattaatcacgtgctaatcgctgctccgttttccgtgccggggagtgagggttcccaacccttactcccgaacacagccgaacttttcacatcttacttataattatcttcatcatccatgtccaccatacaagagtagggtattacgtatatgtgcggttcgaacatgtatactcgctttgtgtccattccctttgcataatcaggacccaagctcaaaacttgctcccccagccaaactcacatagagggagtgcctagcttccccgctagaggagttccgtactccgacaagtgtattggtaggtgggtacatgtggtggtgtgtgcatttccatgtaattgaaaataacctaccatttatgtagagagagcaccagtggggtgatggtagagccataggttcatgattctatccatcattctttaaattctggtgttcacaaatattatacacatataagttggttttcaacaggaggattttagtaaggtaaggtgtgtgtgataatcgagagaaaaaaaacacctgccacatacataattaggtgtgaagaaaagaaataactcaacagatttacccgaggatgcaatgagaaaaaggaaacaatgtctctgattcttagaggtatagcgaatgcatcttgtgatctaacttcgtctatgataatgtgacatatgaaatttcaggtgtaaaacaccatctttacgggtaaattttacatgttcgataaataatagacattacttaaagtttgtagagacatcttagtaaaataatatacacatcttttacgtattaggtttaaaacattatcattgtggataaaacctacatgttccataaaatagtagacaacacttaaaatttgtactaacatcttcttaatacaacaatgggcacatcttttacaaattacaaaaagtattaataacaaatcgtataagtccattcttagcaaaaagtttcatttcacggttaccaatattgttatgtcgtcaaaagagttttgaatcgataaatgaaataaaaccttcagtgtacaatttcattttgtggctttttaggttagtcataacatttaataataatgcatgggattgaatgcagttggatgaaatggaatactcgagctcctcaatgccagtttcaaatagttttatagtcttagaaacagtgtacatccagttccatatatatgaaactcttttaatctctcttcataatgatattgccatgtcatcaaatttgtttgaatggcatctcatttattgagaaaaaactctataaaactaccactagaaattttttgttacattaaccaccattgaaattggcctaagagcaatttcaatagaagagtaagccgtcagctctaaaacctatcaaacacatagagtgctgctccaccaaacagatatcatgtacaacaaaagtctannnnnnnnnnnnnnnnnnnnnnnnnnnnnnnnnnnnnnnnnnnnnnnnnnnnnnnnnnnnnnnnnnnnnnnnnnnn

SEQ ID NO: 41553 - DNA, 2147 bp, Oryza sativa
agggggggcagcaaatcagcagaaaaattatcatagatggaaaacataccagatggaacatgtggttgctgatttacattccatgccaaggaataaaagggaacatataatttataagtttgtattgtccacttgctatttaaattcagaatatgtagattattttaaagtaatgatattatctgaatatcctttttccagaatatgcagacacatttcaggtttataagcttggaaaaaaaggcactaacgaacattccatcgttggtcaaagaatcccatcatagatcaactggcctaaaaaagaagaaaaataagtgtttcatgcatagaaagtggtttcaattttatatccatctgttggatattaagacaaaacttgaaggagaataactattccacattggttccagataattaattacatccttttcatgagaaagcaacaattaacaattgcttttgttccccataacacattgggccagctgtacttcccaactatcatgaacaatttgtttaaacaaaaattagcaataaaacacatgggacattattcaaataccagtatgtccactatcattgtcagtaagttccaaacactgtcaatggattgtagttcctacactataagaactacctcatccaatatcctagtatccccaactggttgtcaataactgtaagcctacctgaccatttgaaataaaatatttgatagttttggaacacaggtagctgcttaaatagtatatagtcttcaatatgaaatgtcacattttagcaatatgactatgcatgtagcatgttaagcatatttctcttatcaataactatttcaattctaaacaaaaactacaacatgagtatatgtttttctttattgcctaaattcacacacctcagatgagataccatacttcccaaaaatgcattagtgctcgtacagagagaacctagctagtatttcttagtatacctctagctaagaagaggaaccaaattaggcgacaaagactaatgcacctcgtgcaagctggtgtataataaaaaaaagtcccatggctacagcataggacaatctttgttaaaattccagttctaaataggttacaatgacttcgtatgatgttcaaaaaaagtaattgattcgtatcgaggcaaaacaaaacttacatagatatgttccacttcatatgcactgggagggatacctgcatctggagaagcttataagcactgataaataaagaacagtagggcatttagggcatttatagtatggtctgaaaggctttgagttggatctgcactattatgtttcttgtgtacataatatgaactgaatcagcccaagaagaactttaccttggcaaccaaagagaatcattacatacatgtcaaaggtatcctaagcttgatataatgaacgaaagccccaaatcgcataaatatgccctgcatcacaaatgggaacaaataaacctatcaacaatatcgttttgccctccaaagctgtatatgcaattcctaactgaaacaattaatcacagcatagagaaatttgagtagcagcgtgtgttgtttcaagctaaacagtttgatcacacatgacagtgttgaagtacatgcagagggaaatttctccacacaacctacacactataactgaagaatgccatacacattaaaagcaaatcaagactggcactgtaactaaatcaaggcttacacattagaagcaaatcacggttgtaatcatcaacaactaaggtccaaccacttccttctcatggccctatggcactgagctagaacgaaaaggaaaaaagagaacaggaacgactaggcagctattgtcgcggagccgcagctgtcttcatcgtggtcctggccaagccgacactctcccttcccttctcatggcactgagcgaggctctcatggagagggagaggagaagatggcagtggcggcggcctactgactccgtctaggcagagagggacaggagaagagggcagcggcggcgccctgttgactccatccgggcgaccgattcaactggaggggaggccaagatcgatgaatcagacggtccccgagccatatttgacaccgcaaagagggagcggcggtggcagcac

SEQ ID NO: 41554 - DNA, 10207 bp, Oryza sativa
  unsure (1)..(10207): unsure at all n locations
ttcccacatgtttcttcagctgactaacgtgaaacacagggtgtatgttagcttcttctggcaactgcaacttataagcaaccttcccaatcttttccaacactctgaagggaccataaaactttgctctgagtttcaatgatcctctcagcccaaaagcattctgtcgatatggttgcatctttaggtagaccatatcccctaactcgaattgtctttcactcctgagtctgtcaacaagctttttgattctggtttgagctttggccaagttttcttttaatcttgccaacatatcctccctctgctgtacagttgctcttgcctcttctgaaacatttccaggtatcgccctttccccaatatgtggtggagttactccatacatggcctcatatgaagtgacttgcaatgatgtgtgataagaagtattataccaccattctgcagtaggcaaccatttgtaccattctttaggctcctgaaacaccatacagcgaagataagcttctacacattgatttaccctctcggtttggccgtcagactgaggatgataggaagtactaacccgcaatgcagtacccattgctttaaaaacattttggaatagttcgctggtaaaaatcctgtctcagtctgacacaatagccactggcatgccatgaagtctgtatacattttccatgaaaacttgtatcacatcttgagtgtcaaaaggatgagacatggcaacaaaatgagcatactttgttaacctgtccactactactagaataacatcttttccatgagattttggcaacccttctataaaatccattgaaatgtgtgtccatgccatctcaggaatttgtaaagggtccaacaatccaggtacatgaatatgttcaggtttagctatttgacaggttgggcattcagtcacctgtctatccacatccttcttcattttaggccaataaaaaatcttcttaagtttatggtatgtcaccttcattccggaatgccctccaaaggtggaattgtgaaaggattgaagcagcctttgtctgatatcagttgattgtcccacataaattctgtttttatacctcagtaacccagattgtaaagtgaacccctctgctccttcattcagttcctctccagttactaactttgcatatttctcatcgcccatgtagttgttcttcacatcctccacccaagctggatataccagagtgattgccaagcacttgtctccatcagtatccctcctagacaatgcatcagctgccttgttttcttttcccttcttgtactcaatactgtaatcgaactccattaatttcagcaatagtttgtgctgaattccttctgttaatctctgggttgccatgaacttcaaactttgctgatcagttctgatgaccacctgatttccaagcaaatagtgcctctatttcttcaaagcttataagatagcaatagcctccttttcatatgttgaagagctagctgccttcttccccagagatttgctgaaataagcaatgggtctcccttcttgcatcagtacagccccaattccaataccacatgcatctgtctctaggacaaaaggttgattgaaattgggtaaagccaaaactggacaggaagtcataacttctttaagattgtcaaaagctttttgctgttctacaccccattggtagctgtttttcttcaacagatcatgaagtggtctgcatatggttccataccccttcacaaatctcctatagtatccagttaatcccaagaatcctcttaattttgagacatttttgggtactggccaatccaccacatcctgaattttactaggcttagttgcaacaccttctccggacactatatgccccagatattctatacttcctacagcaaaagtgcatttgcttcgcttggcaaacaatttatgtgacctcagtatgtttagcactatgcgcaagtgctgttcatgttccctcagatctctgctataaattagtatgtcgtcaaagaagaccaaaacacacttcctcaaaagtttgccaaaaatttgattcatgagagcttgaaatgtagctggtgcgtttgtcaacctgaatggcatcaccaaatattcaaaatgccccatatgagttttgaatgctgtcttagggatatcaccttccaccattctgatttgatggtaacccgaccgtagatccagctttgtgaacaccttggcaccattcaattcatctaacaatcttctatgataggcatagggaacttgttcttgacggttttggcattcaattgccgataatccacacacatcctccaattcccatccttcttcctcaccatgatagctggagatgaatatggactgagactaggtctaatttctttagaatccagcaattccttaataatttcttccatagcatttttctgttgatgtgggactctgttgggtctcaagcttggaggttctgctcccaccttcagtggtattgcatggtcacaatccctctttggaggtaaacccttaggttcagcaaatacgtcagcaaactcttgaagcaaaactgctatctattctggtataatggtttcttccttcttctcttctgttttagacaacacttctatgaagaaacccattatccccttatcaagcatcttcccaaattttccagccttaatcattatcttctcctatggaagagtatgatatacaaatttaacttgctggcccttacatgttacctaaagaactctctgttttaggtccagactgattggactatggtcataaatccaatctgcccctaaaatcacatcaaatcctttcaagggaattaattggaacactctttcaaatggatgaccttgtacagtatatgacaactgctcagtttttgtggaagaggagatcatacccccaccagctaccagtattcttctattgccagcttccaaaatttcacacccactttttatagcaaaatcatagttcatgaaagaatttgtactcccactgtcaaccaatgttacagccctccttcctttaacatgagcaatgagagagaaagtattacttccacacatcccctgtgctgcttgtgtagatatttgcatcaactgtccctcctcttcttccttcttagctggactaccaggagctgtctggtatccagtctctccattctcctcctgagtttcttggggttcctattcttctttaacctcctccatcatatgtaccaccttgccaactttatatttatgttggtaattccatggttccttgcaataccagcaagttttcttttctttctccaccccttgagttgtgtttttctggttgacaaatctggtaccactagactgggcaggctggaattgaggtttgtttctattaaattcagattggtagcttagtctcttagcaatacttgccttctcatacaccttagcataccaatatcctgccaacaagttctggggcttttgcccacatacatcatgcttaatgtcagccctcaatcccccaataaaacaactcaaaatgtaagactccgtcaagtaaggatgatcccttttcactaaagaaacacagtcttcgaatttgtcaatgtactgcattacactaccagtctgttttgcattctgcagtagttccacagcttcatgggcattagcttcagtaaaacgatctaaaaccattagataaaattgctgccaatttagacagtaccagggtatggccaaatttctaaaccatttccctgctcttcccactaagtgtccagatgctaaattaacccactgatccacaggggtgccagtcatctcaaaaaacttttcacattgttgcaaccaccctacagcatcctccccattgaacaatgtcaattccaacctctgactcctcaatgacatttcagtataagggtttggtatgacaccatgcaaatatctaggtggttcctgccagtacatacctcctcccgggtttggcatccctgctcttgtgcctacagcagtaccccctggttgcctagttggatatctccaaggctgattagtgtcaatcccataatggttcatccccacatcctcttgtgactctctctcaggaaaattgaaatttcttctctctggtaacacatgagttctagtagcagtggtgaaaactgggccaaaagatgggttcacagtgtttggttcaatttggaagttcacatttcctacagaagtcatggcaccctgtgtttctgggcagaaaggatgggattgtcacagttgaggtcatgcttccagcattaacaggatttacctgagctcccgaagtcagtggcgtcgcaccagccccggtctgaagtccagtggtgttaggtcggggactgaaacccggtggtactgaagaacttccagccactgttgcagtattgctcaccgttgctgctgctgaagctgccaaccctgctgccccccttgcaatgccactagtactagctccagccgttcccccaaatccaggtccttgactcgacatactcgcacagatactgctcagaagtcctttaatttcacccatttccaaccgcttcactctcggatccgccatctcatgcctaatctgtgtgatttcagcacgaacatcaaactccccagcgctgtccaaactgttgggggatctggttcgcgcaggcatcatcgattgactgacgaaatcggctcaaggaattcacagatccctctccccttaagatctcgccgtctaggtctaccgccaacctgagtaggaatcccgagctccggagattttacagagaacacacctgcgtggttctccaaccctcgctcaaaacaccttctcctcgcttctcctcgcctccggttcgatccgcccaagttccagggattttacggtgagaaatccggagatcctcccaaccttcacttggtgaattcgagagccaagaatcgggctttactctgatacccttatcaaacccaagaaaattcagagccaaaaaatggaattctcccctctctcacaatctgttgggcaccgcaagactcggaaaaaaactagggttctaagctactaagacaataatttggttcttgttgcccttctcattagtctcgctgggttatatactcccgagcggatccaaagcatcagttttaacctcatacagcttagattcagcattcaagtaaaagtaaacgagcataagctcttaaacaaaaattacatgacagtggataagagaacagcgaatcgccaccatcgaatcccgctgtaaatacgaatcttcgcatctctaccattcattctcattaaatgacgtcagccaaacggtatcaccattcttcagactttcttcagttatctctgaacttttcttcagttatctctgaaatctccacttctgacacggatccgccggcgaggagaccggggtcaccggatccggcggtcccggcctcctcactaggagatccggcggcttattgggagggagcggcggcggtagcacagtagaggagagggagctgcggcgacgacggcgcacacgagcgcaagaggcggcgaggttgcggtgcgagctgaggaggtgggcgacggcgcacacgagcacaggaggcgggcgaggttgcagagcgagcggaggaggttgcggcgcgcgcgtagggagaggagaggacgggcggctagggtttgtaccggttggcgaaatccaggccgtccgtccataatccgacgatcacacgggtaaggaagggccggcacagcgggacatgtggacggccagatcgaccctacggtgagatcagacggtggaaagaagcgaggactggcgcataattaaccgaaagtgcaggggtttttttcgcaaaaatcgatgatgtggcactcctactcttccggcgttcccacggcttttaagtaaacctatatttgctggccaatttgttgatgattttgttctctcacatcgagaaaacacgcgtgtgttcttgtttcaaaacaaatactccctccgtttcaaaatgtttgacaccgttgactttttagcacatatttgactgtttgttttattcaaaaacttttatgaaatatgtaaaattatatgcctacataaaaatatatttaacaataaatcaaatgatagaaaaaaattaataattacttaattttttttgaataagacgaacggtcaaacatgtgctaaaaagtcaacggcgtcaaacatttcgaaacggagggagtatatttttctttcagaaaagataacttgttgctcgtattgttgtctgagtaatcagctaatgctccactggcatgcgtactcttctgcttgtgaataggcaccgagatttgttattgccgttcaacttcgtcatatgcttagtccatggccacacctccatttttttttgtcctccgccactgcttctgtgtaatagatgagatgactctcctgattaaattagtttgctgatgcatgtgttcatctggtcccagtttacccctaccttgatgccatagagtttgccttttaattaagcaagtcattttgcaatgcattatctgcatgctgcagtttagccattattgtgcatgcaactatcagcaggatggccatgctaataatcaaagacacgagagaccaatttttctgggattcacgcatgcatgatatggtatgcagatataagagcaagtacaatagcagactataagccagctataaacataattcgaggaaataaaaaaggagagagaagagcagcgggttaaagatttgtagccagctgcaactatatttgtgtatgataggtgaaaccagacattattaattgtgtaatatatgtttataggtaattgttgtatgaattgactattaagttgactatagaaattttgtagccaacaattggctatactattaaacttgctctaagctgatgcatccacctattgacagtgtgtgatcagtccatgatgggagggggagatcaacctgggtttatcattaccaatgccgcagcgcactgatgtgaatcatgtgatcgatgatgatcatgaggtttcttacagattaatctccctggaggcatcggggacaacatggtaatctctactgctgtttcccaggagatctttggccctttttaagtcctaacgtatctaaaattatatgtatgtaatatgtgccaataaaacatggcaggctgagagagagctcgcaacaaatttcctgttgcaggacaagtttgtcgagatgggatgaaaggcacaggtttgaattcattctcttttttcaaccatcattctgctcatttgccagtggtttggaccacatatcatcttgcattcttgcacctatggtatgcttccgagccaagctgtgttaataggaccacaatagtttgatgcacctgtagaaatctgctgttgcaagcatgccctgctattgtgaagttttttaattaattggtgattgtcttaaatttggttcaacaatctaaggggctatgggtgattccgtaatccatatacctaaattatccatgtattttttttcaggaccattgtcatgataatattggcattgcattggcaatattaccatgattatatatattggaaaatgaattatctttgcctgttcgtcacagggaagctacttgcagcaggtgaaaacattaggagttcagcgtgctgaagaatccaaatttgttatggtccttagttaagtgactttcagtcttagtcgatcttgccgcgtggtattgtatacgtatgacagattagcgtgtccttttttactttgctagaacacatttttttgcacattattcatggtgtaatttgcgtgacagagttgcttacattttattatgttttgttctctgttccctatattgacattagccattttctactaaacacgcaacttggtcaataatacaactatgtaatactttatgaattgtctgaaagcttaggtgttgttagtcttacgatagaaaagccactatgctctcaggcgcatggtttttcctactccttccgcttcatcttattataaagtcatttaatttttttcctaaccaaacttatttaagtttaattaaatttatagaaaaatatgtgcttaaacaaatatggttcccatcggatggcataatcagccaaagaaaaagccaaattttgaatttttaaacttaattttgagattgattttgagacattttcaacgtagcttcttttacaatattggcttttaagccaccaagaacacatttataaaagtttcacctacaaattcatttttatttcctaataagccgttttagcttataaggaaataagccaaacgatgggacctatatttttaaactgttagatttaataaaactagtttcatattttaaatattgttaaattttttatgcatctgatcaagcttaacaaagtttaactacggaaaaaagtcaaacgatgaaaacaaagtttaattagaaaaaagtcaaacaacggaaatggagggagggagtatcgttttcgttgttcatgttatttcattggccacgccttagtgtttttcattgacctcatccgctaaagttaattagttatagttttactatcagtacatgctaaaatgtcccaaaaaaagccaataagcaatacctactgttttgactttagtaacttttgtactccctctgttttaaaatgtttgacatcgttaactttttagtacgtgtttgaccattcgtcttattcaacaaatttaagtaattatttattctttttatatcatttgattcattgttaaatatacttttatgtacatacatagttttatatatttcacgaattttttttaataagacgaacggtcaaatatgtgctaaaaagttaacgttgtcaaatattttaaaatggagagagtacctttctgtgtgagcggcgacagctcacatccccttctagttaacgagtaacgactagacatgagacaaacccgacgctgcgtgacgtgagtacgtgacgcagcgtcgatgcccgcgagagagagcaatcaaccgtccatatgcctccctcccttccccctgcacgcatctccatgcgctcctccgctgccgctgacacgtgggcccgccatgtcagtgagagggagagggcccgtgagtgggtcgacctatatatgtcgctcttccactccgcctcgtctcgcttcaggccttcagcttccattaatttccttccgtgggtttgcgtgcttctagctccgcttgcttgtctaccggccatgtcttcccgcggcggcggggtagggggccggcgcggtggccccggcggcgccagcagtgtccgtggcggcgagcgcggacgcaaacgcggtcgaggtgctttggacgccgtggagccccgcgtcccgcttccacggggcacgggatccggccctggggctggccgggacggagccgccgcgccggtgccggcgctgcaaccggcggaggcggatgtgctcagcggcgaggtggagacggagatggcggccgggatggaggcgcgcgagggggcgtcgtcgtcgtcgtctgcttcggcgccggcggtgggggaggtcgagccgccgtcgcgggcggtcggtgcgctgccgccgacgtcgagcaaggcggtggtgctccaggcgaggccggggttcgggacggtcgggacgagctgccgcgtccgcgccaaccatttcgtcgtgcagcttgccgacaaggagatctaccattacgatgtactccatcccggtttcgctttgtattttagtaactttttttattaagttgacttctagtacaagaatggattttaaactctgcatgtcacatacaatttctttcatgtcgtcgaaacgattataaaaaaaattcaagataaaccgagtttagttccaaactttttcttcaaacttttaactttttcatcgtatcaaaactttcctacatataaacttctaacttttcttttctgtcacatcatttcaatttcaaccaaactttcaattttagcgtgaactaaacacacccatagattaatatgtagtaatagatcattccacgacnnnnnnnnnnnnnnnnnnnnnnnnnnnnnnnnnnnnnnnnnnnnnnnnnnnnnnnnnnn

SEQ ID NO: 41555 - DNA, 1670 bp, Oryza sativa
tgcattaagactcctttacctattaaattgtctcttcaattataatgaatacatcatgaagatggcaattgcctacaaattgaacacagggtgttgggaacaaaatagaactgttggatacgcgaagttgagcaaactaacaatcgaaagagatatgataattgcatttgcttatagagaactgacagagtaatagataatggaaaaattacacttcaaataagattttgatatataaatggctcctacaatctgatatggacagataacaagcacaatgatacaatatgtaaccactttgtttctgtaatagtaatacgaagttgaagtaatatgatcccggatgaatcaagggtcttcttctcatcagtatcaccaaatttaggttaattaactctaatttggcactaattatcaatatgctcgtgtgattagacacggatcttgctcttcaactcgttcttactcctaacgctatagaatctagagattgaaggctccagaaagtgagatcactaggatggattagtatttattttacaagctaaatctaggagtctagttctcttttcctttcttttaaatcatttgaccaagcaaggtttaaactgcaaatgttggcgatgttcaaactttgaaataactatatggacagaaaaaacaaaataaatatactgtatagaaagaaatatgcatgtgaaaaccgagaaggtagggacacacaaagaatgagggaagtaaccttaatcactggccgattggcccgaggaagagattcctttccactatatgacccaagaaccatcacatacatgcctacagaataaaatagggcatcaactagagcaaatgaatcaggatccaggaaaagtaccaaaatggctataggtctacagcacaaacagagtaaaaggctaaaagctgcgcaaaagattaagtagcactccactccactttgccagcaattcggcatgccaattggatggtaccatagcaccacatggcagatgagaaatcaagcatgaagcgcaaaactattttgaacaatatgcttgtaaaccaatagcattctcgtaaataacacatgttaccatctaaggacaaacatgccctgacaataagttaggttttgatagccaccctaatggcgaactagtgattattaggatagtgtatggttccagagttgatggaaatctcaatccgtcccgccatgaatcacatgatacaactaatatgattaatccacaactgcacaactatatgtgcattttgacgattttccaacaaaaaaaaaggggacgccacgagcaaagaaacaaaccttctcgccatggctgcccctcggcctccttcggtgtgagcgtgatctcggcgacgcaggagccgtcatccacaagaatgtgcccggcgccgtcgcggtagtccgccagcaccaccacgccctgcctgccgccacaagtcgtcagggagagatggagctaggagatggggggaatagggaatggtggggaggcgacctggagccagacgcgctggaagcggatgccgtagagcatctgggcctgcgaggtgccgtccgactccgagggaggggcctcggtggcgccggccagctggcaaccgaagagcttcagcgccgcgagggtgtagtccatgttgttccgctt

SEQ ID NO: 41556 - DNA, 24021 bp, Oryza sativa
ttcctgcagcccacacaaacgcgaactgcttctggaccagactcttccttagtatatccatcctatgataaaattaaatttgtcagaaaatggaatatgtcatgcacagcagattatgtccaaagcactatttcactaacatcatggaactatggaagtaactccaattaatgtattcctttagtatatatatatatatacatgtatccatatgacaacttaagttcacgtttactttaaaaaaaaaaaatctatgcaactccatgatataactggttatgtatgcataagaggaaggctaatgaagttaaatggaagcagtaataatataataaaaaataatggaattttcccataaagatcaatttggcaatgtcatacctcgcatcttcctttcttactttcctttgcaaggcagaagctatctgtaattccagtctgaacatgaccgctatgaactccacccttttgaagaccaaacttgggaatgacatgatcatcgaacaatgggtttgagccatcgtgtataccatatggtttatttgatgttattactgttatgttcatatatttaagctcggcgaaatcattttcagattggcaattattgtcattgcgcatgctggatagagctacaccagaagtaaaggaatcccacataaagtagctctgcattaggtcagcagaagagaaaaataataataaggtaaaagtgaacaggttcccatattgtaccaaacataagatctaaggatataagcatataacttactgtatagaattcatcattgaaccatgtgtctcgagccatttttaaagagtcaaaacaatattgtgcttcatatgtactttgttgttgttggaatgcataaaagaactcctcattgaccggaattgtattagttgcatcaagagggacaagggtgattgcaatgccagaatggaacacctgaaatgaataaattatattatactagctaaaggcctgtgttttgctacagataacaggaaaaatatcaccatatttctaaaatgaataaatcatattttccgtgaaatatgttatccacattttccctataggaaaatgtggctatccacataattttatatgtggctatacatttattaattttatatgttgctatccatccaaatttagttcttatgtaatattaagaagttcaaggggtaatatgtaaaaattgtaatgggagtaggtgggatggcagattcactgccaccaccattgagtctttttaaggagtatagataatctgctagataaagattaagaatgatgaagtaaaaaagagtttagatataagtaaatgtggcataaaattctttcttcaacaaaagaatcatagatggaagttttcattttagaaaccaagtcttctatagctgttatatgatactagtctaataaaagagttcaagtctcttagatacaaaagaagaacaaggttaacgagtatgtcagcatgtactaattgagtacatattaatttaaaaccaacagaggaacttaaggtacatattaattaagaaaagcagtacaggatgggatgaaatgtaagtttctgactttactccttatggagaagagatactgaagaccttaaatttaacgatagagatcagatcagtaaggcattgcaaaaatctacttccaaatttcaacaaaagaaaacggtggcacagcctaacatgtaaatctgggccatatacctgatatgcagcaaaaggatctgcaaacatgttgaattctgcattcggattggttctgtagctagtaaacaggttaccatggtcaccacactgctgtggcgtgcaagatgtggtagaattttttgggcagcaacctgtagggttctccgatctcactccaccacccataatgtatatgtgctccacattttttttcaggtgtggatgtgtcataagaaaaatggcgaagttcgtatgtgaccctattagcatgacggttgtagggcctgctgatattgtctctatcaacacttgctgtgctgtagactgatgaagtggtatgtatcttctgttaccctgttttacatattaaaagagtacattggagctggtaataaaaacgaaaatagccagattatccagtaatattcttgcagaaaagatcaaagcacacttcagcgattgattgatattgaaaatgccaaatggcatccccgaattccctagacccagttcactgatactgcaaatacaagtgttcagataacagcaatgatttttgagtgtcatactgtcatccataaattcttactagtcagcttgcctcaaactacaaaccaattagagaccaagtgaaagatgaccagtttctagagacatttatacaaatttgttgatatctgcccttctgcctgaaatgtttacaacatgactttgttggaagtcttaaagaataatagaaaaatccatccaaatagtcagtgtagctctttgaaatagacaaaaagaaacatagagcagtcctaggagcacattgtcaatatacagagttcttgctggtagttttgaagttccaacaactttgtgttagcaagacaactgctaagttaacaaggaaatgagaaggagagaccgtaggaccaaattttattgccgtgtttgacatttgctccgactaaaggattttagatctaaggatattagatactccactcaacttaaagtacctcaatttaaaatgatatgttggcacaaaattatgtagtggtgcagtggtgcgaaaactgaccaattttaggaacaacgacttaactactatgtgcactttctttgcgagagatgcagtgtgcacttatcctacctgaacaccaaaattgcggcattcgacaagaaggagcacaaaatgaagcatacctgtggaaggaagccttttcttatgccagagtttgtgtcgatgtccaaccgcccaccgccttcaagtggaatagcctgcctataccggcagggcccaaaggttgtcatgccctaaatttgaacgtttgtatattagtgatcctaaaaaagcagacataaatttgggcaattctactacatattttggtctagatcataacaaagtgatgaattctaaattgtacctgatcaatcagaggtaaataaccaccaacgttcgggtgtatggtgccatggcctgatataccaccatcaccaccaacaccaactgggatgtcatcacggcccatcatgtatagcatatcatagagatgattcacagcatgaccagcatcggtccacgcattcacgtcgatggtgaccgcctgctcatgtttacaagaagagtaatgtaccatcgatttcttgcaaagacccacaaagaacttgtctaatactaccatagataatgtcagaagaaaatttgcataatcagtcggtgtaaaatcactatttaactgagcggctacatcaatccttagcttgacacacaatcgctgtaaaatcatcatcgattccaaatttccgatcaatagctaccgattgctccttgggtggctaatgcgaacgcggaagaaacaagctgcttcgatttctcaccattccgcacattccccggtagcccgcggcagcgcggagaactcaggccagttgcctcgagtgtcccagccgctcgcgcagatccccctatacgggatcctcctccgaatccacggtgataggtggagtgcgccatcgccacctagtttgaattcgcctgccgccgccgccgtggtgtcgccgccacacttgctcccccggccggccgctgccctcggcatcgccacgcgaccacgtatcccgccggagtcgacgcgacgccgcgctccgtccacgggcgctcgtcggtggcattgtcgtgtggccgtggtggtggcggcgccggcgccccatcccaccggcgacctcatccgcttcacaaatttaatgggcgaacggcccaaaccttgaaagtatccggataggaaaaattattgatgggcctaaatttgttgctaccctagttgagcttgagaatttaacccgttagtgtaactgtcagttgcccgatcttcttcagttaaaaaaagaacaatgagttcagagctttgcaaaaaaaatataaaaaaaaattgggcagatttttttgaaacaaactcagtcgtccgtatatcttgaaacttgaaattgacgaaatcatcatggacatctaactgttaaagggtacgttgtctaccactgaaggaataattagccgcaaatgcgaatccctgtgtcaaatctaggacttaaatccaaatggattgatttaataaaaaaactaaccagttgagttatgcttacttagcaagtttggatagatttgttagagcaattttcaacgtgtacggtgtacccccttagaaatggccaaatgggtacctgaatattcttaacggattctggtcaatgcattgatcggtacaaatcgtggtgaagttttatcacgaatcttcttgtaaaagaataatctagcctgcgtgaacactcggtaaaggatccaatgtactgctacaagacttctacacgctcttttttttcccgattacacataaatgctcaacactaaagatgtaatgccacactcacacgtatgtaaattatacccctaacacatgctcaaagatagaaaaatcaacgacgccggtctcactaaatttatgcttaaagttcacttacacttaaataaattcatgtatattaagatttaaagcttagtggattaatacgattatattattcttagaaaagtaatgtgccaagcaatctctccgcgcgatatgtgtcgttttttatgcaaaaaaatatgtgacggtatagacgtatcataacaaatatcatattgatatatactagctatggaagtaatctattatttgagataaaaacaaagagagagaataatacaagtttcgatggcgcccatcctcttagttagcacaaaaaggaatcaacaaaaatgttggcttacatacacacgtcatcaaattcccaaccgaccaaccgcaagaaatactctttgaaattgagttagctaatctctcggttcacttttgggagatatatggcttaatcatgaaatgtggtggtgaagtgcaggtagcatatagtcaaagggaagatgctccatcactgtcttgcctatagctaactcctgtactttaattatgctcgagtaatgacactgccatgcaaccagcaatgcttggggggggggggggggcagttgaatttgcatgtaattaggagcagattctgctcgttttgtttgaaggtaagatgtttttgtattatgctaattaagttaaacttatttaagtctaaccaatcatgcatgcatcatatagaaaaatataatgtagtaacatttataccaaatttatttcattgtattaactgttgaacgtgtatttttatagtatatttgtttgatattgaaaatattactgtattgttgtataaacttgatcaaaattaaatgaataaaaccaaaatatctcgggtacgtcttaattaatttacatatgctcgaatacaagttcgtggcgcacgcggagagatgatcgatcaacgtgatcgatgtatatatatatatttatgcaatgacagaacttctacaagtttgaccaatttgctagcttgcttgtattctaaagcaaaatattaacgggcgatttgagtacgagtcaggatcaagttgaattatttggagagaaaaatatgcatatagctagtatagtacacaacacgaggtcgggaaagtttgcttccgggaaggcgggaaggtatatatatagagagagagacgatttctcattcattaaaaaccaaaagtccaagatacgtacgatcagccatttcacaagtccaagatatatacgtttgggtcgacttcatgggtagttttgagtgttaggaacgagctgttaagtacacaaaataaggaaatgttgtataggatttatatgttatgttatttatacagttaaaaggcatgaacaatattggtggcatctacgcgatgatgctaggatatttggtgggacggaggatgtaaggagaattaatatgaatgtcctttgttgatcccagcacacggtttaataggcaattttacaccatactagcaaaatacttatgctttactatggataaaaaaatatatatattataataatatcattgaaaatatatttttattaaatatattagtatcacttgtttatttatttaaatatatggtattaacttgtttaaaacaaatactaaactatgttaaatatcagaaaatatcatactaacttataaaaaactacaaaacaaatggtgtagatggtaaattcactgccaccaatagtgtcttttaaatcccttctctatcaatatataaggcaaatttcttgccttcttttcaaaaaaaaatagtgtcttttaaaagagtatagatttccatatatatatatatataattataccagtaattatatgaatttgttgtaaatgaataagcaaacaatttataagagttgtttgtatattatataaatattgcataaaaatgtttatacacatagcaatcgtctaaaccaatgtttatactctttgtttatgtttatgttaagccactacgagttactcaaaatccaaaattgaacacaaaacaagaggataaattaaagggacttggtaaaccgtacatgtggatgcatgggatccttttccttgtcaggtccaactgtcggctctactagtctgctgctgcagtacatggttagtcgtgacatgcaccgttttgtttggaaatgttttgtcggccatagacatcgactgaactatgataggaccgaagatgttaatatggatcgctcacgagtacgtactgtatggctattatatacgcattcgacaaaaaaaaaagaaagaagagcaatagtagaaatgaagaacagttatgaggtttgccagtattagctagctagctgcatgtgcttcattcatggaaacagcaatttttggtttctttcaagagtatggagctccaatcaaaagcagcaatatattagttgtcactgcaaggaacgatcaaaggcaatgcctaaccaacgtattatctcctatattttctttgcttggatatatatgatccacatgacgataatcctagttaggcaggaatgcggacttgcagagaaatgcaagaaggtaagcaaaaccattactactactactaccaccaatcaagtcatcaaccatgcatgcaagagaaattaagaagctatacacgctacgtgctgagacgtacgtggctgcagcatcaccacactaaccttgagctcgaactcggagcggttctgcttgaggaggtagagcagcgcgaagaggtcgtcggtgtccatgtccgtgtccaccagtatcctcctcggcttcgccgccgccgccgccgccacgacgacggcgaggaccaccaccagcaccgccgtcgccgccctccgcagcggcgtcatcttcgtcccgtccgtcatctacacgggcggcggcaacgacaccaccggcgcccgagctggagactggagagagagagagaccctgtgtggcagtcgccgtagtctgctatccaattcagcgagcagttaacggaggattggatagttaacgaagcaagtcgagtgagctagctaccctgccaccatcagggtccagggcaagccattaaatgctatagctcgcgcgactcagagagagaaggacgattgggtatgggccgtatatatgggcgtatccgcgtatgcgtagggactagtaggaaggctgttggcacatgcacactcatactagctagatctacaaatggatggattttaaaaacctaggtgctttcattttgtaagtatatgcatgctatctcaatatatgtttttttctttaacaaggtaatatatatatatataaacattatctgtcacttcataaatataggaagttacatttattaacacaaatatgcagagaaaacagtatcaccaacacaggaaagcatgtctacgctgccagtttacaaacctcatgcaccgtagatgtcatattcgcagccggcaccataagagcatcactgataaaccatgattattgtttacaactgacacacataggggaacatatatatggccaattcttatttacaaccggtacatatatgagtcttaagcttagcagggacatgttgacaggctcatatcaaacccatcggcaatagtcctactgtagacatatacaaataattgtctaactaattaaaaaaattaaaaaatccttcttccaccaacaattataaggaacattccccgcaaaaaaaaattataaggaacattgaaatgaaggataggcaaaagatttttagaggattgttcatttcctttggaattttttccatggacccatttgattcttcataggaagaagatataatcttttttttcaaaagatctcattcctatagtcaatttcataggggaaatgagcaagagattaacctcttgtaaactttcatttggtttaatttttccaatggggcaattaaagggcttctctttccggtggttgtgtttttaattcctatagggttggggaaaaaacatgctacttcgatttcaacggtcatgcatatttttgccaacttcgggtggagattcacaaatatgattcaataattgtgatttatttatcttgtgttggtgcctattagtttgtatttgagtattgctgaattcaaagtgtgtcttgtgaactctgtggtgtgtgatcgctgttaagcaagtctgtgtaataagtggttgtagctcttttttagtaaaggccggagttatttccattatctaaaaaaggagtgtaaaaaaataggaattgctcaatcacgttgtttagatgcttcatggaaatagtacatgaatttggagtgagagtgacacaaaaggaattgttcaaaaaggtttgatctcatgttaaatatcctataaaattccagtaatttttaaggtcgttttatagaaatttcaaaggactccaaaagagcccacaagaaatttcttccaaatatcatgtgttcgtaagaagccttaaacattatatgccacttcataaacgtggaaacattatgtccgctccttgaataaccatgtatatttgtgattggaggtattaactctgttttacataaatatatatatttatcatattatcaatttttaagacattatgactggactcgtcttattaaaactatctatcatttatttaattgtaaatgtttattgctaaagatatcttaagaatgcatggtttatattttcttatatttacattagttttaaaaaggtaaattgtcacaacgatgtgttaaaaagttagcgtcatatatttaaaaagaaagagtaggacttaatgtacgcagaaggaataatataatttcagatccatcgttcatagtcctgcggtacacgcacactgtcgaactaatcaatcccttttcctggatatcattgtccccctttttctccaaatacctttggcaatagtacgctcccacacgttaaactcgtgataccctcatgcccatgctaatatgctaagtactcccttcgtcaaaaaaaaacaaaattagaagggaatgtgacaaaattagaaggggatgtgaggatgtgaccatacaacaaatctaggaggagtcacatcttttctatattgtttttttaatgtggggaggggggagggctccataaatgattatgagtgtcttgtcactcttcatgactgttggcagcgtggggtttggagatatctggctgcggagagcccaccggccggggcaggtcccaatcgttggagctggagtagctgacaaattaagtgtgtatgaagatggcagaatggggtagatggaacgaaaagataagagcctttttggcttctacgtgatgtacgatcctaagagctaatctattaagaaaaggctggttgagagtggagtacttgtactggtagctaggatcgcgacctataattaattttatactcgagattttgttagcttgcacgtatgagcatttttttaagcaagaacgtacaccaatttgaggttgtaattgtctctaccctactcgattgataaaatcatttttcatggaatgattgtttcgtgttcatatcagtcaaccgtctattatagtgtgtcttttccgccatataatgagataaatacaagctactctcgtaaaaactactccctccgtcccataatataaggaattttgagtttttgcttgcactatttaaccactcgtcttattaaaaaaatttagagttattatttatttttttgacttactttattatccaaagtattttaagcacaacttttcatttttttttatatttgcacaattttttttaataagacgagtgttcaaacagtgcaataaaaacttaaaatcccttatattatgggacggagagagtagtgaattgtacccgagtcatctcctctcacagaccggtgctcctttttcctctcttattctcttccctttacttagtgaagtttagcggtgtctatgtataactattttattgtttctctacatgctctaaatatgacttttatactgttatagttcttatatgttttccatatatatagccctcgtgtactctagttattcattgctttatgaatgataccatttgaaagcagaatgtattatactagtgacataaaaggaagccattgtgctcgctctcgtgacctagaaattctctaattaatccgaaaaaaaagaaatatgaattattaattaaaatgtgggttcaaatcctatctttctataaagttaaggctcactacatcctaaagcttaacatgcaaatatgccacatcatccactaacatttactacatctcaaatctcatgcaagcatgctaatctattaagttttagagctttaaaatgcaagcatgttaattaaattatcatcctacataattcacataatatttcaatatatctctgcatcattttttataatatcttatatacctatatagttcatcctcacttaaatttaagagctttaaaaaatccaagcatgttaaatcatcattccacataattctcaaaatattttcattttgtataatatctatatacctatataattcattcgcacttagttaatgttatttctctcttctctcattaagccatatcacctcaattgtttctagccctcaaatgatcaatctatggttggaattatctcccttattttcttctctcataaagccacatcatattacttttaaatttgggtcattattctatatactatttaaattatgataaaccacatcaacttatataagtttctatcgtctagctatcttacacattatttctatttcttattatcataccaaactcccacagcaacacgcggggtttcatctagttactacagacaagataaaccaaagaatccaactaggaaaaaaataaaagagagtacatataaaactagcaattatatatcgcatgcaaaaaaaaaattagaaccctaaaattttgattgaaagtctatcagcattgtaaagtttgaaaccaaacattcaattccctaaactttagaatacattcacacaacctcctaatgtgattttacaaaatggattttatttaatttgtatatacattagcttagctttgatcatgtgacataagcattggatatatatgttaaagttttcacttaaatatttctttttgcatcttgtttgctttcacttacaagaaaagtacaagttgtatgatatcactgtacagcataaagttacaacctacaattgatgatgcgtaaaaatattgtaaagttcaggaggttggatatctggtttcaaagttcacggggctaaatggagtttaatttaaagtttagggggtatttagactttttccaaaaaaaatataaatgctataactggaatataagttgaaatattaataaatagttcatgctaaacataaataactacaatcggaaataaatattaaaacctacaggttaaattaatccattctacaggggaaaataagcatgatatccactaaattaaaactgataaaaatattagtgaagatgagctaatttctagcaggatgattcttacatcgatgttattactgattcttgctacataaggatagttcaaggttgaagcaagtgcgtagaagaagatttaaagcttagtcttctaatttttctctttctagtgaagttttctgattttctttcttattagtcttctagctttttttctattttttttatattccttagttataaggcttgggatccaagtactcatatttatagtggttggttagaccggatttcaatctgttacggaatcgctgaggccaaaatggtgagacacaggtaatcaggaattcaggatttttagatgacttacagattatagaatcatcaacgggacactgggatttgtagggattcaacatgttgatgtgttgcctcaggtacgggctccaatacatgttgatactagtaggctagtagctcaatcgtactctatttgtcccataatataggaacctagagatagaatattttatatagtaggaaaaagtatgaattacccactaatatatcgtgttcgctcgaattacccattgcacccgaaaaccagatattgcttaccctaaactttcaatataataccggacgaattgcccccctcgatccaatcaaagcggttttatcttgcgtggcgtacgcgtggcaatctagtcagcattttcttttttaaaatagtgggacccacctgtcatccctcctctaaccctcttcctaatctatctatctatctctctctcgcgcgcgcgcgggcacaaggcacgcacagcggtgcatgtgggcggcggcgcaaggcgagatgcaggaaccaaaagccggagctgggttgtgggaggcgtggaaggggtgcggctgggagggcgttgcggtgggcgcgtggggtggtgcgagacgcaaatgcaggagccggagggcggagctaggtggtgggtggcatggaggggacgcggctgggagggcgaggtgctgcggcagacgcgaaatcaggctcctcctccgcagtcgcctcctcccgcttctgcctcaactcctcctccacgtcctcttcccgacgccgctgcagcgtggccgggttgatgtcggcaaccgcatctgcagcctgccgtgaaggcggatggcgcgatggggaaagccggagcaggcggcaggagagaagccgccttcgccggtgaaggccaagcggtcgtcctcaccaactaattaagtccaagtcgtcgggtaaggggaagaggtccccgtcgccgactaggtccaaatcgatagccatgggtgcggctgggagggggaattagtcgcgctcgtccacgaccacacggggatccccctgccgccaacacggtctcagcagcagcgcgaggcaggctcaggcgaggcgcgcgtcacccacaccaccaccaccttcaccccgcccacttccttccggccttttccgcctcaaccttggctgcggttgtggcagccgatgtcctgccttcgtttctgacgtcgccgcctaccgtccgtccccgcgcgccgccgtacgcaccgacctcctgcacttggcaacgccatagagagagagggggggagggggaaggggaagaggagaaagaggaggtgagagactatgacaggtgggccccactatttttttttaaaaaaaaagaaaatgttgactgggttaccacgcatacgctatgtcggacaaaaccactttggattgggttgagggggtaattcgtccgatgttgaaagttcaaggtgaatgatatctggttttagggtttaggaggtaattcggccaaccacaaagtttagagggaggggtaattcatactttttccttttatagtataatgaatcatataccctcctgcctaaattttattcggttctagattactatattatggggcagatggagacatagagtaactcgcgctgttggcatgtgccatgtcagttctcactagttttgtgttgtgtggaacatttcattccacaagttgagcaccaagctaaccactccagcacaagttcgtttacagtgtactcccaagctctgtttactcctctttcacatgcttttactgcgtacagtggcaattcgcgtccaggctctagtatagccccttctggacaagaggttcaatcgcaacatgggccgaggcctactaatgtgacgaacgtacgtacgcgatgagagtattgatggaataaggtccttttaacttgtcgacgaatccgattttcatactttaactggaaaaccagatataataggtctatcaactattaaaaccggtgaaaaaggtccctcgacggttttgatggcgattttggttgacgtggcgcgtatgtggctagtttaactcggtcttgatctgacatggtgcttacgtggcaaattgatccagaaaaataataaaacccgtgggaccacatatcagtttcgcacaaatgataataataaaatggtgggacccacgtgggccccccatgtcatcctcaatcctgggtgggcggcgagctccaagctgacggcgcccggagcgaggccgccaccgccgtcgaggcggagagggcgtcagcgggaggagatcgcaacggcgtcggagcagccggcgaggaggtcggcgtagacgtggtcgaacccgaggagcgcctggagcatgcaccgcctgccgaggcgtgtcgccacttctgcgacgcggttgagcgcgtcgagcttctcggcgagcgtgagcgccaggagccacgagtcgtcgcctggcacgagcgcacgcacggcctgggagccgaggcagagcaggtgagcagccgcgccgcctcggtgtccgacagcgagcggatacaggttggcggcgcgcgacatggcgttggccacatcgaatgacaggatgtcgaccttcccgtcatccaccccctccgccgccgccgccgccgcgccgcgccgcccttgccgctactcgtcaccggcttcactttcctagacgacgacgtcgccatggacaacaccttgtgcaccagcgaccggcctccatggcgatttcttgattttcttcttggatcaaacaaagattaaccaaaaggaggctaaaaagtagtaagaaaaatatctccgcttttgcaccaaatccagctaaacaagaaaccaaccacgagcagtcaaaacagacacaccgatttttttcaaatcccgtcgatttgaaattcaaacctaaatcctctgatttcttcgttgtctcgctagtagcaagcagcaggagcaattaatggcggggagcagagctaaagcaaacaaacaaattaaacaaccaagtaacgagaaatggaaaaacaatggagaaaggtgaccacgaagacgaatcatggcctctcctgccgccgccgcgatctcctcccgctggcgccctctctgcctcgacggcggcggcagcctcgctccgggcgccgtcactgcagcgctcactgtccacccgggcccaaccgcctcggtgcgcctcgcctccgcgcacctggcctccgtagatccaaacgtggccggagaggggagaggaaagagagaggagcgaggatgaggggagagaggtgaacagagtggagacggggagagagaggaagaaaataaggggattggggatgacatgtggggcccacgtgggtcccaccatttattattattatgtgcgctaaactgacacgtgggtcccacgggttttattatttttccagatcaaattgccacgtaagcatcacgtcagatgaagaccgagtcaatctagccacctaggcgccacgtcagccaaaaccgtcaagggaccttctttacactgattttgatagttgaggaacatgttgtatctggtttttctgttaaaagatgaaaatcggattcattagcaagttaagggacctagataaacttattccgagtattgattgccacattaagcctgccactccaagcggcagtatggtcggtgccattggctggcccatcatcgtaccagccagtccagccatatacgagcaaggaaaaagtacaatgaagatcctgaacttgtcatcgagttaaaaaactttctcaaaccgtaaaacaggtatctgacgtctcttaactaattaaaaccgttataataggttctatgacagtattgcacccggttttgtcagctgactcagtataggtcccacatgtaagcctcttcttccttcctctctccttccctttccctttccacgggcgacgggcgtgcgcgggcggcggggacggagaggttgggcatggtgaggttggcgcggccggtgggggaggagctgagcgcagccggcggtcagcggggcgggagaggaggagggcgtcggcggccgaagacgggcgacgcggcggcggtgacggctgcgacgcagcgccggtgatggcggcgacgggcaacgcagtcgggtgcgtcgcgaggaaggaggggacgaggcgggacaagcaagccgccgggacatcctcttcgccgccgccggggggccgcctcgtcgccacgacggccagcggcagcaggatgggaggaggcacaagtgcaaggtggcgccggctgcgacggggtgcgtggcgaccgacagcgggggagaggagctgggcgcagcaggcgaagatgggcggccggctcatccccgctgccgccgcccacgcccgcggcgaacggtgaaggtgaaggggtagagcttgtggcgacggaacttagggaagcaagagcggagggcgacgtcctcggcggcggaggaggagaggctggcatccccacccgcgacatccccgtcgacctcgtcggcgccaagctcctcccccaccagccgcgcacgcccgtcgcccgtcgcccgtcgcccgtcgatgtagagcaccaagttcatctccgcctggcacggcccgccgcagaacgcctccgccgcctccgaatctccgatggcacaccgcacacctagcgcgccctccggacaagcctgtactgcccctggcacccgctgtagatctttacccggccaccaatgcaagaacacacacatccaagattgcagaacgtcaaaaacagagtctattttctacttgaactcttttttctttcttttttggctgaaattgtttcaattactgctcaagtttgatttcgaactatcaatgatgtgcttacatatctatcgttgaagcagatgatggccccggcaatgatgtcttcagtgtttcttttctgaccatggaagggtgttgctgcctcgtctgcgacggcgatggcgacatgcatctagatggggctgtgagcagcacgatgggcagagcccggtcgggaggaggaggacggcgccggagacggcgagcgtgaggaagccgacgacttgggtggagttgggcgcgtgcgtttgcaccgccggagcgtcgatgacaagtccgccgccgcgggcgcttaccttacccatggcgttgcgtcggacgtgcgcgtgctgctgccgatgggaagaaaaaaaagagtctgacatatgggacccacgtgggtcccacgctgagtcaactgccacgtaggacaaaaccgggtgtaatactgctctaggagctattgtaaccggttttaattagttaagagacactggatatctggttttgcggtttgaaaacgtttttttaactcgatgacaagttcagggaccttcggtgtactttttcctacgagcaatttactcctcgtgataggccttcaatggtgacactgtgacaggccagaccaaccgccgcaatctaatccatcccacccaaaccattcgggcccgcgtagcaaagccaccgcgctttttcactcgtataggtggatcatcatcccgctttatgcattgctattagcaatggcggagctagaaaactttttaaacatagacaaacttaaatatacctaatattcgctataattttataactttatttagaaaataaaatttcaatggtgtatttagtggcgagcccaggcggctacctggcttgcggtggctccgcccctagctactaaagtacctcacaattagtaaccatatatagtctctcgctagtgataaaaagacacaatacatgtctatactacttaaaggtaatagtgtcaccatcaaatcacggcgccaatgtcactggcgccccactcctgccacgtcagcttggctcgccgacacagtgccacggtggcgcgaggacggtgccaaaggtgttggcgccaccatgttagacgacggcgccagtctttctgttgtaaaaaaggatcatttttagaataagtttttccaagggtttatttataaaataagtttttcaaaataactaaaatgtaaaaaaatattagctttctgttgcagtgcttttgttagagtgcgcagcccagcccacccaggtcacattgggcctgctctaccacaggcctaaccggagccacaactttaggtcttgggcctatacaaccaaaaagactagtctgatgggtgaggaccgctctcaccttttaagtcgtactcacatatcatcaattaccgatgtgggactaaacccaacagctttatctcgattagaaaaaccataaacttgcaagcttttgtagtaattttaaatgagatacacaatacaaattatcacgagccattgacggaattttttatttataataattaataatatttaaattaaataattagtaattccttttgagtatttaccaaaataagaaggacgctattctaaacagcttccgcatcaggacgctcctgtaaacagcgtccgcggatggacgctaatccaaacgacgtccagaccggtgtagccacttcaaatgcagcgaaccgagcaaaaaaaaaaggaagaaaaattacggtggcgctagggtaggttgccgccgccgccgttgcctccttccaccgtttgcctcaacatcgggaggctgtagcagacgcccgcccccaggaggccctcacgaccgcccgcatcgattccagaggacactgccattggcggcttccaatttgggaggccgaaggttgttgtcctccccggaggctgctgctgctatctgctcgactcctgggagaccgttgaattccattatcctgataaagtacgtatgaacacaatgtatatagcagctgatcaatggtaattagctaaacgtatgcatgggcacctgttacctcccaccgaaagacataagtagatcaatgtgaaagacatgcatgtcttgcagttcacctgtcaccggcgagcagccaacgaacttgccgctcaagacgccgtggctggattgatggcgctgagtaatggacaaatccaaggcgccggcgtcgacaaggatagtaacagtggcgacgtggtttgtagggcgaaacgtacggaatacagccccccgatcgaaggcgaatacgacgacactggtgatgcctgaccctagctaggttgaacaacttttgtttcaactagaaagatagcccgcgcacatgcgcgggcaccttcttatataatgagtgaaattttattatgaatatttatatgtgggtgttttttattaaaatattttttattatattataaagttaaaagtattttgtgtgatttgaaccctgattattttcttataattacccttgtaacatttaaattctaaaataaaattactcgagaacatgcggttttgaattgatgagaaaatattgtgtcgaaacaaaggaggtggttcctataagaaaattcaggatatttaactccccagtaggatatcttacaaccaaaaaatccaataatatcaattttttgattgattgtattttactttttatatattttttcattcaaacagaactcgtaaaatgtttgaatttttctatttacagtgggttttaaatctagcaacatttgctcaatttccaattgtaaaggctgcctcaaggttgtttcactgctaagattcctaggtgcaacccacatgcttattggtatgatgttcaactggccacacatttatttttaacctattgtctatattggtagatgaatacctattatgattagtgacttcatagatcatatgtgtaattgggatgctatgatcatctttcttatgaatatttatttatctcctaataagatcgttttaaaagtatcaaggtcaatttgtatgtacatagccctcataggcatgttaagagaaattaattaagttagtagaaagtcgttagacgcctgacaggatataagtaatagatggaggtccatttgtgtcttttttacatatagataattttaattttagttgataaggagataaaaaatagagagaaaataatggcgcacgctgtacgcgagccgggaggaagggagatttcggatgttctttttttaaatgattaatctaacaaactaaaattatgtgtcagatgtttaagtcgaagctgatggtcgaatattttgttttcttgtcagaatttttacgattttctcttaaaatttaagagaacgacgtaatatcttaagagagtgtattttctccgatttaagagaacgacataatatcttagaagcatttataagatgcgtactttttactgtgttacaatgtggggggctatttttttaatattactcatagatctgttcattttacttttattatatataatttaattattatcaagttatatacgatgaaaaaaatatatatatcattaatttttatagttttaaaattgcttaaatgacacgcaaaagtcagaaaatgtagccccaattaatgtgacatttctctctttacagttgaattaaagaggacatgagttttaaaatgtaaaatatctaaagacatcagcagatcaaatattagcattataatttagatgctgcatttgcttaattgtttggcatacaatttttgcttttctaaaagaatgaaaataggagaaaaaataggtgaaaaaaggggtgaaagaattaagggggggaggggttgagcagacgtaagtacgtacgtacatgcaattgccaacagggcgaggtgggcctagggataaggatatgtttttttctaataaatctaatggttacaaataatggtccacaaagtttaataaaaatcaacagttatacgttgtgtccttttaagaatttctctaatttataggatgccacgtggcggcttaggagcatttataggatgccacatggaggcttagaagcgtttgtaggaagtttagtgttgattaattttttattataaatccttatgtggaagacttttaaggaaaaagtctgaattacacccttaaacaataagaacggtacaaattgtcccggttatatataatctgatctctcaccatcgttcgcaaacatataaactaatatattttttgttttgttttttcttttattatacatctgatttacctatgtatgttcatgggtaatatacgatggaataatctatattgtcaaaattatttgtcctaattattaacattatatagatgagaatgacataattaaaaagatataatgtggttctatgcggcattttcgatgatatgtgtatatgttttttctagcaaatactaagcacatactttttccttttttttggagacaaatattttttctcttagggtaggtgtgtgtatgtgtatttatatgatggatgagcacacgtttatatatgcgctcgtgattgctttttttaaggaaacatgattgccttatacatcattagtaaaaaaatactttcaaaaaatttagcgagatggcgtgaagcggtgctgcggccgcgtgaattctttgacaaactcgccaagggtggttgctactcatatgcacaatttgaggaaaatctcaaagctacaaagaaagaaagaaaaaactactcgatggagctgatcttgtacacattctttttttttcctttatgacatctcttgcgtagatatagatataaaataatggttgaaaataatatatccacgggttacgtataaataagtagctagattttgtttttttatatatatgatgacccttatatatatacagtacgtactcctgggtgtatataaccatttttctatatattttttcttagataagcacgggatatgcaatatttgatatttaattaatcttacgctgatggcatgcttagtttcgtgtgtcctagataagctcatccaatgagatagaccgaatgaagcttaagagataaaagggcatccacatggtgtaaaaaatatatatggttgttaattttccaaaatatatatatatatatatatatatatatatatatatatatatatatatgaatatagaaacatagaatatatgaaaatacattcttgataaatttaataatgtcatttggatatatcagtattacacaatagggagtgagtaaatttttaaaatgctactcaaaatttaaattgttttttaattataagtccaatttaattgtgatatacaatcatatagtctataatgttaattattaatatttttatggatgtttcaatgagatgtgctatttagaataaaacttaaaataacatatatttttacaacttaaaacataacatatggttaacatgaactttttagtttttcatctaatctaagtatataagaaggaaaaagaaaaaggacatagaggggatatgtacgtacatcggacatacaaacgtacaggtccaggggacacggccgagtaacgtgggattttttttagatagattgatttgttttttcttaaaataaagatatagtggttaaaaataatgggtccaccagattaaataaaaaccgatggttggatgttaaagctccacgtgccgatctaggagcgtttgtaggagcgccacgtggcggctcgagagcgtttgtagaaagtttaatggacttttagtatataatagatagatagatagatacttctgttagcgtattggtggcgtagtgatggtctgactgcaccaggaaggtggacgttgtttctagtagcgtccatgtctggacgctgtttgaatgagcgtccaagtctggacgctgtttctacccccgtccatcctattttggttaatcctcctagagaattactaattatttaatttaaatattacttattattataaataaaaaaattcggagccattgatctatacttaagtattggaagctatatgtgtttgtctcacattgagaattgcaattttaagcatgacatttttcattttacttttgaaggcaaacgacatccccccaaaaaaaaaactcaatttttggttttctcaataatccgttgtaattatagtatgtaaaaaggtaagacgcatcacgttggaccactcctgtaggtagatcgagccgtattgtcattccttttgccttagctcgtcttgattcaaacatccagggcaccggcttgcacggcctcgcccagcccttgtcattgccacatcaccacgctcagcgcgcaaatgacacggataaggtgggtctctcctccaccggatcgatcgtccttgcatgtccacgctgcttgtcggtccacatggcgacacaccgacggcgcggtagcctctcgaccccggtgacctggacggccaagcggcacacgtgcaaaggcgcgaccgagtcgaattgatttcgcgccggttcgacggagatcatccggggacccgatcacccaaaggtggccgtgctcgtgatcggagcgtggattttagccgggcgcttagccgggcggg

SEQ ID NO: 41557 - DNA, 2350 bp, Oryza sativa
attagtagaacctattagtatatcatttttttaaaataaatattgaattccgcatatgtgatccttgttcaaaaaatgtttcaagaaaaaccatggaggtgttagcatgctgggggcaagaataacctagtgttaacctttatatcttatgtcccatattctaatcttgtacggagtactaatggacttcaatttaggtggtgggcattttattttgccaatgttcggtgagtgatgccgagatgcatattgaattgtgcgtgatatgtcatatgtgttctaaattattgccttttatgaataatattgcatatcgtgtgtatctcaatgtgaagttatcaaatttataggaaaagggattatccaatttttttagcattttttgactactttctacatttttaggaaacaaaaataaattggaaatttctcatcggtttctcgacataatcgattggttttcgatacgaaccaattgatattttcactttgcttgcactttcaattgccgatcggaattttaatgtttatgtttgacatttggatagagtcgataggatttcgacacatgaccgatccactttgcttgcactttcaattgctgatccgaattttaatgtttatgttcgatatctcggtagagtcgacaggatttcgacacatgaccgaacaaaaccgataatttgaatttaaatttttggctacaaaatttgttcggaatctgtctcgatcggatctggcagcatactgccagcgtccggcatggaaggtgtttctgaattgtgaaccctggtggcggtggccccgcgaggcgagaaaggccgggtctcagtctctacgagcttgtgttttgggtggatccacacaggagtagataggttcttccggcccgagttcgcagcgggcgcgggggcgcaccgcatgccccgcgggaaaactaattactgtctgacgtccgatacaatcacaaatatcgaacgcctccactcaatgttagtagtacatgtgttatactgtgatttttttttcttgtgctcaggtgcacctacgggtgatgtatacgcttataacaactttattttaaaactttaaacaactttttttttctgttttacttatctggtcaataatttgatcgtactatttgattcgttacaattaaatctttacaacaagacctcactcgattatattctgattattttttaaaacttattttttaatgttgcgcatagttttactcagttgtttcaataagtatttcttagtgtttcactattccatttataaatgttacacatatttttcccacagtctaaaaaatgttttagcaaattaattattcttgtgaatatattatgtttcacatgacttttttaatgtttcattagttaggactaaatgtttcatgcagtaattgtcgatgttgcagtcagtattatcgaaatgttgcatctctttgaaacacatttaattacatgatgaaacaatttttctataaggggtgaaacaacgctcgattttttatcaaaatataaccatatgagatcttgttgctaagatttaatctattatattattaaaacagctttgaaaggaggcaccacgttcgttgtgagagctagaaattcccacattaataggataaaaagaaaaaaaaagaaaagaagagtccaagtagaagtacaatttaaaaatagttcaaattcggaattaaaactaagcaatattgaaagaagtttctatataagaacccaatacgagatcaatcaaaattcgaaataaaactaaaataaaatccaaaattataaaaggaaagaagagtccaagtagaaatacaatttaaaaatagctgaaattcgaaattaaaaataagcaatattgaaagaagtttccatataagaacctaatacgagattaatcaaaattcaaaaaataaaataaaatccaaaattagaaaaggaaatgggagtccaagtagaaatacaatttaaaatagctgaaattcggaattaaaaataaagaatattaaaagaagagtccatataataacccaatacgagattaattaaaattcgaaataaaaataaataaatccgaaattagcaaaagaaaataaaagaagagttcaagtaggaattcaatttaaaattagctgaaattcggaattaaaaataagcaatagtgaaagaaaaatccatataaaaacccaatacgagattaattaaaatttagaataaaaaataaaataatatctaaaattagaaaaattaaaagagagttcaagtaggaatacaattttgaaacaactaaaattgaaaataaaaaataaaaacattaaaagaacaca

SEQ ID NO: 41558 - DNA, 16819 bp, Oryza sativa
caaaattagaaaaggaaatgggagtccaagtagaaatacaatttaaaatagctgaaattcggaattaaaaataaagaatattaaaagaagagtccatataataacccaatacgagattaattaaaattcgaaataaaaataaataaatccgaaattagcaaaagaaaataaaagaagagttcaagtaggaattcaatttaaaattagctgaaattcggaattaaaaataagcaatagtgaaagaaaaatccatataaaaacccaatacgagattaattaaaatttagaataaaaaataaaataatatctaaaattagaaaaattaaaagagagttcaagtaggaatacaattttgaaacaactaaaattgaaaataaaaaataaaaacattaaaagaacacaatacaatattaactaattttttttaaaaaaaatctgagattagaaaaagaaaaataagatttcaattaggaatacaatttattaataactaaaatttttgataaaaataaagattattgaaagaaaaaaccatctaaagcacatgacgagataaattaagtaacaggcctataaaaagtagagtggtgcaggcggttgatacaatatataaaaattattaataaaacaccaaataaaatcctaatgacgattaaaaggagggacattagacaggccgtgaagcaaacgagtaaggcagttgccgggacttctaaaaagtaaaaaaaacaaaccccattgataatcatatttgatttttaaaatcctaatgacaataaaaaggataagcagcggacggggtgtataagggtatagttgcggagccgccgacggttgaggggacttctagaaaataaaaaatgaattccaacgatagttatgttcgatttttagaatcacaatgataataaagagtaggcggcggacggactatacaggggtatagtggcatcatttgatggggcttttaaaaattataaaaaatgaaagtacaagtccaattttaaaggttcagaacttctaaaaagtaaaaaaaacaatgataatcatgttcaattgtaaaatctcaatgacaataaagaagggaggcagcgggcgagccgtagaggagtacattggcaaagccgtgttaacgaccaaatttggtaatctaaggatcggagatggagaagaaatcgagaagaagtcgagatggaaatcgtcccggaaacagagtgaagatcggctggagtccgaatcggctacggctaagatcggcagagttcgagtcagacggggttagccgattaagccgaatccgacagtatgacacagcatacgttgtcggtttaggttgatgtgcttcataatgattgccacgcatggatagagtcctcagaaggcaattgtatctattaattaggatattttatgtaatttccttagagatatgtttgggcaaaagtctgccgcaaagacttatggtatcttagagtttgttagagataagagtcgtgtccgatgtggacatatcttgttataatgattacaatgatataattataccgtagattggattgataaattattagataaaactatttatactgggtaaataagtatgtatacatgcatgcaagaggtagtgagagagagctgttagagagacgtccgattttagtgcatctatcggacgtccgatgcgtaggcgtccccggaaaaaaggctagggaaaatggtagtatgatcaagtatataggaactacgtagaaccttctgaatggaatgaagtactagtactagattctaagcacaattgtgcaaaggctaaatggctaatgcacgactgttacaaaatgtttatgtgtgcccagttgccagcctggcgacatgcttgagaacccaccttttagttagactaaccgaacgtcaatttaagtatatagtcatctcttgccttctaaggtttaggcaccattattgtgtctcccttaagccctcgcttgttcggctcatgatggaaatggaattgaaattgacgctcctaatttcctatatgaggtttctgattaattaagttcagacatcatgcaaccagacagccgtgcaaacttaattagcaccacggctatcgtcccaatccatccgattaataattaattaattaattaatgaacgtaacgagcagctacattttcttattattctcgctgggcctaatcactctctgtagtactccctccactccagtttcattttaattgacgttttggacaatgacatggtatacaaaatatatctttgactttatttttctattataagatatacaataaataaatacatgctcacttttattatagtgatttgaatgataaatctatatatgttgttctagtatctttaaactaaatattttaaaagttattgatggtcaaagttataaagtttgacttcaaccttatccaaaacgtcaattattactacctccgttttttaatagatgacgccgttgactttttctcgcatgtttgaccattcgtcttattcaaaaattttatgcaaatgtataagatataaatcacacttaaaatattatgagtgataaaacaactcataacaaaataaattataattacataaattttttgaataaggcgaatggtcaaacatgtgagaaaaaatcaacggcgtcatctattaaaaaacggagggggtatataacaggagggagtatacttacttcaaagtcaaaccgcgggtattattacatttatgtccacctctacgcatttcaagaaatgtaattacagtgattctctgcgagcgtttggtacttaagctaagctgaccgagttcgtgctagcgtgtgcgcggcgagcggcctcatcgtggccggaaaaacaactcgtcgcacgaagcagcgaccggacaccgtgctgctcacaagccggcaatgccccaacacgcccacttgtttcttaccgttggcttcgaggccccacggtctgacaagtcctccacattctgtccaggtcaatcagtccaactgtttatccaacaagacaataataatggaactatggaagatgaaattttgatcttttttagatgggtgaaaaatgatccagaccaccaaccaaagtccaaactacttcaggctctagaaaaaagagaaccactgtaacaccaaaagccactttcctttttgcttgctcggcgactcaccgccgctgacaggtgggcctggtgattcggtgccagtctcctcgtccatgtttgccactttcgccgacgtgggtgggtgggccttcgggtgaagctgaaggaagcacaaacagagccgacgatacggactgtaactttttcgcatgtgcttcgcgcgaattattcaggatctctctctgtcatccggtcgaaagcgacctcccatgtcatactgtctccggataaactgcccatgtttatcacagagaataccgaacggattgcgtagttttctcgccatgaacccgtgcaggtagattcagttgctcgcgcccgatggtttgtacgagccaatactcgtcccctatccgttgtactgccaccgttgcatacgctacaaaacgccgtgcgtcccatcagctgctgttgcgtatcctactctcgtttcgtcacggagtgggtaaaaggactaaattaacagcaaggtaatccaggattacgcgagttccataccgcatcagtgcccttttttacctagtaggcgccaactaggcgaaccggacaggacaaagccacgaaacggagcaccgaccacgctggccgatgtgggctgtgcagctaaccatgtcaccaggtcactagcccgttacgcccgcgtcgtgttccggcccaccttacgcctcccggtagatccacgagccccacacgggcggatccactgtcacacgggcccaacggttcgctggccccactggcagcctaacgatggtttctcggttttacatggggggaaagccggtggctcggcacccgaggtcagtggaattgatggcgcccaactgccacgtgagaccgtgaccccacatgtcatcctcccgtaggacggcctcggacccacaccgagcctcagggacgaactagccgtttgcgggtcggcactaaaaaaatcggagacccatcggttcaacgggagggacgcgcgagcgccgccaatgaggcgaggggagggtggccgcgtcgtgcttcagtagtagtgggggcagtgggcgagttcttgctgcgagttcgtcgcgagagaggaagcagcagagagaaagagagcaaaagcagcgagaggttgtggggagagagaggagcgaattgattagtgtcgccacatcgtctccaccaccaccacctccgtccttcctcgccaagccaccatcattgcgccaccgccgcaagatctgagctcgactcctcctctcctcgcccccgcacgggcgcacgacgctagcttcttaagtatttttcttcttaccgcgcagcgcgcggcggctggctggctagctagcttctcggcaaaggcttgttgcggttgcggttgcagtacaggggcgtgtgtgcgcgcgagcggcggtggtacggtgcccgcacccacccaccaccacccccgccattaaaggcgctcacgcaccgcctccagcttcttcgtccacgagaaagcgaggtgatcagagagagagagagagagagagtgagtgaagcggagctcacttcctcccctcacgggagcagccaacgcccagcgccgccaccacccacgccgttcgcgcgctttaaagaaggcgcgccaccttcgcataagcttaaaagattccccacaccacctcctctcacctcgcgccacgagcgttgatcggtgcttttcattgttcttccttgctgcagaagagacagagagagggagaggcagaggacgaggatgatggcggtgctcgcgcggctgggcgtcattgtggtgttgtgggcggtggtggcggaggggattcttgaccccgtcgacttcctggcgctgcaggcggtgcggcggtcgctcgacgatatgcctggctcgtcgttcttcgaagcgtgggacttcacggccgacccgtgcgggttccccggggtgttctgcgacggcaacaaggtgtcggcgctggcgctcggcgacccgagggcggggtcgccggggctgtccgggcggctcgaccaggcgctggggcggctgtccgcgctcaccgagctgtcgctcgtgcccgggcgcgtcgaaggcgagctcccggagtcgctcagctcgtgccggaacctccgattcttggccgtcagcaagaacctcatctccggccagataccggacggcctcggcgggctgtccaacctccggacgctcgacgtcagcttcaaccagatctccggcaccatcccggcgtcgatcgccacgctgccgtcgatcaccaacctcatcctctgccacaaccatctcaccggcggcatcccgtcgttcccggactcgtcgccgctcatccggctcgacctcaagcacaacgacctctccggcggcgtgccgaacctgccgagcacgctccagtacctctcgctctcggcgaaccggctcaccggcaccgtcgactccgtgctcccccggctcactcggctcaactacctcgacctcagcatgaaccagctcgacggcccaatcccggcgtccgtcttcacattgccgctgtccgtgctccagctgcagcgcaacttcttctccggcctcctccagccggcgaacgacgtgacgatccaggtggtggacctgagctacaaccgcttctggggccccgtgtcgccgctcctcgccggcgtggggcagctgtacctgaataacaaccggttcaccggcgaggtgccggcgcggctggtgcaggagctggtcggctccggcgggctccaggtgctgtacctgcagcacaacttcctcaccggcatcgagatttcgccggcgtcgtcgctcccctccagcgtctcgctctgcctcatgtacaactgcatggtgccgccggtgtacgcgccgtgcccgctcaaggccggctcgacgaacacccggccggccgaccagtgcccggagtggaggggctaatcaaagctggcaacacaacgccgacgccattgccggatcgcctcggatcgtccaagctcaagaaaaccggaaaagaatggaggagattgcaaatggcggtctccgattctttgattaatttgtccagttactagcgttccaatgtggattactattctttttggttggggggagatggatggagatagtcacagacaagaagtaagttccttaataatcttgggtttataggcgtaatttctttctcctttttttgtgtttaggtggtgtatgttcttttgtgtcccctgctgtatagttgcgtgagtagtaaaacattggctcttgatgttatgtgaggtggcgacgatcgattgatgtatctgatgatgatcatgatgatggtggtgttagaaatctgtgatgttatttatatatcgcattgccattgggcaagcatagtatcacaagcattcgctgtgcttcattttagttacagttactcgtcacagttcattcttgtcagagaaacaatggctatattatggatgagcatatttttatgattatttcaggggaaaaaaaagcataacggtagatgatgaataacacgcttgtagaatgattgctcagggcgcaatcacaaaaacagaagcaaagccaagaattagcaatgcagctccccacactgaacaatcattacgtaaagcagagaactaactaatcaatctatctgctggccttctgaagtctgaacaatcatcctatctgcatttgcaagactggcaggaccagagtacttgcatacaaccgatcattaggccatgttgttccttcttgattggagttcttttttttttaacaactactctacgtgatatgatttccatgcagctgatccttcgtatgtccttcacattctctcattcgtcctcctcctcccctgttcatctccctgtcctaaccctggcttaaaaccctctcgcgtgtacagtactcgtcttgcacagtgaaacataactctcgtctcgccttaatttcgctgtcagtacgcgatacgagcgatccttgtgcgtgcgtccttgcgtactcggtttgtggcgagttggtagctctggtttttaatggagctgcaactgcacgcaacagttggaaaaatcgcgcgagatcagcaaattcgcgacgcagagggggaggacgtcgcacggcgaggcggaagccgtcctctgctcggcttccggtggtttcgagttggagacaagcgggttgttcactttgttgcaaaaatcatattttgatgttatcgaatttcgataacgttgaatgtatctagtttacgattttatcaaagtttgatagtgttttcgtgagtttttttttgtcggaattgtaagatcatgttttgccacgtataccggccgggctgtcggtgtaactcgtacgcgatacgtatcccctcgaggccttgaaggcttggatggtacacgtactggtacgtacgagaaataaaagggctcatcgtgacacgggcgcgatggtaaagtctctctctcttcattagccgtggtgcggcgagcgtgactgcgcgatggccatttaattctctgtttcactttctttttttcctctcttcttttcacatcgtcatgtttcatgttagtgatgctttctttaccttgccacccccacacgcatgtaacgaatgactactcggccggagtactcgctatagactgtaaagaggtgataacaactcaacatgatccaaagcactccttcttcccctacatcctgtgggggccccgtttcaccgccatgtgggccatggcacatgcaaagcggataattgtacatgtttggcagcggcatgtcagtttgtccccacatgacagtgacgcagcacggcgaaaggcggtgagtgtcgctgcaattagcttgggcaaaaatgtggtactactactacaaactgccatcgagatcattcatcacgccgccccgacgagcgagcgagcgaccttacctcggctttcctcttttctgcctgtgaagtgcgtggttgttccgaaagcgtgatgcccactggtctttccattcctggctcttttgagttttgactgtttgttcggtttctagctttgcaaattgcaatcccttctttcgcgccagtgactgagagacagaataataatacagacagctgcttactatatagatttttatagcctatctctcagctcacttatatagttgttaatttttcactataaatatatggtccacatgtctgtctcatagattttcttggttacagtgtctaaaccggctgtaaacttacagccggcttctcatctatctcctctcctttctcatccacctcagcattcagaccctgtttagatgggactaaaactttttagtccctatcatatcagatgtttggacactaattataaatattaagcgtagactattaataaaaaccattctataaccctgtactaattcgcgagacgaatctattgagcctaattaatccatgattagcctatgtgatgctatagtaaacatgcgctaattatgaattaattaggcttaaaaaatttatcacgcgaattagctctcatttatgtaattagttttataagtagcctatgtttaatgctctaaattcacccgatatgatagggactaaagtttagtcctgtatccaaacaccacgtcagtcttcttggagccctctattatactcgctgacggatgatagaattttagaattgagcggtatgtgcaaaagcaggttttgtcgtcggagaagaggacgtggctgtggctcatgtgaaaagaaaggcaatttggctggtagcttttgctttgtacggagtagtactactagacttctagagctgaactagcagtaatagtttctaaacctcagtagtctgttgatccgtcggccatggcctaccgatcgcatgggcaaggcccaagcccagcacccgctatccaggttctttctggcgcacccaccgatccaatcgagaggcctccgtataggaataagttcactttgggtccctctatttgtcgctcagtctgattttcgtcacttgatcgcaaaaccggatacgataggtccctcaacttacgaaaccgtttaaatagaatccatcagcagtatttaacctggttttggctgaggtggcccctacgtggctaatttgacttggccttcatctcacgtggcattgatgtggcgcttacatggcaaattgaacccaaaaataataaaacctatgggacccacatgtcaatttcacacacacaataataaaaaaatggtggggcccacatggaccccacatgtcatcatcactaccatctctctatcccctctctctccatcatctctccttcctcttatctctatccccctctctctcccctgacaatggtgagcggcggcgggcggcgcagaggggcggcaagcggcaggtggagcggaggggcggcgggtggagcacgacgacgaccactgcggcgtctccgaagataacgacaacgacaacgacgctctgcccagaactcgcgtccgtcctgtcctcgcccgtccgcgctgctcgtcatgagcttgcaggcaggggtgtccatggccgcatggagggtgcccgcgctgctgaagagccacgtcggcgacgagatctcctaccacggtggtgccgtgctccggggcgacattctcgtcaccgttgtgtggtacgggaagttcaagctggcgcagaaggccatcgtcgttaacttcctcctctccctcacggccacgccgccgcctccgaacgcgacgacgccctccgccgagaagtggtggagcaccatcgctgccgtggttcttgcgagtggttctcgcgcgcgccgaccaatgggagggagggagaggagtgggggtcggcagtcggcgggagttggcggtgcgcgtgaggaggtcactggcgagcacgggctccacgccgtcggccgcttcgcctgcgatgcccagcagaatagcgccgcccctcctcgcccggttgccgagcgccgcctccctcctcgcccaccgttgggcaccgcctccctcctcgtccggccgccgcgtgccgctccgcccaccgcctccctcctcgcctggctgccgcgagcggcccctcctctcgcccggccgccgccgccgcctccctcctcgccggccgccgcgtgccgctccgcccaccgcccccctctgcgttgccgctcgccgttctgtaagggagagatagggggatagagataagagggggctgacatgtgggaccacatgggccccaccttttcttattatttttgtgtagctgacatgtgggtcccacgttttattattattttcccgggatccaattgccacgtaagcaccacatcaataccatgtgggataaggacctagtcaaagggagccatgtcatccaaaaccgggcataatactgccgagggatatcttttgcacggttttgtaagttggggaacccgtcatacccggttttgcgaccgagggacgaaaatcggactgggcgacaaatagagggacccaatgtgaacttattccctccgtataaggcctcggagctgacaggccgaacagcccaacccaccattcttcgcgcgacctgtgagggaataagtccactttgactcccttaaaagtgactcgaatctaatccgtaaccctcaaccgcaaaaccggataagatgactccctgaattattgaaaccagcacaatttgactccctcagcggttttggagggcggttttgctgatgtggtaatgttgacctagtcttcgtcccacatggcgcttacgtggcattagacttaaaaaaatatatctatgggacccgcatgtcatcccctctctctcttcttctttctcctttctctctctttctctccccttttctcttcaccttctctctcgtgtagcaatcggcgggcaggggcggcgacagcggcaacggcggcggcggcaggcgggcgagcgctggagtgtgcggcatggaagctgccccctgtgacggtggggtgcgcggggaggcgtgtgacgaaggggaggaggccatggcggcgggctcgacgaagtgggacttgaggaggcgcgagcacccggtcacgcacaaagacgagcaccctgatggcggcgacaatgtagccgacatatatatggcaaaagtatttgcggttagttttggttctcatcggcgagcgtggttgccatcgttgggtgtcatgaacaacatgtcaccatcgatgatggctggacctagtgtttgctctgttgtgtcgtacgtctcaagtgaataatttctaggtttttgtccctcgccttcctctctatggcactgagtttgttgagctcccatgtgagcgagtgtctgagcgagcatcggtggcaggctggcagcagccacagccagcaggcgcacaacttgaggtcgacctcgccgtcgggggtcatgctgctcgacgccatcactgttagagtacgcagctcggcccatcaaccatgggctacccaggtcatattgggtctgctccaccacaggttcaactggagccacaactttaggtcctgggcctacacccaaaagactagtctgatgggtaaggaccgccctcaccttttaagtcgtgttcccccaccctcaattaccgatgtggggctaaacccaacaatctcccccgtcacatcaacccatgtgaccccgaagacttgtcctgggcctacacaacccaaaaggaccgccctcaccttttaagtcgtgttcccccaccctcaattaccgatgtggggctaaacccaacaatctcccccgtcacatcaacccatgtgaccccgaagacttgtccggggcctacacaacccaaaagactagtctgatgggtgaggaccgcccccaccttttaagtcgtgttcccccaccatcaattaccgatgtggagctaaacccaacaatctcccccgtcacatcaacccatgtgaccccgaagacttgttacctggcctcaggcccaacaatctcccccgtcacatcaacccatgtgaccccgaagacttgttacctggcctctccaccatatgacccatggaaattgttccaggtttcaaaccttgggctctgataccacttgttagagtacgcagcccggcccatcaactatgggccacccaggtcacattgggcctgctccaccacaggcccaaccggagccacaactttaggtcctgcgcctacacaacccaaaagactagtctgatgggtgaggaccgcccccaccttttaagtcgtgctcccccaccatcaattaccgatgtgggactaaacccaacaatcaccacccgactcgaccaactccatcgccgttgactcgtcttctggttcgccctccaccacctctccttgtcttccccgacgccttcctcggtccgttactctgtcatgtgcacgtcgggctcgtagctcgagctcgagtagttttgtcggtccccaactcaccgccgccttcctcccttcccacggacgggcagctgacatcgagctcgatggggttcaccggccgcgccgctgccgtcgggagctcaagtttgactcgtgagctggttgttgttgaggtggagcaagctgagcttccgcattgcgccgatctgggaaggtatctcgccagagagctgcacgtagccgccgccgcttcagctcccgccggccgccaccactctggcccccacccgccgccgctccagcccgtgctccccgcggccggccgaaggggagagaagagaaagagaaagaaagagagaagggacgaagagaggaggaagaagaaagagagagaggtcagtggggcccacattttttttatgtgtgtgaataacaaacgggtcccacgtatactttttaattcaaatgccacataagcgccacgtcaatcacacagattaggtcaacaccgccacgtcaacaccatgtcagtgaaaccaccctccaaaaccacccagagagtcaaattgcaccggttttaatagttcgggggtcgagatatccgattttacggtttagggtcatggattagattcgggtcacttttaagggagtcaaagtggacttattccacccgtgaggccgtgacgctactgcgcggcccgacagcggcgccgccccggattcttccatgcttccggcgggaccgcgtcgcgcgcacgctggaacggacggtgccagccggtcccgtttccgttttttcctttttttttctttttctcttttacggtgttgggaaggttccagaacgggtggacgcttctggaaacagactcggccgcggatctctcccctgcataaatcccgggcacccgagcgctccgcccgtctcggcctcacgacacaaaagtttgtcaacagcagccgcccgctgcttctagatacttcttcctccatttctttcctccttgccaccgtctcgtcccccacgctcttgcgacctcttataatttcaccgctatgactcatatccttcgccacaacaaaatgtttttttttctcactatttttctattttaaggagttattatgttccttctttggtctgtagtagagtttaaggaatttatttttcaattgttttctgtttttttaccgcgcgtgttcgtgtgatgtttttttggatctgtggattgcgctgctcgtactgtgttgtccttgacctgaggagggtgcgcacgcggcgaccagagggagcgggacaggcagagggcgcaggcgcggaagccggttgtgaaggggcgcgacgacgggctcacgccggagcagcgccgcgagagggacgccaaggcgctgcaggagaaggcggccaggaaggcggcgcaggccaccgggcagggcggcaacggcggcgccggcgccaagggaaagagcggcgggaagaagtaggcatcggcatatgccggcatttgatctgttctcacctcacgtctggttgcgtgtgacaacaccgttctttcgatcgtcatctgctcctgatcctgcccatgttggcagatctgtactgctatttcttggatctttggaaattgcattacaaatttatgtagattgtgaaagcaaatttactccgctcctgcacggatcaaattaactcccagctcatgctccataaatcagtgacatatacagattgacatgtatacggaccacatgtaaagctccaccaagggaaacgctgtacagacaaccaaagaaaactctgtgtattcccggacgagcgcatgactctgactacgagtatccattttttacgacgcgccatcttcttcacaatatatctaatatctagccaaactgtgtaatctgtttaaacccatttgtttcgtgccattatctgcatatatgctaatggaagatcgcaagcaccgaatcaatcgagatcagtagtctcttcttgctgacaggaagacctggaccacttggcaacccggccgtcccaggatgagctgacaagcatagggtcgaagggatgccaactgcagtctcgaattgccagctgatgatatcctttgagttttgcaacttgtgatccgctcacctgaacatggaacaagatagtgcaatatgagcctttcgaaatactaattgaagtaacaagatgaaagaaattgtctgaagaatccttatgttactgaagtaacaatatggacaaagaaattgtcaaaagaatacttatggtgaagggaggacaacggtacactttttgtcgcctattctgtggtagaataggttttcagtgtacggaatgaatttaatttttttgcactgtcacagatccaactactctttaaaagatggcatgtaatttggagcatcatcagttgtccatattctctaataaatcaaaacagtttatttgcgaataaatattaatttatcgataaaaattttatatatttgttcgtagcgacttaaaagttagtgtaaaaaattacgttgaaaatatcttaaaatcaatttcaaattcaagttagaaaatttaaattttggcttttgttttgacttatgaggccaaccaatgaggctcccaatatctttcccatcttcccctactctaacgctgctgcatgccagccatcagggactttgcctaccaaaggctgttgtaacagctgtttaaaaacccttcttttcccttaataaacttcggccggtttcaaccggcctggcgaaaaaacctaggctgtttgagcaaaacgcattgcaaagcaaaacaattgggctggcattttgtaacatcatggatttgtaacccataccatttcctttttgcataacatgattaatctaattacatgcaattctcttgcgtgtttgagaaaaaaaggaataatctaattcggtattggaggttatccaaagatcatatacaactctcaagctagcataagtgcacaacaactgcctgctggtactagactaattacattgctaaaagaacgaataggccaattggtcatggtattacatttgtccactagaggaacgagtcagcgtataggtggtcagtcatatgaaccgatgctgtatacaatctatgacataaatacaaggtttgtttcctatagcccgaacacccaaaatagttatattatttttcgctttgattgaaggcactagccagaacagatatcatgcagtgagatatgcaagtcaaggataccagtaccaccatgtgaactattacaagcctggaattggccaaactggctgagatcttacatatttggatgcagtcttcaggttctgggaaaggcaagagtcattttggctttggcgaaaaaaaaaacaccttgttggagtgatgtttttagggggagaaatatatgtggcacaaatgcacaatgcagaatctggttgatagttttatttacatattcagacaatggtgtttgcctattgccatttcagatttccccaatttgcatgtagaaaaaatcacacacatatacaagtacgcaactacacaagcattaaaaaaatagaatcagacttccttgaagaagatcgaaaaaaaatcaacaggaaaattcatccaagaaaggtgcttgagtatagcaagcgcagtgcaatctgtagattgctgtcatgaaagttgaaaagagacataccacatcgtagatacaaacactagaatcataggatcctgtatatatgtacttctgtcctgtgctgtagaaacaaaaaaaaacataaagggacattagcacttactactttacatagtttgactaatacaaaatccttcatatgacatatcagaaccgagaatcatgaagttacctatatgcaggagaaaaatagcaacggatcaatgtacgaagaactgaatggccccagtatgtagctattgactgatcatggggatgctttagttgcttatactgttgtggatatcttgaatatctatagtcccaatttgaggttctgtcttcataactgcatgaaacaataagattggtaaaattcctgtcttcataactaaaattttacgttttatgttgatagctcaacacctacctatcagcattggatgtcattttcctgatgtcccacattttgatagcttggtcttttccatttgatatgaaacaccgaccatctccacggctatcaatatga

SEQ ID NO: 41559 - DNA, 710 bp, Oryza sativa
cgcatcaagaggaatcatcgtgattggaatcccggaatgtatgacctgaagatatagaaacgtagagtcggcactattactcaatataatcagttaagtcttttttttttcgattgatataatcagtgaagtcaagacatgcactgaagtagctaaagttcatgcatttcatcgtctgcttgttgacttatcatctacagcctacaactaaaatttgaatttcagagttgattttatggtttttcatcgtgatctattttccagccttacttttaaactgtaataatactaatacaaaagtttactcataaattatctttggttgcctctacctgtcgtagcttattaaccacattgttgaatgcaataaatcacgagataattgctggatcatatgcagcaaaattaaaattaaccatgggaaagaaacagtttacacctatattattgctgctagaggcagcgaacagttgatactacattattattgcaaatacaattaaggtgacctgaatacctgataagcagcgaaggggtctccaaagatgttgaactcggcgaacgggttggtggcgaaggcggtgaacaggttgccggcggggtccgccgccctgacggcgccgccggagacgtagacgcggtcgatgttccgagccaggcgcgggtgcgccatgagcaggagcgccaggttggtgtgcgccccgaagagg

SEQ ID NO: 41560 - DNA, 9005 bp, Oryza sativa
  unsure (1)..(9005): unsure at all n locations
gcagcctttcgttgcgccgtaagaggaatgagtgcgattttcagatcagattccaggactgtttttgcagctagtggatcaagaaatatgttaaactctgcatgtttgtttgatggaaccgtgaacaaatttccattctcatcgcctccatctttgatgagtccaccaacaacatagactctctgcattggaaaaggttgtttattgagattgacgaccactgatgaactcatcacaaactaaaacttattttggaagatcgagaactaattgacctctattacagaacttgcatccctgtcagagagtgaaatgttggccatattggtgagaggtccattagtaagaacagtgatcttttcgcctggatcaagctgcttcctgacagattgccaaacttcaagagccaaaggctgccgatcttctgggtgatctaaactttcaggagcatatctgatcgtgtaattaacaatgtaaaaaaaatttaggacaatcttcaattaattattcctatgagagagttcctttactgtacccacagattagtgtggactatatattcagagcatgctgcagaagcagaaggttaccttctaggacttcttggcagtgacctggctagtccatacagtgtatctgaatcaataaaaccaccacttccatgggggatagcataagaattgttgcagccaagggttggaattcccaatgcagtggtattgcctaggcctactggaatgtcgtcgcggcccatcatatgtagaatgtcgtaaacgatatcgatgctcgcaatatttgcccagccattgccattgaccaaaacagcctaaaacaatttttaagacagtgagttttgcttgatgttgtcaacaatgattcaaaacaaatgctaatccattgttgtacatatgagaaatgacaacatgattttgttcacttaatgcatttgccatacatttttttgtttccttacctttagatctattacttctattggtgtcttcaagaggtatattagggaaacaaaatctccagggctcatgtccatgtcaaaaatgactggcttccccctgctcacatttctgaaaaccggcttgtaaagaacttctctataatatgggaactgcgtattgatgttgaaaagcccagtttgttcgggacgatttaagacctgcaggaagcaatttcgtcaataacagtaactttattagacaaaacaatgaaaatattcatgtcataaccttgtcattccctaaaaataagaattcaaccttctcaaagatgagcaaggaatgacatgcatgcttacctctaagaagctcttggaaaattccttttctagtgaactatttttatccgtgttaggctttgctcttgttgcaacacgaacccgaactccttctggaccagacacttctctagtgtatccatcctaagaggatttcagaaaaatatcaaaatgtatcttgtctcatgcatagacagaattttgcatgttgagtattaaaaatgtgagatcatatcatagcaactgggagatcagcgatggagatgttcagaacaggaaattttaacttgctcactttctaattatcagtgaactaaatggatataagaacaatatccataaatacttttttttttctaataagcatatctatattgttaaagaacattccaaaagtataacaacatttttcaatcaacaacatagcgatggagatgttcgcaacaggaaattttaacttcctcactttcaaattctcagtgaactaaatggatataagatcaatatcaatatatacattgttacaacaactcgaaaagtacgatttttttttttcattcaataacacatgcacattacctcgcatctccctctgttgcttcccggtaccaggcagaagctatctcttattccagtctgaacatggccactgtgaactccaccctcttcaggccaagtttaggagtagcacggccatcgaaaaaggggttcgagccgtcacgtttaccatacggtttgtttgaagttatcactgtaatgttcatatattcaagctcagaaaattcattttcaccatcaacctcgccattgcgcatgctagagagagccacaccagcagcaaaggaatcccacatgtagtagctctgagtaatgaaagaacaccatgagaaattgggactttttttaggcgaaatttcggtaccaaataaaagttgtgttgtttttttttacaattgtgaaagaaaagggagatttgagctttggacttgccgtgttgccatggccgttggatcgtcccctcagcctcatcaagaccttatcaagtgactggaaacagtactgtgcctcgtaagtttgctgatgctgttggaattcagaaacgaattcctcggtgaccgaaattgtgttggtcgcatcaagaggaatcatcgtgattggaatcccggaatgtatgacctgaagatatagaaacgtagagtcggcactattactcaatataatcagttaagtcttttttttttcgattgatataatcagtgaagtcaagacatgcactgaagtagctaaagttcatgcatttcatcgtctgcttgttgacttatcatctacagcctacaactaaaatttgaatttcagagttgattttatggtttttcatcgtgatctattttccagccttacttttaaactgtaataatactaatacaaaagtttactcataaattatctttggttgcctctacctgtcgtagcttattaaccacattgttgaatgcaataaatcacgagataattgctggatcatatgcagcaaaattaaaattaaccatgggaaagaaacagtttacacctatattattgctgctagaggcagcgaacagttgatactacattattattgcaaatacaattaaggtgacctgaatacctgataagcagcgaagnnnnnnnnnnnnnnnnnnnnnnnnnngaacgggttggtggcgaaggcggtgaacaggttgccggcggggtccgccgccctgacggcgccgccggagacgtagacgcggtcgatgttccgagccaggcgcgggtgcgccatgagcaggagcgccaggttggtgtgcgccccgaagaggagcacggtggtgggcccccccgacaccgtgtcggccatcacccgctgcgccgtcggctgcgtcaccggcctgtaccgccgccgcccctgcggcaggaaccccctcctcacgccggagttcgtgtcgacgtccagccgcccgccgcgccccgccgggaccgcctgcctgtacctgcagccgccggccgtcgacgtgccctgcagtacacacatcgctggcatcgatctgcagctttcttggacacactacaccggactaggtcacctgttccaaacccttatctttaacgggtttaagcttggttacaaactaatgatcactggtgaggatcagtcacatttaacgggtggagaaccgtcacaatgactccacccgacacaatgatagtcaactctgacgagctagaactctacggtccgtcagaggtaagtgacacacagcaacacacagtactactatgagttttgtagtacctggtcgatgagtgggaggtagccgccgacgtcggggccccggagggcgccggagtcggagacgccgccgtcgccgccgacgccgacggggatgtcgtcgcggcccatcatgtggaggaggtcgtagaggtggttgacggcgtgcccggcgtcgctccactcgttggcgttgatggtgatggcctgcgcacgcgcacgcgcagcgcattgtgtacgtgcaaagaagaagcgcccgtgtcacatcacatcgatcgatcgatcactcagcacacaaacgcaacgcagagagcatcgacaagacggcttatcctgtggacaaatggcgttgaaacatgcaggtaggagcagcgctggtcaaaggccggtcgtctctctctgcagggtgtgctgtctacgtcaacgtttaattaattaattatttaccaacttaatgatgaaatgacagtgtaggtgaggaggagagccacacgcgtgcgacgatatcaccaccggagatggaccatttactccgagttggggagataatagatacgatcgaaatgatcgagatcgtcatcgtcttttcaagagattgagccagaggcctttgtaaaaaaggctatgtatggatattttttacggtatactccagaattatctggagcgagagaccgtctgttttgacagtgattaaacgcttcatatgtctattattacctccaataagaagatgattagtggtaaaatgatcgtatctttgggaaaattcatgaaacaaattagctagacgcaggcagtatcgtatggagtatgcaactcgatggccatcagcgttaacgcacgtattaccttgacgtcgaactcggagcggttctgcttgaggaggtagagcagcgcgaagaggtcgtcggtgtccatgtccgtgtccaccaggatcctcctcggcttcgccgccgccgccgccgccgccgccgccgccgtggcgcggcccgcgccgccggccgccacgccggaggcagcgggcgcggcgcccaccgccaccaggagcagcacggcggccgccgtcgccgccgtcctccacatcttggctctcctcttcgccttctccgcgggagacatgcacacagcagcagcaggaggaggaggaagaggaggatgagcttagctagctggccggtgcgcctttttatcgatcgccggccggcctcgctgtgggtcggtagctgcagggcattaatgggcggcggggcgggctggcagtggcagcagccgtcaggcgagcgtggatgatggaggcctccccaatcgggcaagtagtgatgaagccgatcgggctgcccacatccacactgcacctgtatttgatgataaacacgtagtacctccgctaaaatatagtaactcttagctgcatgcattaatttagacacacaattatccatatatatagttaaaaatatttatattttggaacgaaaggacctgttcagattgtaaacaaaataaatcttactaaattttggtaatttggtaaaattttgataggatttcttatgtatttactaaagtttgacaataaactaaaaggatgcacatatttagcaattctgctaaaaaataatatggtttgaaatggtatcaatattaacaagcccgaagtatatattactttccattttacaaatcacatagcctgcctagctaacatattaaagtatggatggattaatattctctaagaataatctacacgtgtgactatttatatatatttaactagttctaaaaatgccttcaaattatgtagtcacacgacatgtaaaactttgctgcaaaatacaataaccgagtagccactaacttgatgtgggtatcggtctaattgaactagtaccaatcaaaaagccactcgatcaacaaactggctaagctagctcaaaagatttatctagagtatattaatattaataaacacttgttatttataaatcatatactttcaacgtagtggcggagctagaacgaaatgaaggacgtacatcttgcttaatttactctactttagatcaagtgtaaattgatgcgtgtgcctaagtttgtattgaggggggtgcacacatgatgaaaatatgtgagttataacttaaaaatttttcttgaccaagttcctgggcacccctcccatactctacctccgcccctgtttctagggttataaatagttaaagcttataacaacatttttaaaatcgttgctagccgtggtaataaatagtgtggtaataggttattgcaatgatttttatttagttgcaaaaaattttgatattgccataaaatggatgtggaaaaaaaaatattacaacacttcacatcgttgcaatagataactattgccaccactccatgtgtggcattagatatttaaacccaatatctctccctcacacgtgctctccacataaaaattatcattgcaatagtacaatgtattgccacgaattatttttcgttgtaataaattgatagcgatagctcaattattttggctagctagctaattattaatatctaaaaatcagccgtggataagctctttgagtcaatcctcggtttcttgtttccatgtgtcacattagaccattagatcttgagtttacgatcagataaattaattttcttgttttccctaaaattaatttcttgtttatatgggatacatcatgagtgatagttacccctactgtacaggtaattaaaccaacgaaataaacgtgaaaccgctggcggttggctcgatcgtgcccatcccggcgtgcccggcccggctggtgggttcgggaccgcgtggtcgttttccaaaaccttccgttgtggtggtggcctcgatcgtctccggccggacggcgagtccactgtccaccagaggccgccacaccctcccgtcgttgaagctacagcaacaggcacgtacgaccgcgcgcgggtgggcgcagcgcggtggaagcgacaccaccgatggttatatcatcgatcgaaattgcttgcttgggcgccggccacgggagggaatcgtgtgtgtgagacttcgtgaaagagagctacgtagctaagggggtgtacgtttagatccacgggtaaattttttttcaccgtcatatcgaacgtttgaacacatgtacggagtattaaatattagaaaaaaaaactaattacacaaacttacaagacgaatcttttaagcataattgcgccatgatctgataatgtggtgctaaagtaaacatttgctaataacggattaattagatttaataaattcatctcgcagtttatacgcggattatgtaattttattttgttattagtctatatttaatactttaaatgtgtgtccgtatattatatgcgacccgacaaatcggtggagataacaaagcctaagctagctagctttcggtgtgcgtccaagccacgtgttgtgcaagttagcgaggaggcatgaagctaggcacagggacgagcacgtagatactgttgtgctgtgtctgtgtcaccattgacttcggttgatccggacggggacttattgtcacgggaaaacggatggaaattcacaggcatgcgcgtgcattatgcacatacggctggccctgttcgtatgggctgtttgcttcagcaagacagcaactccttaattatcttttagcatattttccgaactgataataaataaggagttttgtgcaaaaaaattatataaaagttctttcaataagtaaataaatctattttttgaatttagtatttaatacttgattagtaaggcgctaatgatctatttattttttttagacgtcaatggctattcaaattaatgatataattaagcagggacgacgtttcgtcggcggtggccggtggggagtttgaattttggaagaggggtacagagctaagaaaaaaaatctattgctcaatgaaaaagtaaacattagtacgtgcaggaaaaatatatctaaagcacatagagttcatactgacttgtatatctcacagctgctaatcgatcgtacacaatttaacaagacacagagagtatggccaacaatttattaaccacgagggtggtaagttttaaatacaaaatgagaaggaaaacgtcagaattacctcctaaatgttgtggcagtacaaattacaccccttaatttaaaaaccagacattcttcacccttaacttttcataccgatgaattaccctcctggtcgattccggagtggttttgttcttacgtggcacacacatagtcgacttcggagcggttttcggcctacgtggcgcacacatggtagtccagtcaacatgaaaaaaaataaaaaatggtgggcccaattatcagtttggtatcttctctcgatcaccacatgtgggccctactctttttgtattttttatactgactggactatcacatgtgcgccacgtatgatcaaaaccattttagagtctgttagggaggtaattcgttcgttataaaaaattgagggtaaaaaatatctggtttttgaattgaggaaggtaattcgtactatcgatcaccacaatggtttagggggtaattcgaactttttccaaatgagaatatggcatgtaggacagtatgctaacaaaatgtggtgtatcttaattgtggtatatccaaccaaatgctaacctaaaaaaatatggcaagcctaaagtttggtgtgtgacaaatttcgggcagtaaccaaatagctcttaaatgcctaacttacatatatatgctacacatttaattttaaactagcatggtggcctgcgcaaattaagtggctagcatcattatattttctctcatataatagcatatatattttctcaatgtattattcaaatatattaaaatgataacataattttaaatattgtactaactttacgaaactactaatgtgtaatatacgtattgtattttatatacgtgttagttattaatagtttttaatatcaaattttagttatttgtaaattatatttctatatggactctagactactctttcaatattacttttaattccgaattttcgttatccgtatttctatgtagactctaggctgttcttccaatatttttttatttttaatcctgaatttttattatttctaattgtatttctatgtggactctaaattcatctttcaacattctttaatttttaatttcgaattttagttacttctaaattgtattcctatattgactttagactcttcttcccatgtttttttaattttgaattttagttatttgtaaattgtattattatacggactctaaactctactttttaattttattatgtttatttcgaattttagttaattttaaattccta

SEQ ID NO: 41561 - DNA, 712 bp, Oryza sativa
ggtcggtgaagacgtagatgcccaacaacggcggcataaaggccagccgtgcaggcgaggacatcggtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcgaggacatcggtcggcggcggacgaggcggccggtcggtgaagacgtagacgccaacaacggcggcataaaggccagccgtgcaggcggaaacaccagtcggcagcggcgaaggcaagccggtcggtgaagacatagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcggaggcaagccggtcggtgaagacgtagacgcccaacaacggcggcataataggccagccgtgcaggcggaaacaccagtcggcggcggcgaaggccagccgg

SEQ ID NO: 41562 - DNA, 1115 bp, Oryza sativa
  unsure (1)..(1115): unsure at all n locations
nnnnnnnnnnnnnnnnnnnnnnnnnnnnnnnnnnnnnnnnnnnnnnacattataatgtacttgaagaaccacacaatattgcgctataggaattgtattaaccccggtccctgaagatccttttttcataaattgcaaaaacaaaattatggctgtcttgttgcttaaccaccagaaaagcaaccttttattgcaatagtcatggtgcacagttaacctccacattccttttgacttaaatttttgtgtgcatgcagaaaccgtcatggtgcacagttaacctccacattccttttgacttaaatttttgtgtgcatgcagaaaccgtttgtcttatgagcagttcagtgcatttctagccaatgtaaaggagttgaactcacacaaacagaccagagaggtataaaactatagaaactgcacttactgtatgttctactatatgtgaatctgtatctccctttttgtcctaggtttttcttctcttttggcgcttattgaagcttctgtgatgcttacaggatacactaaggaaggctgacgaaatatttggtccagataacaaggacctatacaccatctttgagggcctaattactcgcaatattcactagaatcctgaaaagtcaaaactggaacatttcttgtaattaaaagcggtccaggtttttttacaggaattatgagaaaaatacgtttggtactttttgtatttcagtggctactaatttcagatttctggtgtatagtttttaaaatttattcttgatgttaatgtagaatctgtaaggtatggttatatatgtaatacaaatgaaaaaaattggaataagagccaatgtgtttttctttttattaaattcaaaatgtttctaataaccacagataaaatgcagttgaaaacaagagcaaactttcctcgcatgtatcagtcaatcaaaccactttgaagaagataaattaatagcaccagtgccctttcatacaagtgtagctctattgaatattcttttggtaaaaacggcttgatttgccgcagaggtaaataatttcagactgtaattatttatactgcttgaatgattcagtggttcagagcacaaactgaaaaacgt

SEQ ID NO: 41563 - DNA, 774 bp, Oryza sativa
gtgaagtcgtagacgcccaacagcggcagcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaggccggcggtgaagacgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcacca

SEQ ID NO: 41564 - DNA, 9342 bp, Oryza sativa
aaaaactgctcaatattcaatcttttgatatatcaaattttgtttggttttaccacacaggttacttttccaatcataagtatttacagtgcttaggataagattatgtcaaacttttgaaattttgatcattaataatttctcaaatgcttagttaaaaaaatgcatatgcatttttgtcttgaaaggtatacaatcttggaggagtttactttgttatcaaaattaatcctaccaagttttggcaaggtaattagtaatctaaacatggtcaaaatttatctccactaccaaagtttattaatctagaatgtttagcaaaggtaacaaactaaacacaacttacacttctcaactaaccaaacattggtgatgccaaaatttgacacaaccaaaatttaataagattgatttaggcatcaaagtgaatagctccttaatatcataaacttattagatcctgtaaacttattaatataaaattaatattcaaagttttaaaagtttgtccgaatattatctaaaacataaaatatttatgacgaggtacattaccactattttatttacctatgaacagtaactaccaaagaactgcacacagtgatactcccaatgaagtcaaaaaagactcatgatagaaaattccagcagcatattttccatctaaaaaacagctgttgtgttcccaatccaaacaacgtatacaactatacatacagttgtagcaaaaaaataaaataaaatagtgcgagttgattcagcttcaagactcatccgggcatgcatgtgcctgtagcacaataattgcagtagttttgtttcatttcgagtactcaccaatccatcagtgtgatttcaaataggaaaataccagtgcgtacaaatttgtataccttccaggagttgtatccaagacaagtagacaagatacttcttttctcatcatcttgatgctattctgccaagctaactagccaatcatttctcagataagaagttatgaaatcagatcagaagcagcagaggttagacccggttaggccgttgtgagggccggccggacaggaggttgccgctgccggccggcaatcagagcgagaatattggattaggccggctgcagccatgtgaaatgagcagagccggattaattagtagtagattagttagtttaagcgaaaattctaagctctgttgcttagggatgagctgaaatttagtgcgatatgatgatgatgatgatgatgtgcttcgatagatgcttagatggaaaagaaaaacacacagtggcccaggtcatgtgattatatttatcccccgtgctattatatataggctttttctctgagcaaatgctggtgattagatccttaatttgtactttggggaaatgtcaaagcgagactttttgatgagctgagcgcgagctagcgtaatttccacacgttttatgttcactttggacaggaggagcaaatggagagatgagtcactgaaaagcctaactggttgcatcaaggacaagtcaggttcatagattcaggacaagcctaatgtgtgccagttaagatgagatgttttctcggtgctggcccatgtttagaataccaccactgggactaggaaaatcttggtttgctatagctgcaaacctacggtcaattcaactactaactcgtactactagtttttagcctctttcagagttggcaaagttttgtttaggactgcatcctcagcatttggttaatcatttaatcttagtaaagagtattttgaaatttctagtagtaggttgagtaggagtacttgagtatgtcctaatcgtcattaggcgaccaactgaagctgaaagtgggtatgtgtctccccaagtcacggtaataaggtaattaaaccaccatgtaggaatttcattcagataatggcttcttaccacaacagaaagcagagcgtgttgagagggatgcccggccaaacaggggtttttatctgggcgcaacatgccactgaaccagccactaaattgatttaagccacatataaaaagttttagtaataaatttctttgaacgttatattgtaatcgccacttaaattgatacatatgggctgtatttagattcaaagtttggatccaaacttcagtcctttttcatcatatcaacctgtcatacacacacaacttttcagtcacatcatctccaatttcaatcaaaatttaaattttacgctgaactaaacacatggttgattcgagaattgttcccctggatatttatttcacggtctatgcgtagctcatcacattcccggcagccaaatcatgaacccaaaacggatagagattacccctcccgatccatgctcatcatcacccgtaccatatgcccacctcctgacagaggcgccaatcaacttgacaacacttatctgttccccttacctcacctgtttagttagtgagcatgatgcagagcagcagacacattgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaacctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggccgcctcgtctgccgccgactggtgtctccgcctgcacggctggcctattatgctgtcgttgttgggcgtctacatcttcatcaccggcctgccttcgtcgccgccgattggtgtcctcgcctatacggttggttggtcacaccaccgttcatgggcgtccacgtcttcaccgccggcctgcctccgtcgccgccgactggtgtcctcgcctatacggttggttggtcacaccaccgttcatgggcgtccacgtcttcaccgaccggcatgcctccgtcgccgccgattggtgcctccgcctacacggctggcctattatgccgccgctgttgggcgtctacgacttcaccgaccggcttgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgctgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctgttatgccgccgttgttggatgtctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgaataacgcaaggtgctaagtattattcagaataaatcaaaagcatagagataagataatttattttctgctcttaataattgcaaaagtacccgagtagtaaactccgatccgtgaaactttgttccattaatgacgaactcatgacactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgattgttctgcaggatccagatccagatatgcataaaagggattcatggctttaagcttatctcttacgctccaggaatggatcagtcagaacatcaccaccggcttgccttcgccgccgccgactggtgtttccgcctgcacggctggcctattatgccgccgttgttgggcgtctacgtcttcaccgaccggccgcctccgccgccgccgactgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgaccgatgtcctcgcctgcacggctggcctttatgccgccgttgttgggcatctacgtcttcaccgaccggccgcctcgtccgccgccgaccgatgtcctcgcctgcacggctggcctttatgccgccgttgttggacgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtcaccgcctgcacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttttgttgccgccgactcgtgttcacttcctcacggcgatgcaactttgtcatcatggtggagcgacttcatctttattatcttcggcaccggcaaactctattgctgctacttcacaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaaggagctataattctcgactctatgttcagttgtttcccaactaaccaaagagtcgggggctacacaaatataaggctcaaaatttgacaaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcactgttgatgcgcgtctacatcttcatcgtcggtttgctcttgtcaccaccgactgttctttcgttgttgttgggcgcctacatcttcactgctagctgacctgactgttgccgactggtttcttcgcctccatggttatgcaacttcattacatttgattggtggcatctttactactactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacgtggattcatagtcatgagtctattttctatgctcaaagactggaccaattattattccccgtaagggctatcaaccgaatacttgcgccagtcgggattcaattattatatttatttttggagtatcccataagggataatcattcagatcagaagctattcatatgagctacacttggtctatattacccggaagatttattactcaggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcattgctttttgccacgtaagtgtgcgtttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagtacatctgttaaagcagtgtgcgcatggcgtatgcccaatactttggaaatttctttattcataatatacaagcttctttatagctattttgctatatcactcatcatattttacaaagcggttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcatgtttcgacacacatacacacacatccattagcagcaaacagttaatcatcatcagtcagctgctgcgctcgtccaatgccgtgccccagcgtcgtccacgtacatctctactcttatcatttggtgtacctaataagagtaggaggaggagaaggaggaggagaagaaaggactcgcgagaagaaaacaaaagaaaaggcgaggaaaagagagaaaggaactctcacaaatggggcagggggcgcgcggtgcagatccatccaagcgagagtacgtataaaaacaaacaaaaaaacacaggagagagagagagagagagagagagaaagaagcttggagagagagagaaaggagtagtagtagtagaggggagagagagagagggagaaaaatattggagaggggaagtgggggaggagggaggggtgggggcccacctccacaagttttactttttcagccgcccggttttgtcgtctcctccgtcctctcctcctcttcctcctcgctattaccccc

SEQ ID NO: 41565 - DNA, 7773 bp, Oryza sativa
cccccccccccccctctccctgttggttgccttctccgtgccgaacaccacagcgcgcgcgcgggggggcgggttcggctctctcgcgagctccgctctctgtccctctctctctctcgccgcctcctgcctcgcacactcgagattggtggggtggatttgggggaggaggaggtggggtggggtggggtggttgctgaggaggaggtggtggtgagagatcgggcggcgggttgccgccggaggaggtagagggatcctcgggggagggcggttcttgggtcgggggacccccccatggcgtgaggagagggtgccctccgggagatcttgcggggcgggtgtgtggtgttgctagctgaggctgttgggtgggtacccccgagcggccggggaatctcctcccttctcgagcgaccgcccgcgtcgctccgccatggccggcagcgacgaggtcaaccgcaacgagtgcaaggtgcgtgtgctcttccttcttgaaccccttccgctctctctcccgcggtggcgtgtgtgtccgtgtctgtcgcctccggattaggccgcggccgaggcggtcgcggttggggttcttgatttgcgccgccgcgcgcgccccgctcgctttatggtttgcggggggaaggatcgattggggccggcctggcctgcgatttggcggtcaatcgctgccttttctttcccctttgggctcagccccaattttatcccccctcgtgcttgcctcggccgttttagggcgggtggtgaactgtggtggtggtaatactgcctgcctgctgccggccgcagcggcagctacccaacaaagccggaagaaacccccattcacaatcaccgcggccgcccgtgttggttgggagcgttcgcgcgcgccaaagcttgcatctttgtggcaagcgcctctcgcattgggtttttttttttttttgggggggggggttgtttcttttttgtccgagcaggaatcagcaaagaaaaacatacgcatatgcacaccgattgattgattgctctggtttcgcttccgcgattgcgagatagtagtagtagtagagggtcgctcactgtggttgtggttgtggttggttgtggtgcagacggtggtgccgctccacacatgggtgctcatctccaacttcaagctgtcgtacaacattctgcggcgggcggacgggacgttcgagcgggacctcggggagtacctggacaggagggtgccggcgaacgcgcggccgctggagggggtgtcgtcgttcgaccacatcatcgaccagtcggtggggctggaggtgcgcatctaccgggcggcggcggagggtgacgcggaggagggggcggcggcggtgacgcggcccatccttgagttcctgacggacgcgccagcggcggagccgttcccggtgatcatattcttccacggcggcagcttcgtgcactcgtcggccagctcgaccatctacgacagtctgtgccgccggttcgtgaagctgagcaagggcgtcgtggtgtccgtcaactaccggcgcgcgccggagcaccgctacccgtgcgcgtacgacgacgggtggaccgcgctcaagtgggtcatgtcgcagccgttcatgcgcagcggcggcgacgcgcaggcccgcgtgttcctctccggcgacagctccggcggcaacatcgcccaccacgtcgccgtccgcgccgccgacgagggcgtcaaggtctgcggcaacatcctgctcaacgccatgttcggcggcaccgagcgcacggagtcggagcggcggctcgacggcaagtacttcgtgacgctccaggacagggactggtactggaaggcgtacctgccggaggacgccgaccgggaccatccggcgtgcaacccgttcggcccgaacggccggcggctcgggggcctccccttcgccaagagcctcatcatcgtgtcgggcctggacctcacctgcgaccggcagctcgcctacgccgacgccctccgggaggacggccaccacgtcaaggttgtccaatgcgagaacgccacggtggggttctacctgttgcccaacaccgtccactaccacgaggtcatggaggagatctccgacttcctcaacgctaacctctactactagtacatatacagcccctctccctctcccccctcgctgatcgtcgtctccaacacaaatactccttatagggaagatggtaattcagcttgactttgttatagtacctactactactactactactacctcctatactactgctgctgcttgggatcgcaatgccgtcgtctgctcttgtgtggcgaaggagaagctagctccatgctgtctgatcagctctaatcaaatggtgactcggttgcgtcgaggaagaagaagaaagtcgtccgtcgtcgtcgtccttgttccactaatcatcgttcatccttttctttttttgtggtttggatcgttctttgatccatgttttccatgttttgcctggggtcagtgtagtcaagacaagttgagggtagttccatgtctgtcatgcatgcctccattagtactactactgttgtgactttggttgatggagagaagaagcatgtttttttttcttttaatctcgcattccatccatcttctccatgtactccaaagagaggaaagttgctatctaacgttatgtgtacagtgatcgatcaacaaggagatttgaggaggcatgccccttttgttgctgttgatgttctagttttatcttctttcttgttaacaggattggatggtgctctcttgctcactctcaatccatgcttgctcactctcttgctcactcgtactagtcctttttagggtataaagcatttgcacgctgggtcgtcgtcgtcgtctcccttctgatcttttttctttattccctccgtttcaaaatgcttgaagacgttgactttttaagcatatgtttaaccgtttgtcttattaaaaaaatttaagtaattattaattctttttctatcatttgattcattgttaaatatatttttatgtagacataattttacatattttataaaagtttttgaataagacgaatgatcaaacgtgtgctaaaaaatcaacggtgttaaatatttcgaaattgagggagggagtatattgtggttgtaatgcgtgaactatgaatgccctctgcttcactccacatgggtgtcggtgagtgtaaacaagaagaggagaggagaggagaggatgggggctcatgcatatgtgagatttgtagtagcgctttgaggtgataactgtttgtcctttctctccccaatgccatgtgtcattctttctgtatgcgaaaattggatggacagccaattctgtgacgggcgtacttggatcctgccagtattacggcggtgtctgtcggtggtaaaaaaaaaaggcgctaggaaaaagcgctacgcaaaggaaggggtggcagcaagtccacagctaaatgcgaaaaccactaccccgtggaagtgacgtcgtctcgtctgtgttattttcgtccctggtacggccatgtgttggctgccagcctctgataaccgtgccaaacgttagtcgtgtcacagtcgtgttattagctgcaaccatgataagcttcacatcatttaacgtacttattgtccggtaaaacgtgtgctagtagtgcacgtagcaccatgtttaggaagggaatgtaatggagtttgtgggggttttgcctcttctcttcgatcctggttgtcctgagcgcatcggacgctggctgcctcgcggtcgcgggctggtatggatgtgacattattccgctccgtgcatgcatgtcaccgttgcgccgggccacgctttggctagtcgtaccactagcatgtactccatcatccttatgattcaagttataagttgttttttttggtctcgcaacaagacgtcgcaccagagctagcgcaggcgagatccgttgaatcacagcgtggcacgagcggctagctacatggtcgccgtcgtagttccaccactagcccgttgtttgattgatgccttgatgggtggctcctccgctccccgcgcgcttagcttagccatcacaacggtcgagcgcacctctctccagagccggggtagtaggttagttcatgtgaacgtccaaaaaagaacaactcggattgtgtaggggctcaacggtgagatactcctactttgtgtccaaaaacagctcggatcgtgaattcatgtacgttacatcaaaccggagcttactgtttttagtctctctcccatctccattttcatttagattgtgctcaaagcaggtacttactactagagagtagagaccaaccaatatttatttgaagccatccaagaagagtccatatgaatatggtcccgttcttctaataagagttggatggaagattttttaataagagttggatggaagattaagattttcgtggcacgctttttaaacttctaaacggtacattttatgtgaaaactttctgtatgaaagttgttctaaaatatcatattctattttttaagtttgtaatgattaaagcttaattaattatatgttaatataatctcgttttacgtaaaaaaatttcatcttttgtcttaagaaggaaagaacaccgcctatgttgatcgtcgcacggttgtaaagcggggaagaaagctactagcatggcaggtatcatcaaaaggccgagactttctcgtgcacttaaagtcacggagtagtgcagctagcggccgttgaaaatattgacgctttggaaaggtggcagaagtctcccgataaaggacaaacgacgcctgcctgcagctaccctcgctttcgactattattacgtgcactgtcccggctgcgctcgagctgaggctgaggctgaggctgagctgagctagcgtggtggcatcacgcggaccagacagatgccatatgccactccatttaattatgcgtgtaaaccctagtagtaacatttctatttctatggcatttttttcttggtgtttctcctcctctcgccgactagccgagcctatttggagcgtctgtcaactacattgacagtttcttttaaaatcttcagccgctaaaaactcttctatacaattcagattttaggcttttaaaatttaatttagaatataacaacttttctatatgttcccttatctaaaaatcacaatcatttttatttaacttcttcgtctatttatcttagctaattacagtaattttctatttaagcttacaataattttaacttaacaattttgtcgaagtttttatatttccggacaaaaatacgaggaaactggaactcttgttttctttctctctacatttttagccttgtttagattccaaaaacttttgacaaaaaaagtcaaatcaaatatttagacacatgtatggagcattaaatatggacggaaaaaaatttgcacagtttgcatgtaaattgtgagacgaatcttttgagcctaattacgccatgatttgacaatgtgatgctacagtaaacatttgctaatggcggtgcgggcagctagctagggtccgccctagagccgtccgcgtgagagcgacacgaggacttggcagtgtatacaatcgttatcgattctcactgtacctatatcaaggcattatacactatatatagtacacgtcctttttgttttttgacattgttggctggagcatgtgcaaaaatgtaagctaaatgatgattaccccagcgcgtgtgtactagtaaatccaacgtcttaacgacgttgccgcgggagtaggttgacacgacggccgggcgcgtggtgtgtgtgcttcgtgtcgtcacggcaactcgatcgatcgtccgcaccaaacgacccacacccgcacccaaaatcgagccgtaatcacggcgccgcgtgtgggcaaaaacaaacctcaccgccggccggaatgattccgggctagtgcgcccaatcatccgcgtggccgacgatgacgcgacgcgcgcgacgacacatgggggcgtggcacgggacagaggcagcagctagcgcagcgcccgcgcgcaggtgaaacgcgcgcgcgccccacgtgaagcggccgccggttacacggctcgcgcggacgccacggcgatgcctcgcgcgtggtggaatggtggaaaccgcggctggcacgttggcttggctcccggccggcgcgggggtttggtatggttttgtgctgggtggccacctgccgctccagacacgtacacgtactactcgtacgtatggctcggcttgtctcggtgtgtactagtagtattgttgtctcatcctacgtcagatagctattctcttcgtccacttgatataaaagattttttttcttaaactagcaaagtattctctccttcctataatacaaagtgctgtgttgtgttttagagcgatttgacacatcgtaatattataaatttgaaaaacaatctacttatatttgtagatacgtcacatctctctaacctccaaaatcctttatgttctggacggagagagttgcagatataaagaaaatgatgtaaaaggtgataggagacgtaataaactagtaaaaaaatggatatatggggattaaacccgtataaaagtgagtaggtaaaaaaaataatctatggctgtgtttagatccaggggtaaatatttttaccatatcacatcggatatacgaacacacatttgaagtattaaatatggtctaataacaaaacaaattacataatccgcctgtaaactgcgagacgaatttattaagcctaattaatatatcattagcaaatatttactgtagcatcacattgtcaaatcatggagcaattaggcttaaaagattcgtctcgcaaattagtcgcaatctatgtaattaattattttttagccaatatttaatacttcatgcagatattcaaacattcgatgtgactggctgaaaaattttagggtacgatctaaataaggcccctataaaagttggtatacgaggaataaagaaatgtctcgagatatcgcagaaaatcttttattttaaaacaaatttaaacaccaataatctccaatgtccaatttttcatcacagaataataatcaaaaacacctttgattttacaatctccctcttaatgaacacattggcaaaccttattaaaaatatttttgtgtttggaaaaataaaaacaaaagtggtaaaaagcacactgcgtacaaatgtacacatcgtgctaaaaaatccaaaagaaaacttctccccctttttaaaaagaaagaaattcccaattgaaccaaaaacatgctgttctcaataactctccaaaaattcaccttacttctccaaaaatccaaaaattttcacattacttctcccccttttgacaatgatttcatcaaacataggaattatgtttattaatgttcaagagcttagcatacatatagcatatcaagtcatgtgttgcaataaaaagaagataaacccatctataatataacaagcatgcattaaagtataaccatgaaccacagattttacaattaagcttgaatcaacaatcaaaattcatgatttcatacgatttataatgcaacatcttaacaagcacataggttgaaaaataaacactaaacacatatacctattgcatttatcactctttctcaaataacctttagcacaaaacaactaagagaattt

SEQ ID NO: 41566 - DNA, 1316 bp, Oryza sativa
  unsure (1)..(1316): unsure at all n locations
tcaaataacctttagcacaaaacaactaagagaattttttttaaccttttctttttcttgagcctttttgctcatatttttctattttattctgggtacgtctttgtcgtcaagactgtttcaaggaattcggcacccattattttgctcacatcgaatacgtccttgtcgtcaagaatgtttccaaggattcggtattcattttttcatattttttattctcttttcacaatgagcaaataaagctatttgaggaataacaagtcaataaagcatatatatatagagcatttatagatcaaaccatatgctagcatcaacattgcatatttgcttaattcaagtatagaatttaagtgtcatacatcatctcccttaaaagcaaaatctaaatctcatgaaaagattagaatacatacaagctatgctagagacaaataaaccttcaaagtattgctagcatgtacaagaaaataccatatgtataaacaaagctctcttttctcaatttttctcattgtcatattattgctcaataaaaccatgaggtacaaactccccctcaaaccatgccaaaaggatgaattatacccaattcaccacgaagaaaagcaaagcgattagaatccaaaagtttagtgaaaatatcagcaatttgcaactttgtgtccaaaaactgcaattcaaaatctcccttctcaacatgatccctaaaaaagtgaaaacgaatatcaatgtgctttgtgcgtgagtgttgaacaggattcttagcaatattgatagcaccagtattatcacaaaagagaggtactttctcaaaagtaagaccataatctttcaaagtagataaaagccaaagaatctgtgaacaacaactagcagcagcaacatattcagattcagcagttgactgagcaacactagattattttcctagaagaccatgcaatcaatgatgtaccaagaaaatgacatgttccactactacttttcctatcaattctacaacctccaaaatcggcatcagaatatccacttaagcatatagaagatgaaatagaataccaaattccaaactgaaatgtatgattcaaatacctcattattcgcttgaccgcttgacgatgtgaagcaagaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41567 - DNA, 3649 bp, Oryza sativa
tttcaccaaaaagaaaggtaaacaaaaaaaaatgatctacacggataagaaaaaaaggttacagcctaaatagatttattttatcccgatttctagggagaaggagagtttgtcaaacaacatggtcgtcgcagtacaatttaacgctttccattatttaatgtcttgttttgttttaattatatggagccatgtgtgaagcttctcagcacgctaaatattatagcattcgtcatatgtatgactaaggaagtacttttgtttgattgtatagcttattacatactttacactttgccacttgccacttactgcgtggaatttattaattcagctcactcatatatggcttgttatatatgtatgcatgcatgcatctcgatttgaatataggatgtgattgtatgcgttcataagtgtaatttcacgcgttatgtataataaataattaacaaaaattgctatactaatataatattttttttttgagaaatatggtcttccaaaaccctgtcacctcccaatttatatataatcagtggtgaactggtacttaccaccggtatgttttaatgcacatcgtaataagaaaacaattatacgtacagacagtataacaaagacaatttagctaggagaaattgacatggtagtttgaatgttgtttttatgagaaatgagactattaaatatttatttgtggagtgttactatgcaaaatttctttggagagctctacagtttactactagtttttatagtttatatgctcctcatagtatatctcatattttttagaattgctttgtgggggttgataaaaaatctaccaaacttattcttgttagagcatctgctatatgttgggctatatggttgtgtagaaatgatatggtttttgataaatcaccatctatgtcctataatcctatatgcatattcttttcagggcaacatactggccccggttctgagctcaactgctaaagtgtgatgaagaaatcaagtcagtgaaagttatatgtcgtaattttgattcaatagttatgcagttgctcgctaactttggatggagattcacaaatagaatttaataatttttgtgatcttgttatgctgtgtgagttttttttagtttgtgtgtccttttgtttattcaggtgtgagtttttggtgaattggtgtaataattaattggctgtagctctttgagcaaaggtcgggattatattccattattaaaagaaaacatattgtattgtagttgtaaatgtcaaactacagaagagaaatgggggagagagaccccggggggtgacttcacttttttctcggcgaatacgtttatcaccatataattaacgattggtgcatcagctgatttcagattattgactagaaatattaatcatgaatatttctcaagaacacatagcaagtttgagatctttgtatctattcgttagaaaaccagaaacaggcatgtaatggaaggaaatgaggtctttgccccgtgtgttgcagcgggattttaataaaaaaaattatcattaatatgttattattatatcttaattgttgtacgtatttgatactaacatgtggacatttttagccttacactgttctttttttctttcaacaaaaagtgaagagttggttggagtagctaacatttagaccatctagacctacctgtcatttttccccttaaaaaaactaggagttggtagtggggcagtggtatgtagaaccaccaccactactctcttttataagaagcatagtatacaactaccacaaaacaccacatcagtgatgcctccttcattgcgtcatgcatggaggaaggaaaggggaaagaagagggcatgcacggcggtcggctgcgcatggccagcagtgatgatgggccttgtgagaggagctagctagcggcaacagcaaaccatgtgggaggagaggatcctctcctctaacaagcggtggagtacttgcccgtcagagttgcccgtcagagatgactatcacctctgacagtcggtcacccgtcaaaggtgactggacacaacaatgaccactgttctttgaccaggcctaaacccatcaaaggtaagggtttatggccatcaaaggtgacctgatccggtgtagtgggagtaaaggactagtgatagaggactggcgagaggagcggcggcgagtccgttcatagggaagagtctgtgtcgtcacgtggagctcagccagcggcgggagggaatgacactggcagctgaaatattttgttgatttggtgttcgttctgttggatgaatcgtttttatcttttggatattgaaattattgatccgttggagaattcttagatctgttcttggtagatggatgtgtttcttatggggccgattgcaatctcatcagtgtgggctcgcaatctggcaataatgatccgctggctgattatcgctgagacagaagtgccggttccaaaatcgtcaccgacgttagttttgaaccagcactgatgtccaaacctgtggtaatgatagttggaaaattttaaagtctcaacacataatatagtactacctcttttttaaatatgtataacgtcgttgactttttgtccaacgtttgaccattcatcttattcaaaaaaatttatgtaattatttattttaatataacttgattcatcatcaaatgttctttaagcaagacataaatgttttcatatttgcaaaaaaatttaaataaaataaatggtcaaacgttggttaaaaagtcaaccgcgtcatacattaattaaaatacggagggagtatatagcaattggatagtttctttagcggcacaaaaatcatcacttgcttatgtagagcttatctaatgtgtgattatattctttcaacaaaacggatgcgcatcatttctcggtttattcctacatgtatggataatgcatgtatgagaattaattctacaatatgtatatgtcagcggccgtttgcaacgaatcaggagggaggccggaggtacagttaggagaataggcaaccaagccacctagcatgacaacgtagtaccaagattaatgttttattttaccatgaccaaaattattgttcattactgaattaactacctttaagtactcatttttaaacatcctaatgtggttggtgtggttctccaagtcgttggtatatttctttcattgatgaatctctattacttacgtattgaatcctgctatccacgcagcatgcatgcatacaggccgatatatttcttaaaagaaaatacagacgatcaacttaataattttatctgcctccgcaggcaaaatggcgatagctaggtactccctccgtttcacaatgtaagtcattctagcattttccacattcatattgatatatattttagatttattaaaatcaatatgaacgtggaaaatgcgtaggactctatatattgagctatctcctaaatcaacattggctgctaggcttaatatatattttctgctatgatttaactaatgaattaattaattgtcgctttccacgtaccatttcatatatatatatacatgtgcaaaattttaaatgcaagctgttttagacacatgaacttttcaaca

SEQ ID NO: 41568 - DNA, 1096 bp, Oryza sativa
cttacatgaatatatatatatatacatgtatatatatatacatatatatatatacatgtatatatatacatatatacatgtatatatatacatatacatatatatatacatatatatatacatgtatatatatatatacatatacatatatatatatacatatatatatatacatgtatatatatacacacatacatatacatatatatacacatatacatatatatatatatatatatatatatatatatatatatatatatatatatatatatatatatagagtgcataggactacaagcatttgcaccaaattggtatagggatattaagtctaaaagggatatagaaaaaattattcaaagattagaagatatccaaattataggagaaattcctatgaaatattgggaaaaaaatgctattgagtgcaaaattaatataataaacccagagtatattattaagactagcccaatagaagcaactccgaaagacatagaagaatttaagatgcatatagaagaactgttgaaactaggagccataagagaaagcagaagtccatataggtctgcagcgttcatagtaagaaatcatgcagaagaagttagaggtaaatctaggatggtcataaattataaaagactaaatgataatactatagaagatgcctataatatcccaaataagcaagaatggattaatagaatacaaggtagtaaatatttctcaaaatttgacttgaaagctggattctggcaagtaaaaatggcagaagaatctatagaatggactgcatttacatgtcctcaaggacattatgaatggcttgttatgccattaggattaaaaaatgcaccagcaattttccaaaggaaaatgcagaatatatttaacgaaaaccaagaattcatattagtctacatagatgacctgttagtcttctcaaggacttacaaagaacatattgctcatcttgaaatattttttagaaaggtggaacaaaatgggttaatattatccaaaaagaaaatggaaatatgcaaagaaaaaattaacttccttggacatggaagatacaggattatcttct

SEQ ID NO: 41569 - DNA, 1798 bp, Oryza sativa
acacagttggcaaccaaactaggagccggtaccgcaccgcatcgcacctagaacgactcaaggggtcgaatacctgtgggctacgattataaatagtcacttcctatggaaagaactcttcacccaaaaaatttcccgtacaatcgctatagttgaaggcaagagacccttgtaatttccaaaaatattctagatgggaaacgatggagaaaaggcatcaaaactatgcaaggaggcaggagggcctagcctagattcaagtaagtgtaaccctgatttattctcagaaatagatgatgaggaactctaacaaatttcaaaggtagttcctcgtagaatacattgactgattaaccacctaaattaactcttgcagatcttgctccaaccatcgggctagcgctcaccaccgtccccatggggtgggataaccgtaggaggaaacacggtattttcttttaatcgggacatctcttatagtctcttttgttgcggaccgatatcaatatggctctatttggcacaactctagatcttagatccacacagaacttgaagagtatattaaattatattgttttcaaaattattttctactctaaaataggaacaaaatgattcatccaagtgttatcaacgtaatcatagatctagatctatggatttgtggagctaccgatacccaggtccaagaaaccttggatctgaagttgtgtgaaaaagggccctaataaaataatacaatagtcctttgctccttgtaaacttttatccaattcaaacgttcggctataacctgtactaaaatatgcctattgtatcaaactcatgggatcaatacccaattctatcacaatgaaaataaacatgattatctctaatcatgagattcaatgaaatttacacttcgttttatacactttcccgagacaaattatgaaaaatatcaatcaacaattgaccattggcttccatgggagagggtaactacggttagttgaaagccataaaaacataatagtttttattagtaactatcccaagtagtaactgaacaaaattttaggtacgacaaaacttgggtgattatttggggtgattgttctccttgcgtagaactttccctgactttggcatacatttatataggaagtacaattttaatttttgaaacttgaccaagttttagcccaaacaaaatgatatttactaggatgatcaaaccagccccaacatcccaatgaggaacccctagagcataattcctcaaaatctacagggtgaagctgccatttcacaacccacataaaggaaacctaattgtgcaattacagcaaactctaggtcatctatgcaaaagcatgctcattcccctcctataagaacatctagaccccatagagcaaacattgtattgcccggctatgagaatttccaacgttatctagagtattttcaaacaaattctttgtagcctaccactataagcttaatccctcacttgacctttctttcatggtctcgagcgcaaggggttactaatcctctatttctttactctagcgagtacgataatgaatgcacgtggccgaggggctaggaatggaaacgggcccaaccgggggcgtgggggtggaagggctcattcagatgtggtggttggagcaaacaccaccgtactagcaacaaggaggtgggttgggttggagatagattccgtgccaggtaatgaggggcaacgtgacattgtgaactactacctccgttgcgccactggcgttggtaatggggagaggga

SEQ ID NO: 41570 - DNA, 2012 bp, Oryza sativa
taagtcaaatatccagtttttttaatctaatttccttgctcttgaacaaagctgtgaattgaattaatcaagagatatgcacttttctagcattagtgacacacacatatatgtcattcttctgttctttcttccttttgtttcattaggaaaatgaatgggcctcatcattgggcaatcaatacctcatacctcaatgagataatgttccttgttaccccatattaacaatctttttaggacatgttcagtttgatttcctttttgttcattgtattattaacatttagaatttatacaatctgcgctaatgtttggcctagtcagctaatcaccaccacggaaagtggcttgcatatctttatttacttggctttagccgatactaatagtgtatcatccattacagatgttgcatctgatgaagttgcaatttgtaacaatgatggcaaagatgctaaacttgctaatatctccacaacaaaggtacattaagttaatttctgatcatttttatttttcatgagaaatgcttccgataaaccactatatattgaagttaataaggaaattccattttattcattcagggctcttcatcatcaactgctggaaatgattcaggggatttcaaatggttaggtcctgaatcgcattctaaaaaagggaagagctacaaatccttctggcgaaggggatttacattcatggtacgcctatcaatcattcaacgcacattttttttaaatcttagaggactgaatcttggcttacatccattgtgttcatgaccctttttaggttcacgattttgtttacatcttggtccaacatggcaacaaacttgttgcttatgtggaagaactctatgaggataaccatgcaaacaagatggttcagatacgacggttccgcacactcaactccaccggtattcaactttctccaggtgttaatgatagagagatcctccactccgacaatttgcaagacatcggagttgaatgcatagatggattggcttcagtcctgaacgaagaacactttgagatgtttcaggcaattgccaacaacaccaacaggcaaccctacctatgcatccggcatatcgacaataacagcaatgtcaagacctttgacattgcacaactgcaagggtattcagaacaggagatatttagaatagtctcaggcacacctcccgtgaccgtgcatcccgacgcatctgaaggcagcaagaacacaccaagatcatcagccagaggtcatcatcatcatcggaccatggagaaccccactgctagtgatgagaccaatgttcaggccacaacaatcaatgtccttgcacgcaatgctgcaccaacagagtctgcttctgctctgataaactctgccctggagaagtatcttgagcagtacttctctcatggttgccttgtggaatgcctaagccaggacagtggcattaggggctgttggttcatcggttcagtgattaggaggtgcggagatcgcatcaaggtgaggtaccaacacctccaagatcccgaaacgccaagagcaaacctagaggtatgtcacctaatttcagtaccacttcagaaaatgtagttcgttgctgacaaattttatggtggcctctattggtagtagaatgaatgtacaccttttgttctttcttattcattggaccatatcgatttatactactatagtagaatattttcctctactgatagtagaactcataaattaacacttgagatgacttgtacgattgataatattgatagtagagcactatcgttagagattcaatagtaacttctactgttaataatatgttagagataagagagaatcccttatatgccactgaaaattggtctgatcccttatatgccattgaaaattggctcttcccttatatgccattgatccaaatttgcacaccctctcatgccactcccgttagttgaccgtgtgttgaccgttaatcctcaaggaaaaaa

SEQ ID NO: 41571 - DNA, 5571 bp, Oryza sativa
atataagggaagagccaattttcagtggcatataaaggatcagaccaattttcagtggcatataagggattatctctagagataatgtagtaacttctagtagattactaccagtagagctatatataaaataaaattctttcttttatagtaaccagatggcaagctcccactcatgtccatgaagctcaccttgagttaagggtgcaagcggctacccgcgaaaacccacttataagctaaactaatccgtgaactcgcttattttgacctataagtgggttcacgggtgacccacttgcacccctaccttgagttgagaaggctgacacgaattgattgttctcctgcaggaatggttgcttgtgacaagaaccgctaatcctgacacgctacgcatacgcctctctggaagaacaagaattcgtccccacaatatgtcggagagggagaacccctctacgatcagtgttggcaccgtcattgacggatggttgtatgatggttggtgggagggaattgtgctgaaggtgaacgatgcaaggaggctgctagcttacttaccaggtgaattgtcagttgattaccttcttagtggattcaaatttaacagtccatgatgcaaattcttgcttgtgtttagcttgttgccatgtcaacggagttctttccctcgtctgaatttgcaggggagaagaagatggtgctattccgcaaggatcaactgaggcattcactcgagtggattgataacgagtggaagaattttgctcaccgggaagatatcgcacgtcgaatccctagtgcggaagatcttagaataagagtcattactgcacgagaagttcttacaagagaagaagtaatgaagcaattggaaggcctgaaaacaaacaaaggtggttcaaactctgcaaaaccagctgcagagaagggaagtagcagctctgctactaagaaaaccacacctgatctcattaggcatgcaacaaatgatctaggatctttaaacttcaagcatgtcggtgttcctgcctctgaagaaattagaactgataacaagggatcgcaagttaatcttgaaaatgtcctaaagtcggacagtctaaaatggaccgagcgtaaggctagaggatcttttggtccaagaatgtagtcggatgggatcgttggtagcatcagccatggatacatcaaggaacagagcccctgaggagatcctggagaattaattgcctgatgatgaagtagtatgcaagatcaatggagagccattgccgagctagctgttcatcagatgaaagaacttgcaggatatgaattatgaaggatgatgcatattctctttttcttgatgaactatccaccttctatttttctttatgaattatgttctttggtgtgactttggttcattttctaggttattatgtcaaccacctgaactgagttttggacttctgatgtcaaagtcctgtgtgtgacgcaatccatttggttatattagctccataaaaaacttcaaatatcttttattaatatcatgagtgtagtttagaccatttttatcatccccttgtcatctcatccaatttgaaatgaaatagagtttgtagtcttaattttacccctgaattgctacttctgaagttaatgtcacttgtcggcaaaatttgtttttggcgcaacaaatgaaaaaaaaaagctgagaaagtagcgaagattctttggttaatttggtccatgccactgcaaatgtggctattcagaaaaataccattatcgtctattcgtaaccatgccactccaattttataaaattagaaccatgccactgccgtcaccttttccatccatccgcttcctttccgtcttcttccttccttctccatcttcttcacggcatcggcgtcctgggccatcccgtcggccgccgctctctggcgacagggctgtctcccggagccaagtggtcgtcgcggcagctgccaggtaccgctgctgctccccacgcgcgccggagtgccgccggccgtcgtcgcaaccgtggggttctgctgctgctgctcggccgtcgccgccaccaggtgccagcgcgagaagggaggatacagtgcggtggcttcagctatggcggtgcaaacgacggcggtggcgacgcccgcgctgacatgcggagggagggacggcgcgggctccggcacatggaaggagaaggggtgccgagggagccgggcatcggcgctgactcggcacgcaaaaggagccggggcacggagggatggggcggcggtgctggctccggtgctcagagaaaggagggaggggatggcggcgccagcttggctccctctcctccaagcttgccgacttggctctgggaggcggcgctatcgctggagagtggcggcggatgggctggcccagcagtggaactcggtggcggcgatggccgagcagaagtggaactcagtagcggcgacgactaagcagcagcagcggaaccccgcggtcgcggcaatggccggcgacactccggcacgcgtggggagcggcagcgggagcagcggaacctagcagctgctgtgacggctgctgccccatcctttctctgagcgtcggagccggcgccggcgccccatctccccgcgccacggctccttctgcgcgctgagtcagcgctgcctcccggctccctcgacgcccctactccttccacgcgtcgtcccatccctcctcgtgttagcatggacgccaccccctcccttcgcgcgccggcgccgtcaccgccgtcctctccctccgcacgtcggtgctagaagatggagaaggaaggaagaagatggaaaggaagaggatggatggaaaaggtgaggcagtggcatggttctaatttcgtaaaattggagtggcacggttacgaatagacgaattgtaatggcatttttctgaatagccacatttgcaatgggatggatcaaattaacccaagattctttgcggtcctggtgattcaattgatacagaattttgccgtcacaagacagaagagtctggacaatgatcatgctccctggtaaaactgtcagggttaaaatgagtttatctggttaattgcaactttatacttgattattattcttgaattgctgataccgtgaagaaagaagctgtggaatgatcaaatacatttccatatagctataaaaggtgcacattttctacattatactaatgacatatctatccatgaagtacatccattctttattcttatcaaacttcttgaaacgttgaaaatcttaccacctgtccaacttatcaatttcttgcatccaagtctcaaaccccagatggaacatcatgaactgaattatgaaaagctattgtttttctctgcaccattagcatgtggaggcaggaaaagccgaaatgctctagcatagcttgtatgtacgtatgtcttatcactcacaaagtggcatcacttagtatgcatgtacgcggtgagatcacctagcatacatatgtatgcatactccatggtccatgttttgacttgtgaagaacaacacatgcatatacaataaagaaatcatttattacatgtatctactacatatctattacatctattgtgagatatgcttaaatctatagaaattttaaatatcaatatctctttttagtaaggagtaaatatgagaaaacataaaaaaaaaatacaaacatgggtgcactgggccatgatgcccttgtgctcatctcctgttagctgtacaagtcaagcgctccccttttccaccttgatgacatcaagaagggggttaatagagatagaaacatgtatgcacaaaaataatggtaccaagaaaagaatatcattcaatacaaaaaataaaagtgtatcatgcatgaaaagcacttgttccaaaaaaaaaagaagcaaacatcattgcataatcaaaccatacctacaatacaccaaaaaaaaaagagctgtacatagtgaaacatatattaatgtaaaaaacagaaaggatgaaaaaaatagagaatacatatagattattctcttacattttatagtgattttcttgttttagtacatatgacacatggtagcatccatgcatctgaaaattctagaactttacgttatatactcaatatcttttaaaaagagagtaaactttcactttccacagaaaagagagaacataaaagtgctagtgtacaaattccgtttgtttctctaccactatatgcctactataacacatattttaagaaaatatagcaagaaccacatatatcacctacatctggacttctgcatttttatctaaatgataatcattactacgttatcactacagcagtgctagttttatcatctaggataattcagcacctatattgctttgaacagctgaagagaaatgataaaaatcctggtataaaaagagtgaaagataacatagaaaattgattatgttgtggcatttgcatggataattcttttagtttggccttccacatcatatgctttatgtgattccgtcgtattccatcccttagagtgaatgataagttgctcaaaaggaaagtaaacaactatcgtttgttgtacatttgtatttttatggcggcaccatttaattttccacgtcatatgtttgatctgtaccaccatattctatcacataattaaagaggacaagaacaaagtaggtgtcatatgcatttatccatgcatgactcaattctttatccttccacatcatcaactccacctccaactcattctatccctaagaataaatgaagagataagaaagcttaagatagaaacaaatatcatgcattgtacatgtaaattcaaccatggaccaccaccctcgtccaaatgtagccacataataaatgaataccaaatttcaggtgacctccctaggcatttcacttttaattttggatttttcttatgctagtattaatgccatcaatttttttcattcttgcccttcaatatttctacatattcttttatgaagtactcttacttttctaactacacctctcattttgtctaatggaatataagttctatgtgaccccattcaataattctattgccaaaatatttagaatcaaattacccaaactttttattgattatgacttaatacaaaaaataatcgaggcataattaatgttaagatatggtacgatgctaaggtatgatacaatcagacaaaatcaatattaagtttattcatggaatgtttggattcgagttaacatcttcacacatgtttgtacgatttggttattatttgcttacattgtccctaaatgatgatcttttaagggatgaatgctttaacaacaattaagtatataattgaacagtttcatgaaacatataaacttcatggggttccaattactttatgaaaggcgctcaacatttgctaaaatctgaataaaaccaaaggcttcattaatcaattgagtatatataaagaaaacaaattatgtctatgataaattccaatccaaaagata

SEQ ID NO: 41572 - DNA, 2183 bp, Oryza sativa
tgtcgagctacggatacccaactccaagaaaccttggttctgaagttgtgcaaaaagggtcataataaaataatagtcatttgcatgttgtacacttttatcaaattcaagtgtttggctagaacttacgattagaggtgggtattcggtttttccggtttaatcgcctcggtttgatggctccctaaaagatcggtttctgtagaatgacaaccgaagagcgtacgaataaaacaaaaaccgagaaaaaaaaagaccaaacaaaattggtttggatttttcggggttcagtttttaccgactaaatgtatgcctcgatctcccatcctcccatcatgcaaagctagccatgggcccaaaggtcgtgggctccaccacccacgcccacaagataaagcaaaattacgtgaaacaatgaggcagattcactcagagcctcagaaaccaatcctgtgcatgtggacttcaatttacttcggtttctttggtgagattggttgacagtaggcggaggccaaagaaactaccaaccactaaactgtattaaaacgaaaaccgcgccaccagctgaacactgaaaaaaaccaacacttcagtttggttcggttcagttcggtggtcggttttcgagaaatttctgcccacccctacttgtgctaaaatatgcctaatggatcaaactcatgggatcaattcccagttccatcgcaatgaaaataaacttgactatctctaatcatgagattcaatgaaatttacacttctttttatacactttcacgagacaaaacattttcaccaacaactggccattggcttccatgggaaagagtaattgtggttaattgaaagccataaaaatagaattatttttattagtaactatcccacatagtaactgaacaaaattttaggtatgacaaaactcgggtgattatttggggtgattattctccttgcgtagaactttcccttactttgtcatacatttatatagggagtacaatttgaatttttgaaacttgacccaagttatggcccaaacaaaatgatatttactatgcatgtgaaattgtattggcaaatttcttgaggctgatcaaagcagccccaacatcccacatgaggaacccttagagcataattcctcaaaactacatggtgaagctgccatttcacaacccacataaagaaacctaattgtgcaattacagcaaactctagggtcctctatgcaaaaaaaatattcattcccctcctataagaacccctacaagattaaagtcttcatatggctgcttttttgtggcagactaaacacgagagatatattggatagaaggaattgtgctcctttgatctcacttgcgttctttgttcgttgcagcaaagagaaactccgtttcatctgtttttctagtgtccatttagtagaaagtgttggcataagcttggaatatcatggaacacctctttggaattctttcagatgttggtgctggcaagattgaggttcaggaggaagggctttttggaaatttgctttattgcgtgctgtcacatttgggaacaacgaaataggaagatttttcagaatatggatccttcttttgatagattcttctacatatgtgtagaatgaatgatccacttaggcaatcggtctctgattggttacaaactttatagttctttagggaggctgtagccttttgtaatttttcttttttgctgtaaatactttttctccttttttataaaatacactactgggcaaatgcctggtagttttcctttcaaaaaaaaagaacccctacaacccatagcccaaacattgtattgcctggctgtgagaatttccaacgttgtctagagtatttttcaaatttcaaataaatatttgtagcctaccactataagcttaatccctcacttgaactttttttcattatctcgagcataaggtggtcactaatcttctcttcctctactatagcaagtacgatgatgaatgtatgtgggccgaggggctaggaatgggaaagagcgcaaccatgggcgtgggggtagaggggctcgctcagatgtggtggttgaagcgaacacctccgtactagcaacaaggagatgtaagggcttctaaacacatttcatcttattatccaatgcgctgcaatttcatg

SEQ ID NO: 41573 - DNA, 34321 bp, Oryza sativa
  unsure (1)..(34321): unsure at all n locations
ccattagcacatgattaattaagtatctgctattttttttaaaaaaatggactaatatgatttttttaagtaactttcgtatagaaactttttacaaaaaaatgcaccgtttagtagtttgaaaagcgtgctaacggaaaacgaggagtaatagcctgaaaagaacgcagcctaagaagggtcttacttcggtagacatttcctttgatgcctttcccgttgtcaatttatctataaacatatttgagctgctaacttgtgggtcctaacccctatgtactagtacaccgctatagggccttgtctccatttgccagtcacacaatggatgatatctttgtaatgtgcacgtgcttgtagtatatattagtgagcaaaattttcctatacatagcagagatatgcatatagagttcaatgatctaaaaacttaccttctttttagtatattgtttccatttgctattagtatggacttgaccttgcatatacttctctgggttggcttgatttaagctattgcaatttagatgaagacttgtcagatctgtatgtgtatttcagacttatcatggttattaaacccaatgagtcatagaacttcacttaaatggttgtaaagttttgttctttaacaagtcaaatatcttttttattctaatttcccaactcttgaacaaagctgtgaattgaattaatcaagagatatgcacttttctagcattagcgacatggacatatatgccttcttctattctttcttccttttgtttcattagcaaaatgaatgggcctcatcattgtgcagtcaatacctcaatgagataatgttccttgttaccccatattagcatctgttttaggacatgttcagtttgattttctttttgttcatcgtatattaatatttacaatttttacgatctgcactaatctttggactcgtcagctaatcaccactgtgaaaattggcatgcatatatttgttttttcggtttttgccagtcctaatagtgtatcatccatgatagatgttacatctgatgaagttgcaatttgtaacaatgatggtgaaaatgctaagcttgctaatatctccacaacaaaggtacattaagctaatttctgatcatttttatttttcatgagaaatgcttccgataaagcactatatattgaagttaataaggaaatttcattttattcattcaggactcttcatcatcggctgctggaaatgattcaagtggcttcaaatggttaggtcctgaatcgcattccaaaaaaagggaagagctacaaatccttctggcgaaggggatttacattcatggtacgcttatcaatcatcagcgcatttttaaaaaaaatcttagaggactgaatcttaggcttacaccaattgtgttcatgacactttttaggttcacgattttgtttacatcttggtccaacatggcaacaaacttgttgcttatgtggaagaactctacaaggataaccatgcaaacaacatggttcagatacgatggtttcacacactcaactcctctggtattcagctttctccaggtgttaatgatagagagatcctcctctccgacaatttgcaagacatcagagttgaatgcatagacggattggcttgagtcctgaacaaataacactttgagaagtttcaagcaattgccaacaacatcgactggcagccctacctatgcattcggcatatcgacgatgatagcaatgtcaagacctttgacattgcacagttgcaagggtattcagaacaggagatatttagaacaatcttaggaacacctcccgtgaacatgcaacccgacgcatccgaaggcaacaagaacacacaagatcatcagatagaggtcatcatcatcatcaaactgtggagaaccccactgcaggtgatgagaccatgttcaggccgcaacaatcaatgtcactgcacgcaatgctgcaccaacagagcctgcatctgctctgatgaactctgccctggagcagtatctcgagtagtacttctctcctggttgccttgttgaatgcctgagccaggaaagtggcattaggggatgttggttcattggttcagtgatcaggaggcgcggagatcgcatcaaggtgaggtaccaacacctccaagatcctgaaacaccaagagcaaacctagaggtatgtcgcctaatttcagtaccacttctgaaaatgcagttcgttcttgacaaatttacggtggcctctatgggtagtagaatgaatctacaccttttgttctttcttattaattggaccatatcgatttatactactatagtagaatattttcctctactgatagtagaagtcataaattaacagctcagatgacttgtacggttgataatattgatagtagagcactatcgttagagatacaatagtaacttctactgttgataatatggtagaactaaagtagtaacttagagttatatagtaaaataaaattctttcttttatagtaaccagatggcaagctcccgctcatgtccatgaagctcactttgagttgagaaggctgacacgaactggttgttctcctgcaggaatggttgcttgtgacaagaaccgctaatcctgaccctctgtgcatacgcctctctggaagaacaagaattcgtccccacaatatgtcggagagggagaacccctctacgatcggtgttggcactgtcattgacggatggttgtatgatggttggtgggagggaattttgctgaaggtgagtgatgcaaggaggctgctagcttacttaccaggtgaattgtcagttgattacctccttagtggattcaaatttaacagtccatgatgcaaattcttgcttgtctttagcttgttgccatgtcaacggagttctttccattgtctgaatttgcaggggagaagaagatggtgttattccatagggatcaactgaggcattcactcgagtggatcgatagcaaatggaaggcttttgctcaccgggaagatctcagaataagtcattactgcacaagaagttcctacaagagaagaagtaatgaggcaaatggaaggccttcaaacaaacaaaggtggttcaaactctgcaataccagctatgcactgaattcaccaggatctcctcaggggctctgctccttgatgtatccatggctaatgctaccactgctccttgaagtatgcacgatcagtggagaatcattgcccagctagctgttcatcagttgaaagaacttgcaggatatgaattatcaaggatgatatatcttctctttttctttctgaactatgcatcttctccttttttttttttatgaattatgcatctttggtgtgactttggttcatctcctaggttattatgtcaaccacctgaactgagtcttggacttctgatgtcacagtcttgtgtgtaatgcagtccatttggttatatcagctccataaaaaacttcaaatatctttcgtgaatgtcttggttgtagtttagaccatttttatcatccccttgtcatcttatccaatttgaaatgaaatggagtttgcagtcttttacccctgaattgatacttgtgaagttaatgtcacaagccagcaaatttgtttctagagcagtaaatgaaaaaagaagcaaaggaagttgcgaagaggcttttggttcagctgaagcagaattttaccagtacaggactgaagaatctgatcaatgatcatgctcccttggtaaaactggcagggttaaagtgagttcatctgattaattgcaactttatagttgctgttattgttgaactgctaatactgtcaagaaagaagctaggacatgatgaaatatattttgcatctagctacgaaaaaaaacgcaccttttttacaggtatgctgatgacaaatctatccatgaagtacatcattttttttattcttttcaaatgccaatgttttcttgaaacgttgaaaatcgtaccacctgtccaacttatcactttcttgcattcaagtctcaaaccccagatggaacatccatcacgaaccaaatcctgaaaaaaaaataaaaaagaggagccagcaaattgttacatacatcgtaaaagtctgcactttctaaaaaaacaaagtctcaaagtcgatggagaaacatatctgcatctcactgtcaagttcttttactgaatccatgggttcagacttcaggctgaagatacagagaaatgaaacggagagctcatgagaaaaggtgagatgagaagcagctaaaaggggctgtgcatggaagccaggctgccacagaatccgattctgaagacacgcatcgatcccacacaaaaggaatggaatgaaccgagtcactgagcagccataaaaaggggattaaagaggcacgcttgcttaagcactaaccaaagcagagcaagaatccggccaactccatgctttttttccactaccttttctgaagctctgaactctgaagaagtagtagtagtctgaaccatagttcagtttcgtcatcgtcgtcttcgccgtcgccgaggaagagctccttctccatggactacagggtaacagccatggccatgagtgtgtcgaagcttgagagaagtagcaatgggatgatgatcatatgatgctcaatcactgtgcttggttgctgtgttgcagctctactacatgacgctcaggatgaacatcgactgcaacgggtgctaccacaagatcaggagggcgctgctccagatgcaaggtatcgctccgtccctaaatattcaacgccattttaaacatatctggctatccatcttattaaaaaaatttaagtaattattaatttctttttctatcatttgattcattgttaaatatgtttttatgtatacatatagttttacatattttacaaaaacggagggagtaggaaggtagccggtctggctggccatggcgacgccggccggtgaaacgaagcttttgtttttttttctgccatggcgacgccggtgactgatgctgctgctgctgtgtgtgcgcttgcttggtttgcagagctggagagccacctgatcgacaggaagcacggcagggtgagcgtgttcggggccttcagcccgcaggacgtggcgatcaagatcaggaagcggaccaaccgccgcgtcgagatcctcgaggtcagggaggccgcgccgccgccgccgttcgtcggttactatggcggcggcggcggcggcggccacgcggcttagagctgaggcctttgcctgaactgtccatgtactcatacagacacagtttgtgttaggttctgaaattttcttccagctaacccaaaaataataataattttgagtttcttcttcttttgacaacgttgtgttagcgtttatcatcaaatgatttaccagagcttaatcggtaatatcgattatgcctttcttttggagtcaggagtgatgtgtaggcttgttttgcttgggtgttagataaaacttcccaaggtatgaatgctaaatgtgaaatttagcaaatggaaaacagatttaattttctcattttgaagtttggacaggacaaaattgactttttaggagccatgtaatattttgcatttcaacatgttcacaaactgtgatgtattgtccatgaaaatcaaggcctccatttcaatagtactactagtacactcatcaagaatcaggcagccaggaccaatgctaatatgagcatagcacatagagatgaaaaagaaaggaatataatcagatttttcttgtgcaaaatctattagtaccaaacatgtgatacttgcttcacaaagtaatcaaaattccttggcaattggtgagattctggaaacttacctgtatgcgagaacctgttgcgagataagtagttttcaattactcattacctgggagaattagggactcagagtatctatcttcaagtaaaaaaaatgtatggaaactggaaatgagcatttcacttattccgtggcgggtataagaaaaaatattgatcatatggcaataacattaaaacaataacaaaactatttacaattaatggctacaaatgctcggtggaattattcttccaattcgaatcaaacaaactgcagatacttagggagcacttgtgagggacattttccctacaatgttaggctctcaggatcctcaatgatcttcgcaaatgtctgcaggaatgctgccaaatcagcaccatatataatcctgtggtcagcagtaacattgacctgaaaaggttgggagaaacatagttcagaagcttcagagaagtatctctgaaagaaaaatttattgcaaccagtgaaatgttgaaaggtaagatgtgctgtgacacgctgctgggaactgtccacacagaatcgatagataataagtatagatataagtcacaaaaaactttttttaaactaaactaagtcagtgattgactgaaagaacaacagactggtatgaactcattacaggaaccaactcagagaagccaaacatccagttggcacctctaggttttaacaataatgacacaagcatgaagctgaaaataacaggtctacactatgcacttattacgttcaatcaggtgcatataaattattccacttgccgatccaattacaagatgacaaaatatacttagttccatatttgcaaggaaatcttactcattgatttttagagttgaatgcataattgcatatgccaaattactatcaatggtcagtcactgagcatgagcagagctttgaggcatacaggccgtaaagtgtgaaaaacaaactaaccagcatttcgttcttgatgctaaagaaaccatctttgttggccaccaaagtaggtctcgatcctccaacagccataatagccccctgcattgagcgagccatcgacaaacagttgttcttagttctcatattgctcaaatacaattctgtcaaaatttcatactgactgggcagtcaatgaaaaaacctacctgaccaggtggaaggattgcatcgaatctatccacaccaaacatacccaaattagacagcgtaaaagtccctacaaatcatcaaacttcaggtaagcgtggtttccataaaaaaccaagtgccaatcacaatacaacatattctgtacctgaactgtattcgtctggttggagctgcttcatgcgtgccttcttgagcaggcctctccacttttgtgcaagaaggtatacatccaactgcaatgttagtttttttcagaaaatgttagatcattcactagacgctaattcgcaacaatgctacatttcttaacagaacgcagctaccgcaataagcatgtaccttatcaacatcctccaagacaggcgtaagaaggccgccctcgatcgcgacagccacagcaatgttgatactactgttgtaactgaagctcttcccatccctgcagctggcattcacaaccgggtgctgcgtgagcgccatggccgcggccttcaccagcaacaatgtctttgtgacccctttcgatttaacctactcaattcatttcagtcaaactataactaaactgtaactctagcagctatgaatttcaccaattttgcaggggattcatagaaatgacaccttctcgcatagtgcgtcgagcttgtcagtgcacacggcgtagccgactctgaatgttggcactgacaggctctccatcatgttcctgctcaccgcggcttgcatcgtcgtgaacggcaccaccgtcgcgccaggcaccggtggcagcgctgctggttgccggggtgccgccgccatcggcggcggagggcgaggagcggggtggtgaggcggaggcggagggtgagcagcggggtgtctgtgtggcgatggaggtggaggcggaggcggaggtggagcgccctttgggccctttagctttggcttgatgccagcggccgcctcgacgtcggctccggtgacgcggccgtgtggcccggtgccgacgaccatggagatgtccaccctgtgctgcttcgctagcttcttggcgtgcggcgtggcgacgcccttcgtcggcggcggtccaggaggggcatgtggtggtggtggcggcggcggcggcggcgcagccttgggaacgtggggaggagggggttcttggcccgggcctctcgggagagcctgtgcacgcgcctgcgcgacggcgacctcctcctcggactccgccaggagggcgatgggggcgccgacgggggcggactcaccggccgggacgaggacgacggcgacgatcccgtcgtagaaggtctccacgtccatgtccgccttgtcggactccaccaccaccacggggtcccccttggcgacgcggtccccctccgccgccgtccaggagacgatcctcccctccgtcatcgtcgagctcagcgccggcatgaagatctcccgcaccttcgcccgcacgacgctcaccctccgccgccgcggcgccgccgtgacgggtcccgcgccgcgcgcgcggccctgcgaggcggtggagaccgggagcgagagggacgccagcgacgccatggtcgagccgaccaccagaggggggaggagcatgtcgcgggcggtggtgcggcggcggcggcggagtccggcgacctcgtcggcggcggcgcgagcggaggaggaggaggagaagaagagtcgcctcagtgaaggcgaccatcccgctgccgtgtgggccccacggcgcgtgtcgttcccgtgttacttggggctctctctgggccgtccgatcgagatcggacggtccagatcgacttcattagtctgaaacttgtgcacgagaatcctcttaagaatttagtattacgcttaacgccttaagcccccacccaaaagatatggatcgtgatttcgtggataaaacacactcgtcgcagataaaccgcccgatggagatcccacggctctgatcgagacacgtgtagtgactcaaacatgttcattgaaccgaacgtcatatgacgttcctctctgtcctgatcagaagaattcagtgacgttttcctgctgttgatttctactccccacgtaaaaaaaaaaaagacaaaccctggatttccgcgtccaacatttgactgtccgtcttatataaaatttttttataattagtattttcattgttgttagatgataaaatatagttaatactttatgcgtggcttatctttttaatttttttcataatttttttaaataagaggtcaaacgttggatatagaaatccaggggttttttttttatggagggagtagtgaaaaccaggacatttccttagtgttgagaggctgaagaaagcatttgttcccttttctgacgtcgtgctgacaagcaaaataattagtccattccgtaaacataaacatgcatgaaaaaagaaagagtgaattatactttggaccaatgttttattgtcaaagttttactttggatcaccctatacttaatcttttttctttgaattaggtaaatttacgtttgttgcataatggatcatcctaactctctttgctaaccatgtcagtgtctccttcaacaaaggtatggcatacgtacagatatgaaagttcaccgacacactgttaacgatttgctcgaagtcattgaagtgcaaaagatgtggtttatggtactctattgtgcaacaaagataaatttattagtccaaagtgaaaagatttaacaaagggtggtccaaagtaaaacttccggcccctttcccctgtcactcccttatgttgaggagcaggatcgaagcaagactctatccaaatctcaaagaataacagctaggcggccagtgggcaaagaaagggggcgggccagccggtcggggcccacccgcctaaacgcagcgccctttcacattatcatctaccattctttctttacttatatctacataagatatcacctgaatcgcccccatctatcctcttgaggagaagtttgtttggtttcaaactccgattcaagcaggaggagtacgccatactaatgtgtcttggatgattcacatcttctggttaggtgctgattgcacgcaaagagtaagtcctccttaagttcaactcaacctgtagttgatgttaagataagggggttctacaaaccgggataatattaaggagcctgctaaaaaataaaagaaaggtggttggtaatgaaacatggcccaaaatgaaattaacttaaaataaaattttctgtctaagatttctgggttgcatgattaaacaaggaatattgatcaaatggtgtcccatcatcatcatggcaagagatggcgagagcactgaacaatataatcaccaaacctgtaggcgaggcaaccggtggctgctactgaagcaagccatcaggcatcgaccatggcaattgtcatccatccagccaagttgccaacgaccaagctcgctcgatccatgtgaggtcaaacttccaagtcttccctgatgttattttagggaaatttaactatttgtcactcatgtgacatggcaattaacgatttgccacaccctatcaatgacatgtgagccctcatgtgtctatgatatatgaggctagtggtaaatcattaaacaacatccgtaataatggcaaatagttaaaagccccgttattttaaggcatcatctcttctgctttatctaataaattctggcacatctttatcaatctaacctgactaatggtagtataaatgccctcctaactggctgatggttacgtgtgctagcatatgtatctcgaatccgaatttctattaaaagaatcctaataaatccctttgaaaccttggctcaagtatgcaattgatagacgcgtcgcttataaagtgtttggttgtcggttacactttatcataatttaccacgtttaaggttagataaatttaattgcttggtagttatttggttgtatccactgttgtgacattctagacgacgaaaaaagtgtggcaaaatttcctaatgatgattaagatgtggtgaagaatttgatttttctcaacttaaccaactatgacactataaatagtgataaagtatacttaggaactacacaactccttagcctcttaacgatgcactcttgattttaaattatgatactctactatattttaaagggagtatatcttaggctcctttcgttctctcaattggcagacataaatttagctcacgtaaaatgagaaacaaattattggacatgattaattaaatattaattaccataaaaattaaaaaaaatagatttatttgatttcttttaaacaatttctaaaaaactttttataaaaacacaatgtttaatattttaaaaagtatgcaaatgaaaaagagaaagttgaattttcgagtcgagaaaaaaaaaactatgccttaccgccatagaataaagaaattgtttatacttcctatacatactactactactcgaaattaatatgtagtaataaagtagtaccagcatttagagctttgttccttaatattctagggcagattcttaacattatgtgccacaggtcagccacctgacatcagattaagtgttgccgtgctgtgggctgtcacggaattgaagagtttcaggcacatgtgttttgtgcagaggaaaacatggggtcaatcctgacgactcagttttttttctgaaatcgtcttttctttccctaatcatatcaggaacataaagccgccggcccaccggccgccatttcgtcgcagtttctgataagctgaacggagattaattattagagcacctatagtaaagtaaggtgctctctataaaacatgtacatcttagcaatagattagattaatagtaaaccacctcaatagtatgtctacataggtatctatagctctataatgtattgcctcgtttttcttaatagactatcttcaggttagtagatagctttgctctctctcttcatttaatctcttccaaataaaaaaatatgctgacatgtatctctggtagagagcctatagatatgggcagatcaccttttgtgtttccccattgtgaatgttgtttacgtgcgtaaacacctggcctgacaatgcgaggtgcagcgagcttcactcctctccatttttactagacaacgtacatgtacagcagcgccatagtaaaagtagaggttttatgcttccgtatctcactaatttgtccgggagaataaattttagtcacttcgattaatattcacgttttcagtttttttattgagttaattaaaggcatagatttcctactgaagatagtaccagtacaaatatacatacaactgtaattgcgaggttatttacaggagctggctgagtgcttctgttagggtgtgtttggttggagggatatccctcgtttttttacgcgcacgctttctaaacggttaaactgtatatatatatatatatatatatatgtgttactttaaaagtaatattgataatctttttaaaaacattaggtaatactaaattaatcacgtgctaagagcaatgataataatagagctcacttcctactattagttcattttaaagccaacatatattatagattagttatacgattggctacaattttcttcttatctctctatctctcacttatacatttaatgcatttgtcttggagcttgtgataagctagttcttgtatgagagccaacatccttaatttttcactacctctcttctccacctaagcttatagtagccttatagcttatcattattatacttgctctaatggactatattgttttgcatgttcggaggaaaagttcgcaactcccctttaccgaacacagctgctatgttcggtttcttgagttgggaacttacactccatgcacgcaaaacagcgcaactcattagcgcatgattaatttagtattagttatttttttgaaaatttgattaatatgaattcgtatagaaaatttttgtcgtttaattagtttgaaaagcgtgcgtgtgaaaaacgagagagatgagttgggaaagtgaagaaccaaactcagccttgcattgctaattaggaatatctattgatgtagaatagagagaagaaaagagacaaatagttaacaactcaaataatacccttagcctttataaaataaaaactttgctccattaggtgaagaaagaattgtaataaaactatttttatttctagttaaattttttttaatctattagaagaatatgtatatagtctttaaataaacacgtatcgtctaacttcgaacatgccataaaaatacaataaatcttctatggtacaagttgtactatatacaaaatactctccctccatttcatattaaaaatatttttttcttagtcaaaattttttaagtttgatgaagtctatataaaaatataacaattttttaacacaaaacaaacaaactatcaaaatatattcactgttatatttaatgaaattaatttaatattgtagatgttgctaacttgatcaaactaaaaaaaagttttaaaaaaaatcaaaacgacttataacggaacggatgtagtagtagattgtattgcaaaaaagaaaaaaaattcgcccccaccgttccatatcataagtctcattgacttttttaaatcaaacattttaaaaatttgatcaagtttatagaaaatacaacaacatttataatatctattttgatagttcctacaaatttgattaaaactagacaagtttgttttagaaaaatatctaaacgacgtatgccggagtgtagtggaaccccctactccaccctcccttgcgataagagtttttttttctttcttagtagcttatcttctatgtatatgtaatcaaactctgctctcttcttctattatattgccgtgtaattctttttacgtgtccgtaaaagaaaataaacaacttatgccctgttacttctcatgcaaaaaaactttcaccctgtcatatcgaaagtttggacacatgcatggagtattaaatatagaaaaaaactaattacatagattgtgtgtaaattgcgagacgaatcttttaagcctaattgatccatgatttgataatgtggtggtacagtaaaaatttgctaatgacggattaattaggtttaataaattcgtatcgcagtttctaggcggaatctgtaatttgttttgttatcaatctatgtttaatactttaaatgtgtgtccgtatatccgatgtgacacaccaaaacttttcgtctcacgaactccggccgagttatgaaattaatttttccattcgtgtccgaaaacccctttcgacattcggtcaaatatctgacgtgacactcaaatttttttttcgcgaactgaacacaccctaaactgagcctttatcctgctaagctctcccgggttggagtcttcttccatttgctttcgagtcgtcttcaacccctccacccccgacctgttccagccgcatacacgccggtgtgcccattttgtcaacgcgcagtctccctgactttctctcctccccggcgctgcgcttcgccgtggagtgccgtgagcccgtgatgccacgcgacgcgccccccagccgacgccgacggcgacatctctgaaacatttctcctcgaccacggcaacccaaaaccccaccccacccaccaatccccaacccaaccaaacaccaccaccgccgccgcgcccgcgccagcagcagcagcaagtagagccacggcgggggaggcaggggggcagcagggcatgaagccccgcgagctcctggagcgcatcgcacggccgttcagctcgtcgtcctcccgccgcggcgggggcgcggagcggcggcggcgggaggaggaggaggcggacctggaggcgatcgcggcgagggagcagcgcgcgttccggtacgaggccctgagcgccgcgacgcgggggttctccgagcggcagaagctcgggcagggcgggttcggccccgtctaccgcggccgcctcgccgacggccgggaggtcgccgtcaagcgcctcggcgccgggtcccgccagggcgcccgcgagttccgcaacgaggccaccctcctctcccgcgtccagcaccgcaacgtcgtcaacctcatcggctactgcgcccacggccccgacgacaagctcctcgtctacgagtacgtccccaacgagagcctcgacaagatcctcttctcctcccctccgccgccgccccgaaacttccactgtgagtactccaatttcttcttccttcgccattgccttccgcaaaattttcaccgcgtgaacggaaccagtttaatcatccgatggacgcgtcgttttttttttttttttggggatcggattatcagttcaatgcttggaaaagtcgcgtgcactgtttcttgttgctaggacagctcattgcttgcgtcagcgggtggtcatcaccgatgcatcgatctatctatctaacaaattaaaatacggctgctactagatgctttgctgttgctgacaaagctcttctcttaacaattactactagctcactgcatttgcacactgtggcacaattatagttttgagttgcatacttgcattatctggagtcttagagataaaatcggattaatcaggcatggaaaatttgaggcagatttgttactacaagatagggcatatgttcatttgttcgttcttgaaaaaattgtgtcttgcatttcccaactgtttgttttccctgtttatgagatagtagtagcttccataggaacctggaaaaactcttccattcattcaaaactagtatgcttaactgttcttgtacgtttcaagattcctcccaaattctcttaaatgaaattcctcccaaattaaaattggaagcatctctctggatattagtggttgtttggcttaccaaaaagaaaaatagaaactcaaggaaccatcaacccatttggtttgttgaataaaacccagcattcccagcaaaccaccatttggttacaaggaatgggactgtgatagaaaaatgagtgaaggtttaggatggaatgagatgagaagaattgtatggttaggataaaaactatcctttgatgggtaatatattctttttccaagcccatttgccaaacgcctcccaaagtttttgttaggcaaagccaactaaagctcacacacttccaaaatcttaacaacaacaaaagcatagtttatgaaaatttggggataacttgcattattacattagtaataaaccaaataggccacggatagcttggtgcattagacattcaataactatggcacagtgatggttgtggatgaccagagtcgttgacaagtacagcgacgcgtcgtctccacatcgctaccctgttgggattttggaagaagacgcagcagtcacagaagccgtgtcgtactagtagcagtaccgagtccaagatcgatctatcatcagcaaccacatctatgaactttggccaaggcttctgatcaatcacacgatcaaagtctctactttgcaaaattcaatcacataatcaaaagtctattttgcaaaatcgcaaaggcaggacttcatctatgaactttggccaaggcttctgatcaatcacataatcaaagtctctagtactttgcaaaattcaatcacctaatcaaatagtctattttgcaaaattgcaaaggcagggcttctcggctgttttcctattaggcacgcgtgcgattttaggaagccagctggctgccggtgccggctctaacctcagtcctcagaatgtactgcacgtaacaaactctcctgctccaagtaattgatcttttataataaggttgcagtagcgatcttgttatgattcgcctggttttggtcgcatgcgctaatttctttctctgaccaaacctctagtattagttgagatgagaattcaggtcgcgtttatccatttcttcttgcttttgatttctcgtgcatttctagaagcggcattctgctgctgcagatgagacacacacacacacacatgattgcgtatggatgcatgagaaatcgatcctgcaaatgctgctctgctttgccttttcgctaaaagggcgattttcatcatgcgtggtggtgtgcctttctggtcagagtgagttcgttcagggaatataagattcgacggactaacaaaccgtggggccctcagaagagaaattatgttcgactgattggtcagaattcagaaaccaaatcattcttctcacgctttgttctttcttctgtctgattgcttcctctttctcaaaggcggtgtgtgttttcaccatatccccgtagtggttttgacgattttgcacactgcaaaatatattcttgtgcctcctttgaaacaaagtaattttgtataatttatacgataatttgagttaattcacatgaaaaatcataagaattctccctgtgggtcctggatgcacatacagtgtgaaccagcttctcaacacccatgcacatcatcttcagttattattattattattaaaagttcattggtttgaccaagtcaaccctcatctctgggtcaaaaaagtcttctccgttgcatgcccaacaccacacacctactctttcgttttcctttccctcctggtggttttcctattaggattagttgggtcatttggggtctccacaagctagtagtactactagtactacctacaacaacaagtaggtgtaccgggctaccagcgacctagccataggataagagcaggtataaaagcaggctataagccaactataaacatattttaaagagataaaggaagagagaagagcagtgggctacatatctgtagccagctacagcacagactccaagacgtaatgtgtatatgacatgcggaaccttatattaatagtatagtaattaactagtgtatgaattagctattacattggctatagatgatttgagctaatagtaggctatactattaaacttgctctaaattatgtatagccaatataatagtcaattcatataatacttgcttactatactattaatacatagtcccacctgttatacacatattacgtcttggagtctgtgttgcagctgactgtagatatgtagcctgctactcttctctctcttcttttatttctttaaaatatctttatagctgacttatatagtatgccactgtatcttcctttatctttttaaaatatctttatagcttgtttatagtctgctatagtatctgctctaacgtgcttgactcgtgtgcacggccggaccggggggccaactagccaaagcccaaagtactcgcaaacacgcctctgctgtctgctctcctagtggttcgtttggtcctgggtgacgcagaggcgtcgccgtctgaatatctgtgagaagccgatagcagtagagcgcgtcggtaggaaatacgagtacgtggacacgcatgtggcgccaaacttgctgccgtgcggactgggggcgagaggggaacaaacggacgctggtttttcagggctgcatacggtgggcgggctgcctggcggctggatccgtgggtcaacagctgaaaaggctgcacgtgcacacgtgtgttctcacggtgcgcaaacgacgtgagcaataatagtgtgacggaagtgtaccagaaaaaggggaaattatgtgctgcaaatctccttatgtattgaagacttagaaaaactaccattagatcgaaaaatggatagtttaagattcgtttacattattatgagtaaaaattttactccgaataaatttgagtaaatctgcgagtaaaatttttcattcgtaatggcgtgaacaaatcttagaatgtagaaagagttttggggttgatcagttgatggatgtaaataaaatttgatttatattagggacctaaagtaaacctttttcccgatctttaattgtcctgtcctgcattgggcccataacggcccatatgttttccctgttttgcttcgttgttgcgagaactgcggtttctgaatcttggcatcatgccaagaaagggttcatgatcgttgcattccatgtactactactactgcatttgtatggagtaataacgagagttttggctttggtggatgcgtggtggatcagcgggcagcagcagcgacggcgagaggcggcggcggcgggaggagctgacgtgggcgcggcggcacgaggtggtggtgggcgtncncncnnnctnctgtncctgcccnangacccccacacgcccatcatccaccgcgacatcaaggccagcaacatcctcctcgacgaccgctgggtccccaagatcgccgacttcggcatggcccgcctcttcccggaggccggcgacggccgctcccacgtccagacccgcgtcgccggcaccaacggctacatggcccccgagtacctcatgcacggcgccctctccgccaaggccgacgtcttcagcttcggcgtcgtcgtcctcgagatcgtctccggccacaagaactcctccttcgtccctccccccgactccgacgccgacaacctcctcgatcacgtacgtcctctccatccatcatcttaatttctccatcgatcatcttaatttctctcttaaagttaatctgttttaagtctgatcaaatttatagaaaaaagtagtaatatttttaacctaagacaaatttattaagaaaatatattcaattattaatttgataaaattaatttagtattataaatattactatatttatcgttaaatttaaaacagacggagggagtactcatcaacttctcttcgatctctcattcatggcgatggatttgcttcgtgtgggcaggcgtggaggctgtacaagaaggggaggagcatcgagctgctcgacccggcggtgaagtcggcggcggcgacggagcaggtggagctgctggtgcggatcgggctgctgtgcgtgcaggccgacccgcggatgaggccggacatgaagcgggtggtgatcatcctgtccaagaagcagagcacgctggaggagccgacgcggccgggcgtccccgggtcgcggtaccggcggaggtcgtacggcacgcgcggcggcggcggcggctcccacttctccgtcgggtccacgtccgggaccagctcgccgtcgacgtccaccaccgcgtcgcacgccaccacgtcggccgcgtccaacgccatgacgacgacgacgtcgagcacccacaccatgcggagccaggggctccccttgcaccgggaagagagaggagtggaattgaagaaagatgatgaaagcggctgaactgtacatttgtccattgttttttcttttttgttcgctctctctcttgatttctttttcttctggtgattgttcgaagattttagagtagatagatcatagatggcaatattatttttatttttttgctacttgatagtgctgtagttcatagaatcgattggattattgtaggatgctgaagcgaaaacgatgatcgttgtgtgcatagagaattaatgcgagatagaatgttaaaggaaaaagaaaagacaatcgttcttgcatttacatttttgtgaacttcaggaaaatttgaaaaaaaaaatctacaatgaataagttcagaatttacaccccttcttttggatccagggttcaactttgtaaaacatatattgttgttttcatgaggtaggctgttgagaagtactccgtagaattttgcaatggagcatttttaatatattcatggaacataaggttgttcttttaccaacatgtactttatttccagatgagtagatttttcttaaaagctaagttttcagagctgaaacagtgtaactactgtatttatgcaacaatttttcccttctgggacaaaagtttaacttttagtttcttccaacatatttatgcactgtgcagcagttacattatgaatgtactgcactgttgcaacttgtcaagaaaactagttgacacgaaagagcaacattttcaaatagcttgatgaaacaagtggttttggagctctctagctccgaatcctccgtttggagccagaaaaaatcactgaagaaaggaatgcacttcgacctgtttagatgggattaaaacttttaagtgcctatcacatcggatgtttggacactaattataaatattaaacatagactattaataaaacccatccataatcttgaactaattcgcgagacgaatctcttaagcctaattaattcatgattagcctatatgatgctacagtaaacattatctaattatggattaattaagcttaaaaaatttatctcacgaattagcttttatttatgtaattagtttcgtaagtagtctatatttaatacactaaattaatgactaaatatacagactagagttaaatcactgaatccaaacatcaccttagctattattctcattgccaactcttggaattgggtgcacagaatgatctgtagcatgagttgggaacggatccgtaaagtctcgttcaccgacgggaattgcacagagtaactgcagtctgcagaggacatgcgtccgtagttcactgttggacttaaggtctgttcttttctccaataaaaattgaatgaagattaagattttcgtggcatgtttttaaaccgctaaacggtgcgtttcatacgaaaactttctatataaaaattactctaaaatatcatattaatcgattttttaagtttataataattaaaattcaatcaatcatacattaatacgttttacgtaaaaaaaaccttaatcttcatcttcatctttagaagaaaagaacgccaatcatcatcacttcgattcatgttcgacggagattgtccgcggttaccgctgttcagtagctgtagctgaaaggtgggcctcacacccctagccccacatattatttcatttcagttactccctccgtctcaaaatataatcatttttagaattcgacatagtttttgggatactattttgaccaacaatatctataaagttgaaatgctttaaataaaaagagttgcatatttaagggtggatgtcgagctggctcagctcgggttcggtctagctcgttaggataacgagctagcccggctcggttcgttaacctaacgagctaaaaaccccagctcagctcggctgtaagctcgagccagctcaactcagctcggctgtaagctcgactcagctcggctgtaagctcgagccagctcaactcagctcggctgtaagctcgactcagctcgtttagctcgcaagctggcacatgctgacgaaggtcgctttcctcctccatggcgagcgcaacggtgaaacggtttggatgaccaacagctgcatggtgcacacacaccaccagaagtagcaaaataaatcgggtgagatttattgagaagtgctggaagtctgaaactacaaaggcacacctgagcagaagaacgacggcaacggcgattgctaacatgtgggctgtggtgaagtcatcgtcctcagtgagcaacgagatcgacgaacaatcgaggctgtaacaccgtgctgcggtgctcggacctgggagcacaagatggtgcaacgacggagtgaaggctaggaaggagggagggcggaagcgcgaggatgcggctgccgacgaaggaggcgaggtgccgaggctgcggtagcggtgcgattcacaatggcgatgacggaggcgcaatgggattggggatcgatggattgattcaagagtaaatttaacagaactacatgttttatgattcaagttgcagaaaaccataaatattttgatacttggtacttaagtacatatattttggtagtttagtttcacaaaaccacactatcgatgaatggatttactcgtgagatgacgtggtcgtttcatctaggatgaacacgtggcatcctattaatttcgtgcgatggctggtaataggatgacatgtcctcatcctaatgaaacaatcacgtcatctcgcgggcaatccattcattgatagtgtggttctgtaaaactacactaccaaaatatatatacttaagtgccaagtgtcaaagtgtgtgtggttttctgtaacttggactacaaaacgtgtagttttgtgaaatttactcttgattcaatccagggacactagggttggaatattatgggctttggactttggagcgttttgagccttagagaaaaaacgtggacttcattgtggcctagttaagcctgccaatgggttggattggaatgggtctaatggattagttttcaatttggattcacttggtatgggtgtaaaggaaaaagtccacattgactcccttaaaagtacgccgaatctaattcataccccttaactagaaaaccgggtaggatgactcctccaactattaaaaccggtaaatttgacttcctcagcggttttagagatggttttgctgacatggcgctttgactcggtccaactggttgactcagcacgtgggacccacatgtcaatgtcacattttctttctcactttcttttctctttttttccctctttttctcccagaccgaaaatttcccctatgcctccgaacggcaccacaaaccgccgccgttcatggataccttcaaggacgccatcgatgctcttctccccgccgcgggaacccggccgatgacggatgcaggttacatatgtaattatagtacaaatatagtgtaattatgaaaattacatatgtaattatagtataaatatagtgtaattacgaaaattacattgtaattatgttacagttacatttgacagatttttaggctaattttcagtcgaatgttgtatagatagtcccttaagaaaatgcaacgagtcgagtcgagccgaacgagctaatgagccacgagcttttcgtccacccctacgtatattacgatagtttttgtttaatgacaaatctagtaacatccattttatatgtttgaacttttttatttgttggctattaatagttaaagttgtaaatgtttgacttaccactactgtaatcttttttaacgtgaacgtgtgtaggattgttgcacgttcagagaagcattacgcttaatttacaagcgaagcattgccaattaaaaatccacgctagctagcttgtgcgtgcaacaacatctttaccgatggacacacgttacatatatttccctcagtcaccaaacagttgtatggtcaacgacaccatcagccgtaaatcgatcggcaactgaaatgatacacgcgacaccaatatcatcgtctccacacaccaccaccacgcatgcatgcatgcaggagtgcacgcatggcgacctcgactactccctccgtttttaaatatttaacgccgttaatttatttaaatatatttaatcgtttattttatttaatttttttaaatatgtaaaactatatatataataaaaacatatttaataataagaaaaaaatatttttttatttttttaataagataaactgtcaaatatattaaaaaaattaacggtgttaaatatataggtacggagggagtacgtagacacgagctagcaagacaacaaggcaagcaatcaagcggcaccggcgccgccgtcgaccatcgccggccggccgccgacgcgatgatgatcaaaccttggcgaagcagagcttgacgacggcgcacttgaggaagcaggcgacgaaggtgggcgggctgacgatgtcggcgacgcaggtgcccgcgcacttgaccaggcacttctggcagttgctggggcagatggtggcggcgccgtcgccgccgtcgaggaggtcggcgaggtcctgatcgtcggcgaggcgcgtctccagctgctgcagcgtcgtcggcgtcgcgtcgtcgtcgtcctcgacgacgtgatcatccacgcgcgtggaggtggcggcggcggccgtcgtcgtgagctgcccggcggcgacggagagggcgaccatcaggcagaggacggcggcggccatcttaaccgcggcggaagtggaagccgccattgatggattgtaacttgggacgcgagaatgcagcaggggtgaggtgaagttgtagcttgtaagcgtggggaccgattggcttggctagttggcttacgaggaagtagggttcgctatatttatagagtgcacacatgacactgcatagacattgagggccgaaatattaagagcaggtacaatagcaggctataagccagctgtaaacatattttaaagagataaatgaggtgagagaagagcaacgggctacatatttgtagccagctatagcacggactcgaagacacattatgtgtatgacaggtgggaccaggtattaatagtgtagtatgtaactattgtatgaatgagctactagattggctatagatgaattggagctagtagttggctatactattagacttgctctaagtcgacagggacggagctagctaggtaggagagggggtgtcagaaatccggtcaagaattttttttttcattatatatgtactcctcaatctaaactcatacattcatatcagtctaaacttgatctaaactagagtaaagcaagcaagtggtatcgctctctatttcgttaaactagagtaaagcaagcaagtggtactgctctctattttgttttagcttcgcacctgtaagttgtatcatatattccgtatgtacgttggagagagagccaatttacaacttaatgaacgtgcactcatatatatttcgggcccggcatagaactattttgtccgaaatttttaacttttttaattcaaccagaatttggtcaaacccagtcaagatcttttcaaatttaataacaatttcgtccaagctagcccccgccgtaaatacgcaaaacgaaattgcataacctggcagtcatgtcttaataatggatcgagatcacctgcagttgtaatgtggactgcaactttagcagtccttgcgtgaccgtcagatcaaagaaaaacagctcagattcggccagaacactatagcacgcgtatatagtcctgtagcgccctgtagcatgtactgtagcgttggcagattggttatgacgtggcacagctatctgtcctttatcagcttgatccgatggttgtgaagggatgtgactgcctaacttgcagtcgctataacaactgcaccggatcttgattccagaataatatatgtaggaactaaaggggttaagagataagaagattaaatatgctgtaattttaatactacacatacttcaatatattgaagcatacttcataaaaaaattgcaactgtagtcattcaaaagacaaactagtagggagaagaaattacttggatgccccttgttaaacaagggagtggttggaagtgggaaagtagttgggcttaaaacaaggaaaaattaaatgacagaagtgctataattttttttactgaatttaaatgttagaattgcattctgtttggaacgaatgatgtacactggtttgatttttaaatttactatctccatcccaagtaagctcattttttactcatctcacacgtaccagtacaaaaccaataattctagaacacccctactttatcaaatctcaatacaactatttctcaatctatctactcccaatacaataattttctacttttataaactctgatgcaatgattaattactctaaaaataattattttatgataaatggaatgagctaaaaatgaacatattacggacggatgaagtagcaaaagaaaggaaattcgtgttgctttccatgtatcatagtcagtagcgcctggacagccccttatcccttagattgcaatccaatggtgatcactcttaccattactaattgaaatcgaagtccttaatttcttatataaaagtttgaacaataaattactcttatctaaacaagaaataattttacaatccacgataacttaccagtattacatgtaaaaatatgcaaacttagattaaaaatagactaaaaccatatacaacgacaaaattgcatagcactaccatgtgcaattcttggtgactgggaaattttcttgcgcctgaaagtagcaaaatcatcccatatatatactatagtctatgtatagtatgcacattacaatatcattaagatgcgcgtttatcccataaaccaaacatgtgaaataccaattaccgatgtgtttgacataataatgaagagggccctcttaccttgaagaagttatctttccttgaagagatggcattcacaaggtacgagcaattttatgttgttgttagtcactgcgaatattttgggttaaatggctaaaccctttgtctttactgttgtaaggaatgaccgaatattccctaaatatatgggaattatctaagagttcaataacctacatttatctttgaccatgtccttacaacaggagatggtaattgtgcactgaacattcatttcctcgttccagatccattttgtcttgcaatggctatatatgcaagagtaaatttcacattgaaccactttttatcaccaatggatcaccatttaatcaatgtttttgaattggataatcttacctttgtcccactttggactacctgactctcttctcaagcatatgaatgattttgagtacaccaacttctactcatcaatgaattcccacaattatattgagtctattgctttgatatataacaaattgatgcatatgaataaaatagttgagggtggtctaaaatgcaacaatgataaatttatcttgttgagagtggaaaatttgttaaagggtggtataaaacaaaataataataataataataataataataataataataataataataataataataataataataataataataataataataatatattacttcctccgtttcacaatgtaagtcattctagcatttcccacatttatattgatgttaatgaatctagatagatatatatgtctagattcattaacatcaatatgaacgtgagaaatgttagaatgacttgcattatgaaacggaggaagtatcctgtagggaatcatggtatctgttacggaggacctaatggaaatccatgaaatctggacgggtttacggttggaatattccgttggaaaagtaattgccaacggtatatagaatcaccgttggcgagttgacaaatccccgacacactcaatcccgaccgatgatcccccaccataaactatcggtcatagcatttccaatagttttgtaggattaccaacggtgatatttaccgtcggcaaagattgcatgtcagtagtgataataaaaggtaacctaaagtaaaatttactgttgtaaataaatgttcaatgcggagctccctcgcatgggccaggccaacatgtgtaaggtatttgggcctgagaaaagggacgattaataatcatgttgtgtaacattggcaatataaacaaagagattgaacgagctagctaaggttcaatctctagctaatcacacgcataagaaattagttaattaagaactgaatggacataactactctcgtttgagtacaaacatagataacatatagattagtacgagcaccagctcatctaggcatcaacatggcatgtaaaccttctattccaaaatataagatatccatagttatcatttatcaatatttataacatttgagcaatcattaaacaaataagtatatggggatgtttgattgaccacagtacaacatatatagaacacaagtgtagcttgcaacaagattaagtgcaattataccatcaactaaacgactgcctaataaaataaattgtgccataactaaaatttaacatggttacttgaggcattgttcgtatttgaatgttttttcatatgatgcaaattttatagttgttgatgatatataatgaaagaaattttgttgttgggtgagaggcactatagaaaaaaaatatttttatagccagagggcccatgcagacaatggcggaaatagcttgaagccacgcctaggctatcctatcctctcctctataaattcaatcattttttttaaaaaatatatatatgaaatttgtatggactttggatcccaggcctagggcttgagccctagctggcctagatccgccactgcataggcagattagggatgcgccggtagaagtggtggatctgccaaggtcttcatctcagcggtagctacaactagctaggcctcaaaaccaccaaatcattgcaacgatggccgtggcgagggcgcacgttgtctcggcaatggggacgacaaccacggtgagggattctacttggcagcggtgacaattactgtggcaagctcgtcgtcaaccagctatggcagattggcaggtgagctcatttgattggttttttactatgaaattgagatgatgtcgttggacagtttgtttcttgcaatctgtgtgaaattgagctggttattctattttggtttggtcagttttgcatgcatgattttcaaggccaggtttcagggttggatgaggaatttagcggttgacctaggtttttctttagcaccaaaaattatttttacaggtggatgcatggtgtaacttgccgcctacaaaacaactacttcctccgtttcatattataagtcgtttgacttttttctatttaaacttcttcaaactcgacaaagtttataggaaaaaagtattttcaacataaaatgaaaatattatcaaaatatatttaatgttagattcaatgaaactaatttgatattttaaatgttactaaattattctataaacttaatcaaacttagcaaagtttaactaggaaaaaagtcaaacgatttataatatgaaacagagaaagtattataatatgaaacagagaaagtattatgtatgtagttgcgcagcctcctatataaaagttatcgatcggttataataaggggttcatatacatgtccatctgtgaaaatccattatgtgcctaccgcaaaagctatttagcagtgagggagtacatataataacatgtatcggtaaaatgcgaaaactttgtaatataattaacgatcgatttattggactgatgtatatatgaacacacagattgacctaggagtttctcggtcatcgatcaagtacatatacgtggccagcgcgacaacaattggccgatatgatcgaaatcgataagacgataaccgagacacagccgacacacgacacaacatgatcctcccccagagacccatgatcagggacacatgcactaacgatgcatgtatgcatacatgaagcttggggaggttaattcgttattctttgcacacacacatatgattatattattattaggtgaaaacgaccgatcgatcgcgattgatgacgagccgagacgacgacgtgatcgattgatcgattaggcgccgaaggcgaagcacttgctggtggtgaagacgcaggcgaagaagcaggtggggaagcctttgattcccttggggaagcacttgatcccgcaggtggcgatgcacgtcttgcacttggtggtgctgcaggagcagccggctccgacggcgtcgccggcgccgtcgtcgaggagggcgagctcctcggcgagggccagggcctcctcctcctgcagctcgatgcggtccttgaggcgcagcagcgccgccgcgtcgtcgacggtgtccgggcgcgcggcggcggcggaggccatcagatgaccggcggacaggaggagcaggcagacgacggccatcttcaccacggcggaagccattgatgattaattacttagcttggtgggtgcggggtgtgtgtgctgcagtgtagtgcagttgcaatggtttgtgtgtgttggtgtgtggtgtagggaagaaaggatggtccgctatttatagagcgagatcgattgagggcgccagacgaagttgtattgtattgaattgtaggcaactaaaactgttactccctagctagctaggagtagtaaagcaagtactccctccatacacaaaagttacgcatattacttttgacatcaagaccaaggagaaattaaatcactttgaatgttacaaaatcaaggagtgaatgcaagtatgcaaccaatgagtatttagatgactttttaggttctaataaaacatttaatttatctcttcatttaagtcttgaatgcataaagactataaatatgaacaacttatttggaaaaactcaaatgtgaaatatgtgtaacttttgtggatggagagagagtatataatagcagcctataagctagcatatgtggagaagaaacgagcacacgtttattatcacaaaatcaattttcactggtgacaaaaatcagttttctcaggcagctggacacggctcgtcctcaagtgtccgaaaatgggttgttttcactcaacctgactgtaaaccgggggaggggggtgatgttcgtatagccgactagtctaactcggccgcctactataagtgattttcacaaacaggctagttagttaggacggtcgtctaggaaaatagtttttccaagcggtgtacctaaccgagccatctgcaaaaaaaaaaacttttattgcacatggccatgttagaccggccatctaggataaccaaaatttccataggtggctagcacttttagcaagtcacctgctgcggtggttatttgaatgctttttcaattgaaacttttcgattatttagttccatatgattataacaactactagcatatgtatacaacaaaaaataaacatatctatatttatatcgatgaatatttacatgtgtattccaattggattgcaaatggtcaatcttagattggattgaataataaaattagattacattagttctatttcccaccatctaaggactaaggataaaaatccttctatgcccctaaaagtttaaccaatcctttttatgcccccaagttttgtctactgttggatttgattcctttcatacctattccgttaattgacggttagttgaatgtttaattcataagaaaaggaccattttgcccttagacatgaaggaaacatggaaattataaactagctatattgttggaagtgtataattttgttatgtaagactattatattcatgattttattggacaatgtattattcacggcaaagttttttttcatgatgacataaaaattaatatttatttacttattaaaagagtatatgtagcatttttttatggtagttcaacatatctttttctgttgtatatattatataggaatgttttccaaaactatgtttatcatttaaaaaaatgctgcacatactattttaatatattaaattttttgtacaacaaacttatgaatattatagtcacacaacaaatttctatacttccaacaatttagtccacatatttctacatattcctcacatattgaagggtaaaattgacttttctacacatattaaacggtcaactgacgataagagtatgtaagggatccaaatcaaaatttaaaggtataccagggagtgaagaaaattcaagggtacagaagggatcgactaaaatttcagaggtatggaaggaattttctcctaattaagattttgtcaactgttgcagaacactctcattgttggaaaacgagctaaatctaatacaacaatcatattggaggaaagttccatatttcttagataaaagtttgaacggaaattactatttacaatccacaataacttacaaaaattacatgtaaaaacatgcaaactgagattaaaaatagactaaaaccatatacgtatgtacagtgacaaaattatatagcactacaatgtgtaattcttggtgactgaaaaattgcaaactttaatgcggctgaaagtagcaaatcatcccattatagccgaggcatagtatgcacattacaataccatcaaggcccgctttgaattagaggattgtcataagaattttgaaggtatcatattttttttcatacatattcccaaatcataatttgttattatcctcaataagccgtccctagacctgtataagagtcccgtatgtgcacccttccacgcttaattagtgaactattagagttctaatagtggtggatgattatgtatccctcctttatattattatttatactattggccttattaatcactaaacatgaatcgatatttcaaatcgcaatttgaatctcatattcacaaaaccgacacgttctttaaatagcaaatttggttattcgagtttcttaacaaggatatatgtactgtaatgaaagtataactgatgtcctgtaaaagtgaatgtaaagtactgtttggaattattgtgtatgaattcagttacatgtcacaacaatatattattaaaaatctataaataataacaatgtttaacaatccagtccatgccatatacactattttgtaagaaaaaaactgaaacaaagacatacaattaaacgaaaattgcaattcccaaactactactactactactactaccacgagaattcaacgcattgtaatgtccatgaattaaattcaaggcataaatatatgataaatcaaatcaaatctgaaatttagcattgtaatgtgcatctgaattaaacgaatattccagcatgggtgcattaagaaaatatctaatttgggctaaaaaaattcgagtataggacaatttattataaactattcttcctatacaggaaccagcagtttattaatttaaaaatcctgctaattgaaggatggatgtttaaacaaattactatgcctaagaaattaaaggattaactagaatgatgagcacgtgccctagtgttgaaaagttcatgcatgtgtcaacttgtaattaaaattcagcacgtacatgtatattgaaatggagggatgcgacaattaaattatatatataccaagtatattaagcctagcagtcatcttgatagtagatagttcaatatatatagtagtactgactactacccagctatgcatactattttgtctacgaaacttattaagctgactgttcttttttttttgaaaaaa

SEQ ID NO: 41574 - DNA, 4688 bp, Oryza sativa
attcctgcagccccaatttactaattcttttaaaaaaatattttaaattttctatccactaattatttactatcataaagcacacatcatacaaaaaaaaatatttaatatatagcaagctctctaatcagccaactataatcaaatttcatgcatgcaccctccattctcaaagggcataatggacatttctaagcaaattaacatctagactaacagagacttgacgggaggggtatgcaagggttccaaacaaattttcaagggcacacaagggattcagtatttttcaggtgcatagaagggactgagagagttttgaggtgtacacaaggaattttctctaactttatagtaagataggataagagcataatctgtatttattctctattcatccactatgtttgttactttaataggcatttattatttacaactcactagatgatgccccgcctttagtgcgggatatatgttagatattggagaaatgatgaaatgatttgggttgaaatattatgaaaataatatgagaatgatgatttagcatgtgtatgtttagttttagaattaaataaattgtacacataattactatatgcttgcatgttgagctttgtgtgtttaatgggttgatgtggcatgcttgcatataggttttaggagtgctaataaatactatgcttgtatattgagctttattaggtacttagtgagcattagctttatacaaaaaagaagagattaaggtgtcttctatgtatggtttggatatgtagtatatgtttttttagagctagtgtttttcgtgtgtaatttgttcctttaatatcctattttactataaagttgcaacccactaacgtcacatcatcaccactaacagttattacaacttaaatatcatacaagaatgatatattatctataattttctataatttatttaattttagagctttaaaatgcaagcacgttaaatcatcataacacataattcacataatatttcaaagatgctatttcaatatatctctccatcatactgcctctgtttcaggttataagactttctagcatttcctacatttatatagatgttaatgaatctagacacacatatatatctagattcataacatatatatgaatatgggcaatactagaaagtcttataatatgaaacggaggaagtattttattgtatcttatatacctacatagtccatccttacatagttaacatcatttctctcttctctcgttaaatcatgtcacaccaattttttaagcccttagatgattaatctataatctaaattatcttcctcattttcttctctcattaagccatatcaccttaattatttttagcccttgaaattatctatggtccaaattacctccctaatcttcttctctcgtaaagccacgttaccttaacatttgaatcatcattctatatacttcctccgtttcatattaagattttctagcattgcccacatttatatagatgttaataaatctaggcatacatattaaaatcttataacctgaaacggaggtagtactatttaaattatcataaatcatattaaaacttatgattcattatactagaatatatcacatccagtctaagatttgtttttttatgggacatggtgaggaggtgttttcttcgtgtacactgaaaagaaatgcatgagatgtaagtttattgtacctcataaaccatattcatttaaactcaaaacgtaatgtaaatgggaaatgtataaatgccgaacctaattacaatgctaaaaaccgtccgtataaatcacatcacgatcaaaagggtggttacaactcatccaaatcccaagacgtactatatctccaacaatactacgacagctacaacaatgaaatgcgaagaatgttaactgcacactatagatacaaaaatcagaacaacgttgggacacaggaagcgccgtttagccaaacggggaaggcacaggtccagcaagtgcgtcagatctcttgatgctccccataccacagatgacacaccctggtgcagaaagagcggagaatttggcaccacagagatcgcaaacatcatgaccgatggttgagaggcggctgagggtgacggcgcagaactgagaggggtcttcgaatgggtcgatagatttgtttgtcagccccctctggacacacatgtcgatcagactcttgagctcatcctgcttcgatgggggcgccttggaatataggagatcgagcatttgcttggcataggcaaagttctggacctccatgtttcgcttgatggcagttctgatgcagttaatccggtgcttagcttggataggtagggaagcaaggtggcgagatagcctggccatttcctcctttgcactgagcgcaccagctccttgaaccctttgtaggcgagcaatttcctgcgcaaatcaatagaattaagcaatggatacttaaaccagttccatgagaataattgttcttttaagaccagttgtttcactgactaccatgacgatagagatggaatttttattattctcgagttcaccaaaagaataaaagaagtattgcctagagttcaacatatatttaatcaaagttgtcagaattgaaacatttctaccagataggaaatgatgagctgcaggatatggtacaaaaactagcagaaaattcaccttaggacacacagtgaaaccaataaataactcttaggatatcatgacaaaaattgtgttgttatgaggtatatcatgacaaaaatgaatattacctgtagcaaagcaacagctatcttatactgtgcacaaatagtggcctgcgctttgatatcagcttcacgtgactggtcctttgcaagggccaagaatgcttcatccaaacaagataaagcatccgtaagctgattttgctcaagatgagcaagacccatcttgtagcactctgctgcaggagcaccacgtggaacctgtaatcatcaatggtagtgtcaaagaaagctatggaataacatcaattttgtttaaaatgaaaaatagcaacttaagcacctgtccaggccgcacagcagtaggtgcaggggggcgaggagcctgctttccctgtcctggaccttcaagagcactaagatcaattggttgcgacatggcaggaatagcaggttgaaagccatgtggctgtggaggaagagcctggggttgcgagggaagaggttggctctgtgggggaacaccaccatcaggtagactaatagggtccataggcatgcctggttgctgaggaaactgtgcctgttgcatcggtgcctgtggtgggaccccaccatctggaagaccaacattagccatcatgttttgattatggacaggccgaactgcactcattccaggagcaggttgagcaattcgtgacagaattattcccggtgggggtagtcgagctgcaagctgctgcgatggaatagtattctggaagaaatcctcaggaataggtccagccgtcactcccatgccaccaattacaggacctgtggctccactggaagcttgtggttctactaaagcattggtaccaaatagatcaactgcagcatttggaattgctggaccagcaggtggtgcgagacctggcggctgcataggagcctggttcaactcttgaggcgtccctgataacgatcttgtcctagtgattggaggacctaaacctagctgtttagtggcttctttcagtttgttaacatcaacagtagatgcagcaggcttatcacgtatcctgatgtgtatctttttagtctttgatgtagactcatcttcatcactacttccaccatcaacaacaccatataaagtctttttgaactcctctgctgcttttgcctgttcatctgcagaagcaatttggacccctagctgcctggccagagtatcaccaactgaatcacccccagcatttgccacattcttctgtgttgattcagaagatgctggtctcgcattatcgccactggctgctgcaatagctttaaccaagctcttttcacttacttccactacggtacctcggcctttcatcacgcccaagtaaacaccaatatgatctgcagtgacagatggaataccagcatcggtagtcttcatgtagggcatgacctctcctgcaagctcccactgaggtatactcttcatgttcgtaggtgttttgatttcccagtttcctcctgcccattccggacctttaggcaccatactttctgcagcaaaatttgcaaagacaccttgtgtccatccagttgaacgaactcttagtattctctcaaggtaacgcctcaactcagaatctgtagcagattcttccagcttctgtgaaaggcgtcgcaatgcactaggattcaggtggcatataaacagatctagcatgctctcatgatcagaaataacctcgaatgtttcttttgcactgtcaaactgaccatacctgtagagtttcaatctcattgaaattagaaaaagtaaaaaaaaaaaaaacatattgtatacagaagtaattagctcaacagtattactggccaaaatgacaattgcttgtcacggctcagaatcatgctggaatcattattcatcagcagcacgcacacataacctctt

SEQ ID NO: 41575 - DNA, 1472 bp, Oryza sativa
atagatccaactcagtaaaggagcaatattgttatagattaaaccagagtaaaattgggtattacaaagtactgtaattacagatccaactcagtaaaggttttcaaactttggttctggttattctgaagttcagaattttggagcacgcctgaggtccaaaactccaaattactttggaggacaaaatttgaaatgcatctaaactatttcagtatttggttgagatcaatatgttgtcctggatgaaagtcatgacccttgtaaagcatagagaaattatttaatcaaaatcatttcaaacaaatatttgcagttgagacatcaggacaagatggtatcctgtttcagaaaaaaaaatagagagcatagttgaccatactttatgcatgcatatcccaactcccggaaacgctggaacagatgagaagttggagggcattgaggataatctctggaacgcaggaactcatctttcaagatcgaaagagcagtagagaaccggagggctttgattgcgtaattgcaccgcatgatctaaacaatatggaagaaagtattagatcaagcaaaagagaacaaaaggatgattatgagcacagattaagcttacttgggtaaactgagggcctgcttgggatagtgatacagcaagatctccacaaacagggggtcctttagctaatatgtccagtgaccttggagtgacacgtaaactatcaaacctgtataaacgcaaaccaatacaagcatcagaatatgatgatccatctattaacccttctgcagtaggtaggaagaaacaacatgctttgaagaaaaagaataataaaatggtgacaagaagccagagcatgatgatcattttgtcacaaggtgcaaagctcaaggaactgcatagccagttctccatgaagatcaagtgattcctctaaatgatctatcaaaggaatttttccacaaagagatgtgcatccaaattgaataaaacggtgtattgaagcttaaactatagccaagagtttgaatgaagcatgcagtgtatttatttatgagagaaatctcgtcatgcttcctatcaaacttcaatctgtgattcataacttcttggcttcctgcaggtcataagcatattgaattaagttgtacgacttcaatgacaaagctgagaatgaaaaatgattttgctcggagtgaagctgatgagggtgaggacaatatattctaatacacgatgcaaaacctgatcatttgctggaagatctaatgcagcagcagcactaacaaatgcagatgaaactgagaatatgaagacttgtactaatcgagtaatgcactgaaatactgaatatcatattttgctgtctagatactgtgtaaagagccttgataattgcgactaggttgttcaatgtatcaattacaagatcttctttgtaaaagacaaaatcactaactcgggctgcaggaat

SEQ ID NO: 41576 - DNA, 14184 bp, Oryza sativa
  unsure (1)..(14184): unsure at all n locations
aactcaacaggtatggcgtacaaaaaactagctgaatggaaggttttattggtagtacaggggtgaacaggtagagaagaaaagagttcaggactacaagttttctggctacaagttttccataaactgcagaaaatatgatgcaacagctgctaacaaaaagagcacatacactgtgaagaaaagccttccttgcaatgtctgaaatagttagctgactctggctgacaaaaggaaaacaaatgaaatcaaagttaaaccatcaataaaattttcatgacattaatcaagaatgtatcttgacatagtcaaaaatttctaagccaaaaaagattcgaattttaccccttcaagtgctgctcttgcagctgagcctggagctggtgctcagctaaaattccagatgaacccagggctaaaagtttctccttcagaacagcagctgcaataccaaaaacaaattttaaaggatgtatgggctgctcaaatataatcgtttgttaataatatatataccaattatgctatatgaaatcataatcaagagtgacataattaccctgctagaattgttcaaagttcaaattaaggaaaagcaaataaaattcctcttccattttcaaccaatggtcacatgaactaaataagaattttgaatatatacaacaaagtaagaacgaacaatcatttacttaccagtcgatcccctggctccctgaagaacagcaaaaagttgtctcctcccttctcttgtgtatgcagccttgttctttgcagcttctgtcccagacatatcctgcaagtcaaatataaactgtttctataattactgccattaagtaccaaacttatatatggcctggagttaatgcgacctaactgcaaaaattactgcagccaaattaaacttggggtgcactgccaagtttcttattcgaggtaaagggtacactgcttctccaccttgaagagtgagtatcttcgtgatatccattgtttcaatagctgcatagttaaaacagaaacagttgtaaaacttattctcagaagaaaaaaaggtagaatatgcaatcggcaagtaacactgctaaataaacaagatcttgtgtgatcagcatatgaaataaaatagcttagaagctagtatgctattagcccatgacgcagatggcaaacatcaaatggaggttgcacttacaccaacaccaggaggccacagcagcaggggccaaaccaacccaactcagatataagctgattatttttatttgtttgttatctccttaattaggtaactagagaaaagattggtttgaatcagacattttttggcattgcctatctgtcttctctaatgctcccatgtgtgctcttcccccatgttttgcttttcccctgcagcaccactttctcctgaagtcccaacacattcaggtccaaccagtaagacccagggccaaagaagtccactaaacatggcagcccattctgttgcaatccccaggatgtggcataaaatcaaccaggtacatattaaccagggaaatagcaattgaatctgaattataagggaggaaagcagcttgagaagaaaagcataagtagcatggaaacaaactaacctgcatgctcaaagaaatgagtttccataggttgtctgttaggattaattataactcgtgttttccatacttgaagtgccccatcctttgaaattgtaacaagtaaccgtagtgtcggaagccaggaaacagatgtgataggctgggaaccagcctgtgtactgagtagaagtaaaagacacaaatcagataatatgaaacaggaaaaataaaagaggtaaaagacaagcagaagtgcagaaccagaacaatcaaaagtacatggaatagtatccatccaaacagagacatacaaagagttattaagttagctgcactaaggctgagttctttcaccaaatttcccaactcacctccctcgtttccgcacgcacgcttttcaaactgctaaagggtttgttttttgcaaaagttttctatacaaaagttgctttaaaaaatcatattaatccatttttcaaaaaaaatagtaaatacttaattaatcataagaaaatgcgtcgctccgttttgcgtgcgcggaaggtgagttcccaacctcacctcccgaacacagcctaagaatatgtgttctaacatttctcaatcaaattcgtgccaaggaattgcaagtataatatcaaaacttatattgaaggtacatcaaaatagatctgcaggctaatgtatcctatgggggcacaggaccacactgaaactttggtcccaagacagtgcctaaagcccattagacctattttgattaaataataaaaaaagggaggtagcccctcgaatgcttgtgcacatagtcaacagtcaacactgtgaaactttaatcgagatatttaactatttgccactcttagaagtggcatttaacaatttgctacctggactctacatgtcatagacacatgagggcccatatgtcatagacatatgagtggcaagttattaaaagccacatcgaaactgttaaatgcgccccactggtgcttcaagcaactcaatgcctcacctcaaagtatttccaacaattaaaaccttactggcttgtccagataatgaatatcaaaataatagaatacattggaaaagaaagaaacaaaggaaaatggtcttgtttttacaacctgaacaatatataatgtaaaaatatacttacattccaatcatacttggtctctccgttgatacatcccatgccaagagagtgccacctctatcaccaataaatatccactctagggttggatgaaatccaaaagcacccgctccgacaagcttaattgtactgtcaacagcaactaaggaaagtacaatctaagagtcatacaaaaggctaaacatacttaaatatatgaaaataaagtactgcatcttacgttgcaaggtgtagtgaacaacatatgtctggatgttataagcgcgtatcaatccttcagcgtaagctacatactgaaattataattttgcacatcaacatatgacaaatacagatacacaacaacaagacaaccttgtgtaggactgcagtgcaatcaccagccaaaaggtaaagctctgattgtatttaccaggacaggaaggcgaggatggcaagccaggttaacaacaggctttttaagatcagtctttatttttgttggcggcctccctccttcaacagtcccaacaactggaagagaggaaaatacatagttgttagcataaataagtgaaacttttaaaagtatagtcaaatagaggaccatttaagcctcagaagcaaaaaagagagagagagagagagagagactaagtaacgaggaataacctgtcacactcattcttttgtgaaaaccgaaaaatacaataggctcaagaggtgtcaatgcaagatgaacttccgtgtctattgaaacatgatcggtttttttctctggtgagtgcagcacaagcgtctgctcagtggcaaaatcacaggatctgattgtagcatcctgaacaagatatataaaggaacaaaatacatgagttattaacataaattgaaagctaaacatatccagactacagcatcacatgaactaagaatatgatataaaataatgttctcattggaataaaatatcattgaacactatactggaagctcataatgaaaaatccacaagaccatgcttactgatgaagctgaaccattataaactttctacacctaacatcggaagcactaaggccaatatttcagtgctaggtgataaaaagtgttttgtattttcatatagtgaaatattcaaacctacctcaagaatagcaatgacaatgtgactagcagtagggctatatgccatacgaacaacacgagctccaaggtcaatcgaagctatcttgcttccagtcaatgcatcaaattctgcaaacaaatgagaagatgtggataataaagaagacaacaatgcatcatatgcaagaaaataacaactaactacagtagcctttattgtgttaatactactctgtaccacaatcaccttttacaagaataagtaatttggtcaaataatgaaagcagcaagtaggtgatttttccagcaaaaagtacataaagggatgaaatgaatcaatgagttcatactgacatttcaataattatgtcatgaagtggagcatggtgcaatgtattggaaatttaggaacaaataatctactggtactatttttcagaacaatcataagctagacaattgctattactccacagataccatgactacatagcacagcaactaaactctgaaaggactcttgcacagcatttcaagccaacagtgtttcaataccaacatttccactcatcaaactattattacttacagcaactatgtaagtgatctgcagactaacgactccattattaccggctcattatactcttgaagaaaggtggacggtggacatgctaaatcaacacgaattcacacagatatctatagaaatgctcaattgctcatcaaggtcaaatcggcactactgttagccactgagatcatcccagctgcacagtaacagcgacactagtgcagaattctaactccacttccattcctaccaccccacccacccagggcgaatcaaactccagcgccctcctcctcctcagagcggcaccagactcaactcccccacggagctccaccctccccccaccctgcctacaaactcctcgacccccgaaccagtcgagacgggcggagccacacacacgtaccgacgacgtgcgtgccgatggcgacggcgacgatggcctgcgacgcgcggaaggcggcagcgtgcggctgcagcgggcgggcggaggccccccggcggccccccgcgtggcggagatccaggtgctgcaccgtcgcccactccatcgccggcggcggcggatctgggcgctccggcgtcagatctggtggggcgggtgatcgccggtcggtggatttgtgctggggaggcagtggcccggcaggctggactagcttcgaagaggagacgatctgaagcatccaacaagggggaggttgcagatccggcccgttaaggctcactttgccaggtgggcctagaatcctcgatacaacagttggtttgtctgacaggtgggacacgtactcaattagattgtgcctatctcaaaaaaaaaaatagattgtgccaaattgtcaatgacaggtgggccaagattacatttggactaatacacaagcacgattgatttttatttcccctagtaacatcattagctggttggggcatcttagcattaagcattaaaaaaaagctatgtggtgagagaaactacgtaaaagttaagttcatatagaggattgtcaggggtgggcattcggttaagaccgaaacttcggtccgggtagttcggtcttttagaaaattggttattgagaaaggaaaaccgaagtgcttagtaaaaaatcgtggaccgatagatcaggtaaccgaacttttagtccggtcttcggtatccaccgatttgaccgaacacggaaggatcggagaggcaggcggcgcatcgaggcgtagactggtgacgagggaagcgtcagggctagtggcgagagcgacggcatcggaactatcgctgcaggatctcgttcccacctccggcgacctcatcgacccgactgtcgattccgttctctccgcatcgtgccctcctagcctcccctgcgtggctgacagagctcaccgccccgccaccgacggcgccccctccacagacaatagaatgagaggatgggagggagagaaagaaacgaagagtgctcgccggcaggatctagtccacatcttcactgatctcacgatagtgcaacagtcggggatcagaagatgggcgatacggtgataggtggcgctgtggcggtcgtcataacgagtggcagctaggttagggttgtacctgtagcactagatggggatgagtgatagtagactattgtggtagacttgttgggcttaacctctcgttgagtggatgtgctgagagtattggcccaagaccaagatcggtctgattgggtaactgaggaataagactgaagcctgacaaaaggattggtcttttgaaacacatgaccgatcaagagaccgatgatcgatagatcggtttcttcggtctcgatttcggtttttccagtctcggtcttcgatctcagttttttatgcccacccctaaggatcgatgagagatgatacgcatgactaagtgatactgatcaaaacaacgaactcaagagcaaagagcttgatagcgacacagtgagagaggcaagctcattaatgggggtggaagcttcaaactcgagagcgaagacctgttcgaaggtagcttggcgtcttctatagtccatatgactcaaaggatttcgatcaagccatctactaatccatatggccagatttggttgttgaacctatgccaacaacaacttgttgttggtgcatggactacacaccaagattttgtcgtggctccgatcgggggctggccaagaccaagctcttagatgaccagcgctagcaagtaaataacaaacggatgggagtgagatgaggatgaccacgggaagaagacaatagtgtaggcatcggtgcagggaaaaatgaatcaaaaaattgataaaagtaaatttagtggagttcgtggctatagctagctactgtacatataccatgcaggatttgtcttaccctatgagtttgccgaaaaccaacgaaaattgatgaaaactaataacttttgtatggatatcagctaaaaccgctcggttttcacaaaccaattcctagcgccacaagcggttttcatgaaaaccgattgaaaatgtaaacccacgtgccatctattggttacctcccaccgacgtatgttttttttacagccggtgccattaaacttgctctaagcaaagataatacgtctagtgggttttcttgtttcgactcaggcctctttgttaggattagcttaggcccttagtttaaaggtgacttatcggctttgtggtttagttagtactagtgtatgtgcaacatatgtatagataatacgaattaaatcaaacatatttcatgcaactaatacctatgtttgacatattataataggacaacatttttatcatgttacaaactatattaataatggtaatataaaatactaatctgaagccctagattttcttttatgaaattaaattccaagtaaacataatacgttactaaaataccaacctagttcttatttttctccatcgatggaacccatagatatctatcagcatcatcttttcccttataattatgctaattagccaaaatttgaattttctaccttaaatatggagttgattttagggtttttgtcatcgtagtttattttttggtctttacttttagatcattaactatcagcatcatcttttcccttatgcttatgctaattagccaaaatttgaattttctaccttaaatatggagttgattttagggtttttgtcatcgtagtttatttttcagtctttgcttttagatcattaagaacatgtatataaaaattttattcataaattatttttcatttgcaaatacgttgtttcattttttttcctcaaatatcctaaatgataggcctgtatgtatcctatatggttgggcccaaaagcttgacatgcattgagccacaccatctagaaaatagtagcatttggatcattctcatggtttgatctaaaccattcatttaccatatgcatttatagcccacttaatgtagttattggcatttaatgtgtatcgaaccatgacacctagaaaactaatagtcattggattgctcttatgcttgatacataacaatcaaagtgtcatgtagaattgcaatttcacatcaactactacaaaacaaatattgtccatttagatattacgtgtgtgtttggttgcaaaccacactttgccacacataaggttaggaaaaaatgataggtgtttggttgtagccacaattgtggcaagattctcttctaacaatttgggtcccacttgtcaatgactcaagaaagtgtggcaagattcttttaggcttagtaagttgtggctaagaatttgatcacctcaccttacacaaggtgtggcaacttttattggcaagtaatgacaaaatgtggccaccaaacagcccttacgtgtgcacgatttacatattgttttctttgagttttctttgaaatatttttaaattttccgctgcaacatgcaggttatccactagtatctctaaattagtccaacaaagaatttgtgaggcgcacaaaattattgtgtttactagtatataccttaaccgtgcccgcttgagtttgttaagtgcaaaaggcttcaaaactaataccttagcctacatcatatttttctattcattgcaacaaactcatcactttttaagatctaaagccatcactcgaggtacctgcatatatttaggcaacaagatttttatcaatatttgtaagaaaatcgtcaagtgtttagaaactcagagaagagcatataaacttatatacttttttcaagatagtttttgctcttggacaagacaaacttgtagccatcatgctcatgtcactagatttggctcctgcagccatgtgtatggcattcataatactaagaaaggaatattgttacaaaggctaccttaggatgtgttctttagcctagttttccaacttcacctactcgttttgcttcccaaattgctaaacaatgagtttttgcaaaaaaaaaatagaaaagttgtttttagggaaaaaatcatattattctatttttaaagttttttgctaatacttaattaatcacgtgctaaaacgtcctttgttttgcgtgcaatgttggaagtgttcccaactccacctagggaacacagttataattttagcatagccaaaagcttgatactacctttgaggacttatgtaaatcaatagaatatattaaatacgctggttacaaagttggtgctggaaataaagcttaaaacataaattaaatagagacacaacaatactaactaatccctccgttttaaatataagcacttctagcatttgaaagctactcatgtaacaccgatttaatcaaataaacatgcatcattgatagtcgcatggacatgctcatcaatatctttgtaaacctttattattatgatatttccaaatattctgaatcgttggaatatggatcatctcatagagtcaagaatcgccacacacacaagtgaataaagcttagggtttagcaccgattgaaatttgttcatgatagttgctaccttggagtagcgaaggaagatacatttcaatgtcttatgttttagagaaagaagctattgcaggacaaatccgaaacaagtttgtagtggtaggggcagctcctgggtaggtcggggcgattgcccaagcttcgccacagccgcctccattactgattgtggttaataagtataaagtttggtcgaccgccatgaaacactattaattgtccgggttcaacgatgatgctggctctatcattgcaagtttttttttatcatcaacttattttacttgtagtatatgaattgaaaaaattattttggtttagtgcttaaattaacagtattaaccttttcatgaagcaaaaatgtcaggagaacaaagttcaaataattatcaaagcatagatatggcccctttgaatcgaaagaatgtaaaaatgtagaaataggaaaacgtaggattcatctcattcatacaagtgtaaaacggatgatcacaaaataaaaaaagaacgtataaataaccatttgattggatcccagaaaacgtgaatcggacaagagatataggctcaaaggaccttttgctaactatcttctaaaatccctatagaattaacaattctatagaattattttcatacgattgaagtccttcgaatttctttcccttttcctagaaaatcaaaggccgtttaactttgtgcgacgaacctggcataccggcctggcccgacgaaacccacaaagaagaaccgacatccccatccgggcccaaaccccgtctccgtccacacgcacggcacggcgatcctcacggcctaaccgtcgctccatcctcgcccacctctcctccttccccaaaccctagaatctcgccgcgcgggcgcagctccgcccttcgctcgccgtcatttcccggcttccccgcgcaggggctagctagctagctagctagggttccggcgcacgacgacgatggccgcggacgatctctcatccccggcgcggaagcgcggccgcgacgaggaggaggaggaggaggaggaggtcatcgacggggaggccgcccagaagcgcgcgcgcggggaggatccggagggcggggcgctgctggggctcgccaactacgaggaggacgaggaggacgaggaggcggcggctgctgcggggaggcgccgcgcgaatggccgacacgaggaagaggaggaggaggacgacgacgacgacgaggttgacaacgacgtgaggagggctccggagcggaggccgaggcaagtggagctgcgccgggactgcccttacctcgacaccgtgaaccgccaggtatggcttttagcagcagcagcgtttcaggtgccaattttttagacattctgtgtgattcgattgatgtgaataacctcgatgaaatatagtttttcattatgttcacgatctccaatttacttgggatccaccatttacgcctagtattttgattatcaattgctggtattgtgatagaagttcctttttttgtgtgtatgtttgatttaatagagctgaacaacatatacagatgctaaagggaaacttaatgttcatggtgttattatatcttcatagtgaattccaattgattttatttttgttgtagtgtgcaacatgtgagcctgttcatttgaagtaatatattatttttttgtcatatgtctgtcttggtactttatcttttttttttttttgttcgagagcactgttctactgctactctactgtgtacattactataataactgaacggaacatatttatcaaataattatgtttagttcttccttgctctggtggctattgggtttatgggtgtattgggttgaacgctggtccattccactatggactgtttcttaactgagacacggtcccttaggacatatcagaaagcctcttatgtttgctgcaattttaaaaagaactgtaggcttttcccttcaagttcttatccgttcaacttgtgtatccctttatttcctcgttctcactggccggtacataaaagctttaattaaactaaacagtatcttgtgagctgtggttggcttttttctaaaatagatccttaaaatagctttaaactaaacaattgtaagctcttgtaggatctttaaatctatccttctgttttagatggccagtgtgatgtgattgtttgtacaattaaaatctatggaatcacttccacgctatattctatatatgttttacactcttctggcagaatgtgtgctggactgtatcattgatgggctatttcacatgttcattgattgttgtatatattttgtctacattgtaggtccttgattttgattttgagaagttctgctcaatctccttatcaaacttgaacgtgtatgcatgtttggtttgtggaaagtattaccaaggaagaggcttgaaatcacatgcatatactcacagccttgaagcaggccaccatgtgttcattaaccttcaaactgagaaagcttactgtcttcctgatggatatgagataaatgatccatcattggaagatattcgacatgttctcaacccaaggtgcttttctatcgtcgcccatgttaactctagtaatgagctcagagctatgcagttttttgattggtgtgctttggcaggtttacaacagagcaggttcgtaatcttgataggaacaagcagtggtctagagctcttgatggctccaattatctacctggaatggtatgtatacgtgaaactaatacaatggttcttaaatgtataaatgattcttttcctagggacataacctgtttgctgttccctgttaattaagggaattctttgcagttgtagcaaaaaaaaaaatgtatccctccctaaaacaagggttttgtttagttggtctatctggagaaattacaaaaatgaaaaagcatcttctggaaaaaaatcacaatgacagtgaaagcctaaaaaattgtggacttgaatagaagcagccaacttggtcatgagctttttttagccaggttatttcattctatattaagttattattataatggtgttatatgaccatcaccatgtcacaacttaaaaacattgcagatttcctattgcacctcaatatttgcaattctctctgctttgaccattattatcctatggcagtagtcacttctctatgcttaaatttgcaggttggtctaaacaacatcaaggagacagattttgtgaatgtcacaatacagtcattaatgagaattactcctttaagaaatttctttctcatccctgaaaattatcggcatagcaaatccccattggttcatcgatttggagaactaactcgcaaaatctggcatgcaaggaacttcaagggccaggttggttttttagtgagatagctgcatgccagcatatttgtgctgttcctctacctccacaaatactcaaaagttaacatgttgctttttgtgcaggttagtccacatgagtttctgcaagcagttatgaaggccagtgataagaggttccagattggtgttcagtctgatccagtggaatttatgtcatggctcttgaacacaatgcactcgaaactaaaaagtaggaagagaaacagaagcatcatacatgattgctttcaggtatagtttttgtctataccaacaatttgattaataaaattgcgtgcaacttcttacagcattgtttttgttagggagaacttgaagtagttaaggaatttcacaagaagcatattgtggaaaagaaagaggacggcgatgaacagaatggtgatgcaggttcagatattgttactgaaacatctagggtcccatttttgatgcttggccttgacctaccacctccacctcttttcaaggacgccatggagaaaaatatcattccacaggtttgttatatcccaaatatatatattagtatcttctggttaaaatttcgcagcacacgttttgcatgtataagtgatactagtatgatgatgttcggtgaggttcttttgatgataatgtgaaaaccaactaaatgattattacagtttgctcagaactttgatagcagtaaaggcttaactctgcagcatgagtcgtaagaattatttggacaatcttctcaagatttctgttactgtaacatttatttgaaaccacctttttgttatataaaatttcctgcttagaactgcaaacctgacctcattttcttttcccttttttggcttatgttcttatagacgtagatagttgcacaacttagccgtcttataagttcattttctttatccgttttgtatatttgcatgtgtctgcatgttaacactttgaccattccatttacttggtggagtggaaccatattgggtgaggcgatatatttgaaatcttgacattcaacttttatgttttttgaactctaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41577 - DNA, 8660 bp, Oryza sativa
taatatatatttgagtagctggttttatgatttacaaaaaagataatgagctaaataaggtgaatgtagcacacaagtttcataccaaactacagcaattgtttggaaggagcaagacattggtcttgaatgcctgaaatctattttgatgctaaatactaaacaatcacaaaactatttaacaccgttccattgcccccaacaagtacactcaagtttgtagttcaacatatggtgaaaaaagtatctggggccactggaaagctaagacaaagccaaaatttgtttatgcgaaaagatactaaaactgccatataacaacttctaaagcccaaataacagcagctcgcacatgattaacttttgcaatttggctggcttgttttatatcaggacagccataatcttatatatgtagcacaattcataatagtatcgcaatgatgccaacgcgaaatcatagtccccattgagttcagaatgttagcttcagattttcagttgtaagtcatatcacaaatttacaatcatttgcaaatggtaaccattacacttactgctgagagacgaaaaccataaaagcagagtaaaatgaacaccaatgttatcccaaacaatgataacataagcaatcaatctgtatgtacaccacaaatactaccacattgaaagtaacaacataggagtatgcaatcccataatcactccaacattgggtaaaaatgtaaaatataccaccagccgcaagttcaaacctcacaagggccatcgaatcagtcattcatcgatgattgaacaatgtgaacaaaaagtatcctaccccaaataacaagcaatctctgaatcattttgacaaattagctatcaaaatcaaaagttcagaaaaaaaaatgtatcacatacatctaaatgcaattcagaaatggacaaaagcaatcgaagcattggctcacctcggcctgcatccccgcgtggcgcctgacgcccgtggcgtcatacatgactatcaatgtgaacccgaggcagacagggaagagcgagtcgctgacgccgtggcagagcgcgacggaggggtgagcgcggtgcagagcgccgtgtgcgacgacggcatcccgccggagctgaacagcatccgcaggtcccaccgccgctccacgaacgaggtgagcacgaccttggccggctgcgccaccgcccacgccacgagccccgacacgaacgtcgggttcgccgcgagcgccaggatgtacgggttctcccgcgccttggtcaccgccgccgccgtcgtgctcatcagcagcgtccctatcctcgcccctccccccgccgccgtcgccgccgcccccgcccccacggctaggtccgggagctcccctcccgcgcgccctccccgcaagcgccgcggcgaggagccgggagagcgaggcgggcggccacactggcggcggcgtggacggcgccgccgcggcatcggaggacgaggaggatagcgtctggacgcggcggcggcggtggcgcgggggcttgagcggcttggagacggggctgaggaggctgctggggaaaaccctagagaagcggctggagctgagcacctccatggctgctgctccgcatcgccgcggaggtggagactggagagtggtggtgtggccatggcgattaggtggttcagttattttataccgatgtcacattggacaaaattacccctggttttctcgcgttattacgttattaccgtggttggtggcatgggaggggtagatgctgcaggggttgttttggggaattcgccacggtggcatattactgcgaagattctcgggtggtcggagtcgccgtctcggcgtccggcgcggccaatcgccggcggacgcgtggccggagcggccagtgcggtcggggtcttggacccagtgagctcgagtcgacactggagtttttgagcttggcttgtggtggcagcttcggaaattttcctttttctgtttgtgagaaatggattttgggaaatttttcttgtgttctttgttgttcctgacaatgacatactgctccacctggcacatattttcttctgccttggaaatttgcaatcaaagaaatgcaagagtgatgtatggccatttattcccacaagcatattctttttttccaatagggaatagcatatgctgatacgaagctcgaaattgctcgtttttctccccccagcatgaatttcttgcaaataattatatatatataacataaaaatattttcaacacaaacaaacatattatcaaaaaataaataatattattttaataagactaatttggtattttatatagttgttattaaatttttctataaatttgataaaacttaaataaatttgactaaaagaatcaaagtgatttataatatgaaatgaaggtggtatttttttttcgcaatccccgagaaaagcagaagtattttgaagtgtggctcgaaaatccgtttctttgtagagaaggcgtattttttccaaacaccgccttcgggccaccgccttgcgattttcccatagccccagagtccccaaaaccctctcctcgctcgccgctcgccgccgccgccgccgcagccggcccagccgcgggagatgtcgctgtcgaagccgttctcggcgcgccgcctcgtcccggcgctcttcccgctcgcgcacgccgacgccgcctcggccgcggcgtcccgccgggcgcggcgccgcgacgcgttcgtcgcgacgccccccacgccgccgccgtccccgagcgccgtgcgcctcgcggagcccctcccgtcgctcgcgccgtcgcgcctcgcgctccacaaccgcatcctcgcgctcctgtccccctcctccaaggacggggagaagggggccgacctcgccgaggccgcgctcctcacccgccacgcgctccactccaactgccgcccttcctccttcacctgcgccgccgtcctcgccgcgctcctccgcgcgcgccgcctcgacgacttcttcgcgctccaccggttcgccctccaggccgccgtcccgcccaccgccgccacctacgcgctctacctctcggccctcgccgcgcgccgcctccccgacgccgcgctccaccacctccgcctcatctcgcgccctggatcccccgtgcccccgtccccgaccgcgtatcgcgttgtcgtcaagtccctcgtcgtcgaccatggccgcctcactgatgccctcgagctcaaggatgagatgctggcctccgggttcgtcgggcccgatccacaggtctacaaccttctcatggctgggttcgtggaagccggtgatggcgccaaagccgtggaattgtacgaagaattgaaggaaaagattggccgcgagccgattcttgatggcattgtgtatgggagcctcatgaaggcttacttccttatgggaatggaggagaaggcaatggagtgttacaaagaggttctcggtgcagagtcggaggtgaggtttggagctgagagttataatggtgtggttgatgcgtttgggcggaacagaaggttggatgatgcgatcgagctgtttgaaagaatgcttcgggagcatgatcctccactaaagattgctgttgatgtgagaagcttcagtgtgattgtggatgcttactgcgctgctggtaggttcggtgatgcaatttcttggttcaggaggatgggggagtgggaagttgttgctgatgttgcagcatataataatttgatccggcatctcagtcttcaagggttggtaagtgaggccgagttgctatacaaggagatgggagaaagtggtcttaaggcagacgaggaaacatatgtgctactgatgcaagggtgctttagggttgatcgcatcgatgaaggcattaattactttgacggaatggctgagttggggttgaagcccgacgcaactgcctatcataagattgttgatggcctaattggttttggtatgctggacaatgcccatgggtatctcgataagatgagggggaaagaaattagcccaagcattgcaagctatgaggcactgctaaaggcgtacattggtgaagctagtttggataaatcaatcgacatcgcaaaggatattcttttggatgagaaggtggtgttcagcgatgaaatgagggacctattggaaggcgcactccgtgaagcagggagggaaggtgacataaccaaactatacgaggatgtggaggagaaaaaagctgaggcagcggctcgggcagaagaagagaaggcaagggcagaagctcttgcaagggaagaaagggagaagaggagggcagaggctgctgcaaaggacgaggctgcagctagagctagtgccgctgccattgaagccatccttggccataaaaggaagactgaaaatgtaacaggagaacctgcacctgatgcaaactcactggatggtgtgtttcagagtaggtttggaatcacatcagctggagatggtgcgcttcaaggcacttcttcaggaggtgaaactaaacaaggagatggacactaacatttgatgaccacaggaaatcatgtcttagtctgcctgtggatctgataaccccgtcattttatatcgattctaagagcatcgatcagtaaattgaaattctcagaagcctgaagatttcaacatttggtgtcaaatgagtaaacggcagtaactctggttgagtcttttgtaactgcaattattgcatacgaataaaatgacggccacaaaattttgatgcattacggtttaaaggcccttttctatttgtgcagtgtgaaatattttgccaactttccttttcaatttgccaccaattctttctcctctgtattacggagaccaaccttggcagttgtgaaaaatatcaaaatattataggtgaaccgtgagccccagatatttccaggctcaaatttgttgcatcccatttatcaaaaagacaacaatgacaccgtgacgaaaataaagcttaatgctatgctttattgtgtaaaaatgttggctttacatagtatcgacacaacccattcgtatatcgaggagaagcagtgaaatgtatggtaaacccacagcttagttgctgacaaagcgaccaaaaggcagaagctgacaatgcgagtacgtttagggttcccagggattaaccctggcagtctaatattattctggtaaacatatagttctaaggctccatcatcccggaaaatcttggctccacatcctcgagaatgcactgaccctacagactcttcatcaacaagaacagcaattatcttctcttttccctctcttgcatcaggaatctgcaaatagaacgaaaaaattagtgctggtcgatgttgatagaagttacggcatgtgcaagtcacctcaaacattgcttctgtcaaaatatcttccattatagatctcagttctcgagcccctgtttctcgtgaagctgctttctttgctattaaccgcaaagcattttcagtaaaatgcagcttgaccttacatgggtaaaatgagaaaatagtttgttgttaacataccacagaagacggtgtttttaatcataacttgcagttgaatcaaaacaatcaatacaacagaaccagactcacatcattcattttaaacaacttcttgtattgttttcctattgcattttttggctccatgagaacctgaagagataaagtagattcatttaggaatatgtggtcaaaaataaattgcataaaattacaaatttatagaaccattgctacctgaaccaattgagcttcactgagatcattcaagccaactgttattggcaacctcccaataaattctggtatgaggccgtatgcaatcaggtcatcactttcaatctaagtaggaaatcgttgaaaattatctctatgtggaattaaaataatgtgtttgacaaatgtcagcaactgatcttacagcttcaacacagcatgattccccgatagcatttgtccaaccacagtttcgcagatcaccagatgttggaagtccaaaccccatatgacagtttcggtgtcttcaatagcacaagtactttaaggcaatatataagtctggataaagatggacaattcagagaattatagaagtttgtattatttgtaagtgcacaacctttctgatactatcttttccaagccagagaaggaacctccacagatgaagagtatattcttggtattaacctgcaacacaaaataagtctttttaaattctaacaacctactttgagtgttcttgatcataatatactggaactataaaaagtatcttgcaagaaaaaaaaatcctattttattatttccaggcagttattctttttttgcccggcctgaccaatttcattaagatagggaagaaacaggcagttattctatatatttccaattcagcaatgatcaaagtaaaaggttacctatataaatcccacaacaacctatatttagagacagatggaacttagtaattacttcgactttgaaccacaaatgcaatttgcagagtacgacaacaccaatgataaattacatttgaaatcaagaacccataacttcgttctgtagcaaaactatcatgctgataaacaataaggtagctattaacaaaacaatttaactgacttaacaacttaatcaaaagattcagaatcaatacctcgacataaccatcggatatactatcttgatttctttttcttggtacattgatgacctaagaatgatagcaacaaatgggtcttatttcagagacagaacatgactgaatgtacattcagggagaaaaaaaaattatggtcagcatcagtcacacatgcattaattgacatatacttacatgtgttgttaatcagatctcactctcttcagaagggctagtgtaattaccaagtatgaaaaatacaaagataaatttactttacagagcagaagattaatatatgcacttactgttccttcaaatatttttaacaaagcatgctggacaccctctccagagacatccctcctgtcctcattgcattcaacctggatgtgggaatgtatccaattattgcaagtgcagaaacattcgctaggcacggaagtagttcaaaactaatttgttcaatgaccttctttatgagtttatcaacttcgtcgatgtaaacaatcccgcgctctgtggcttccacattgaacttagcagcctaaaaggaagaacatgtcagaaaagcaatatatggtttatggttaatggttaatagtttaatatataagcttgatcctgttcagattatgcccaacgtagctattggcaccaaaacattttcttgcagatgataggtgatccaagattcattatacacaaaaaggaactggttattaacaatttgcaggagaactgttagtagcatggtagcttaggaaaataatgtaaaacagtattcaactaaaatattaggaacactagatagcccaaaagagtacataaatggccagaaagagagtgataggctgttacataccgccagaagattgcagattatagattccacatcttcacctgaatacccagcctgaaaaggaagttgttttggcatcagaaagaagaaaatagcatacacaatcagctttttttgccacgatagccatgacacgctggagtaagcacacatagaagaaattttcagaatgcttgaaccagcctttcctacctgtgtaattgcagttgcatcagcaatcacaaatggaacatcggcaaatcgagctaaagtttttgctaacagtgttttacctgccataggttcatagcaaaagaacgagataagcaaacagcattttcacagtacagatgaaccacgtatgtgttcgcgtcacctgaccctgtcggcccaatcagaaggatgttacttttttcaagctcaatgtcatcatcaccactcatactaacatcgccacatgccgagctcttcatagaactatatcaccacagatgaaattgaagtcaaaatcgtgatgcataactgaaccaccaaatgaaatttccagaatctaaccaatttgaagattcactgtatatcctcttgtagtgattgtgcacggcaacacagagcacctgcataagcaaagcacccttgttaaacctagccgcgaaatttgtacatagttccataatttcaatcgaacttgcacaattgtaaattgctagcagatagatcatatatgtagtaaagcaaagtaactcatgctcaaactcgagctcatagcgtcatcactggtcacacccccaatcagctacacagtacacaccacaccaacgaggagggaggtttcgttaaccttcttggccttgtcctggccgacgacgaactcgtccaggcccctgcggatctccttaggcgtcgggaaccgacgcggcgacgaggactgggccgtggaggagtaggagcggagcgcaaacaccgccgcggacaaccgcgaagcggcgccggcgccggcgccggtgcgggcggcgaggaggaggcggcgagcggcggagtacatgagaccacccgccgccgccggccccggtcgccggagcagtcaccggacggcgatctgttcgccgattagctaactt

SEQ ID NO: 41578 - DNA, 7595 bp, Oryza sativa
  unsure (1)..(7595): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaggatcccgtgtatccctgcagcagcaaggtgagcggcgcgtttcgcaacgatgtcgcagacatccaccacaagccttcttgttttaagggaggtgttttggacctgcaattttgtattgatatgcttcggtgaatcgattggaaaaaagatatgcctgagaaactttgacaaaaggttaaggtgagtacccccaggatatctttcagtttcgctccaactgttctgagatcaggtgatctgtcgcagtgcatcattgacatgtatggagtcctggagatgaaagccttaatctgtttagttaaagataatctttcgggggaggacaatgatgatggggactgcaggcattctttggttcaacttcttcaaagaatggagtgaacaacacaatacccaggctctagattgtaaaaggaatgaaattcatatataaattattaaaatttgaattcgtctaccagcttattcaaagatcaatatacatcactaccactaccactgctctgtataggatgccatggttacggttttgtgtggctaccttttacaaggtaaacacaggctacacagcaatcaagcaatatgatatttttctcttatgtatgtgcatgttcggctgtgatttttgaagcaacgcatattcatgatggaagattagaagctggcaaatgaacccaaaactaagattacctgataataaatggaatcttgagttttggtggtacttcatcaccaaaaagagaagcttcttcagccatctttaataggactctacgaacaatttctcccaaatacatgccagagatcaacttttcgtaaacctacaaaataatgaatgaaatgcttcgtcctagttggcaatgaaatacgagatggatctttttatgttacctgttcaccaggattcaaactttcagcatctaatgcttgatcaaattcagtcaaaggaagatgggatgacctgaagttcccccattccatatttattacctgtgacagcacaaacgctgatgagaaccctgaaaaccatctaaagcttatggatgaactaaacatgcacaagtgactcatgctaacagtacagacaatgtttctctccttttgcagcgtcatttgtatatcatgtcttagtaacccgaatcacatgaccccagatattataaacagatttcatgatttttcgcaacatatctattatctaatgagtaatgcctcatcaccaataagctaggtagaagcaaaagcactcaccatatctcctgacttcggcaggaggtcatgccatttaggaattgcattggcacgttccacgtatgctgcattagtacctgttcccagtataacagcagcaatgacatcattatcatcatatctcccaccagccaatgtccctatagtatcatttatctgcataagaaaaggagttgtgtttggatttcaggttacaagcatatcttcatacacagggtatttaacaaagttctatcataatttgtcaaatcaaaagaagctcaccaatgctgtgactttcatatcaagcccctggcgttcaagagccttggttaattcagtcacaacatcttcaccaacctgactttacagcaataagcaaataattcttacatcccagaggaatatgtaacaatcatgagcgagaaggttttccagtaaagaattaaatagtttccaatgggaaaaggaaactcttgtctatcctttgtaagagtatattgctacctatatgcatatacttgttaagatcataataataagatctaaccgtttcatcaatcgaaaaacccttagtccaattaataagagtgccagatgcaattgaagtttgctttactgggaaagagaacgtaaagccaagttctctctgcctcccctcagcaagatgaaagtcttcaccctctgaagcaacaaattttgctaaagaagaagcaataaaatcaaatagttcctgaaacaaaaaatatatgacaacagtcatacttagcatttaattgaatacggaatgaatgaaccagataggatacatggagcaattcttacatttgaaccaccagtcatcagatgcggaggaattgaaatctcgtcatgttcttgcttgataactctcccttccttgccacctaattgaacccgtaaaacacggaaatttgtacctccaaggtcaagcgcataaaacacccccttctcttccctgcaaatgcagcctttgacatatcagaagtcaatccaaagtacaactaagagcaatagttcaataatttgatcgagggtgcgcctcggcaataagtttgaactgcctgtggtacacgttagaacaatagaccccttcttttattcagtcttcggacaattactatgacaccctttctgtaatctaaaatatctatagataccagaattatttctgatgtatatgtgaagtgatacagtaattgcaaggttatagtaaccacatcagatgcaacctaaaagtgcatagaagttggctttacaccaacagacttaggagagactcatgatattcaataaggttggtttcttatctaatgccataacagctgaattcacattttgttcatttttatctaaagagaagtaatatatacacaagaaagaaacgtactttcctgagtagtaatcagtagcaaattagcaaagacatatatgacttggtttgtcaagttcacatctttcagaccaaatcaacattactgcgagtttccgacatcaaaattatcaacaagaccatgtccattacacaaaatcagacgcccgccactgcaaccaacctagcagcatcacattaccgtgacatcaatgcgcaaccattcaacgttttgcaggcgctgctagaccgcaacaccgttcaccgcaatcaaattaaaagaaaacattaaccacctaacgtttcaactttgaagcagatctgtgggacttcacactgttccctcgcagcagccattatccaaacgaatcaggcgaagaaaccaactcttcagactacgcctccccatacaacacaatgatacatgcaaatcgcgcgagaagggggcgagccattttacccggaagggagggcgtcgacgtagctgatgatcatcttgagtttgctcccgccctcggaggcgagcccggcgtgcatctcgacggccatcgcgtccgccacctgccgcagccgccccggcggcgccgcgcaccgctcctccagctcccgcagcaccgcgtcggcccggccccaccgcttcgcctcccgcagctgccggcgcaccagcagcgccacgccgaccgccgccgctgccgcgaccgccgccgccgccgccttcctcatcgcggtcgcccagcctctcctcggcgagatggggcccttacgtacatatgtgggcctcagccaccatcccgtaaaggccgcgcggcgctgcagtgccgttccagcccagcccaactaaaagacgtcatgtggctagagttggaaaaggtccactctacatccctcagctgtggattaattttcaacccaaaactacacgaaatgagcccagagagtccccaacttgtaaaaccactacaaatcgagtccttaacagtatagagggcggtttttgactaacattgcgcctacataacttgttgatttggccttctttcacatatgttgcgcttacattatgttctagtctgcaaaaaatgagaaaataattcaaatgaaaacgtggtgtttgaatctcctgaagatgaagataaaaatttaagtgtttcacgtaaaacgaggtggtaataatatgtgattaattgagttttaattattacaaacttgaaaaatggattaatcttatattttagaacaactttcatatagaaattttcgcacgaaacgcactgtttagcagtttgaaaaacataccacgagtatccaaaagttaatccaacctttgttggagaaaaaaacaggccctcaatgggctccacatctcagtgacaatcttcatccccttacctgcctgagttgagcttgagctcaaccatccatgtgggctagtcccctccctccatctgcctcccgttccatgttcctgcccgccgcgggtgcctctccgtctagctctaaatcggctgtgggaaaagaggaagggaaattggtctgaaggggacccccacaactgatatgtaggtcctatcgagtttattattatttttattttttttccttacaatgatatgtaagcactacatgggacaaagataagtcaacacatcacgtatgaggaaaccaccattaaaattgtcgagagacttgatttatactgattttgattctcgaacgatactatatatatttatatatttggttttatggttaaggatacaaatgaaacttgtcgaaacatggattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatttgatgatcaggttgtctcctgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaaacccccgactatgtggttaatcgaacaaaccaaacatatagtcaaggaataaataatccaaccaaccgagtggttttgataattatagtcaaccaagtgacttgatatcaatatatagcatatgcggtgtgaatcctccaaataacatgatccgagtgatataccaattgctttgtaaaatatgatgagtgatatagcaaaatagctataaagaagcttgtatattgtgaataaaaaaatttccacagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagacaatgaccacaatatataatcagcctaagccataatattggtcaataaaaatgcacacttacgtggcgaaaagcaatgatattgtatccaatcaattgcttaaaaacccaaacagcaccttgacttatataaaaaagtcagcgggacagctatataaagcttttgtcacgcccggaaattcaccagtaatttccgaacttatttgtgcataaaatcctcgtccaggaatcagccgaggtacacaaactgacaatttaatatacagattcatcaataactaaagcgaataaatacttacttaagaggcacttagtcctcaacatgaagaaaactgcagcggaaaaataaaatctagcgaagctccggctccactcccacaggcagctcaactggggtataagccaaacgtcttctccttctggatcctttttcttcaactgaggttgattgattattgcaaggtgagcatatatcatattcatcaaccacgacatcaaataagcaagtgcccaagtataccaaaggatggcgtaatattggctcatttgcaaaaacagcatttagcaaaacatttaagagaagtaaaatagtggagtaattaatcaggaattttaatcaacactgaacagcacacccatgctgcacaggcccaaccatcctgaacaaccatacccggctgtacagatctaatctccaaaccaggagctaagcaaattattaccaggtataacatccataactattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaatgtttctaagcatggctaagcaattatatctaatatctagttgaaccaatatatataaagctcaactagtccaattataataacccaaggtatcaaggaatagaataatcaatgcaaacaggccataacaaaggaataggttcacaccacccagtgacattcgaaaataaatgcacagttgaaataaatagagaatttaaatataggatcaatatgctcaaaggattgtgtttaggatctgtgtgacttgccttgcaataatcggtcttcaattaatcttcttgaatacttccggcgcactcgcgaacctttgcaacgacggaaacgacaagctatcacgcaaaacgaggaaaaagactaataaaaaccaaataaacaatacataaaaagtaaacaaacatgtagatcataattttagatgaattatgagacttgaacggcctcattctgacttcaaatgaatttattataaattttacaagattaaatctaattaaagcccatttaaaaagaattaaataaatttattcaatttatggacaattttaatatgtagatctttattttacacaacttttgcaacttgaaccacattaaactgagctaagatgaattagatatgaatttttaaagattaaatcggattaaaacctttatatggattttaattgaattatgacgcaataatgaattatttttgaaaaggaaaagaaggattattgcgtcagcggctaggg

SEQ ID NO: 41579 - DNA, 902 bp, Oryza sativa
ccagcacgtaaaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacggcgatgacttggcgaacccgatggtggcgacggcgaccgacgacggcgactgcaacggcggcgcggcgcggctgaaccgacgacaatgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgactagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctg

SEQ ID NO: 41580 - DNA, 1012 bp, Oryza sativa
  unsure (1)..(1012): unsure at all n locations
tcctgcacccccccgctgcctcgacccggcctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgttacactgggtggcacaggcaaggctgtcggtgaccggcaccccaagattggggatggtgttctgattggcgccggggcgacgattcttggcaacgtcaagattggagccggggccaagattggtgccgggtcagtggtgctgatagatgtgccggcgaggaacacggcggtggggaatccagccaggttgattggcaggaagaacggtgaggttgagaaggatgaggacatgcccggggaatccatggatcacacatccttcattcgacagtggtcggactacaccatttgagggcgacgcgccgaggtctatttctcttcctctctgtataatccgtagtgttgatatgccaaaaactgatgtacttgtcgtgctttgggtaatctgtactgtagtgttgtatcatcagccgttttatcagtcgaatgcccatgctcatgtactgataactggtgattgatgaaatgatgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41581 - DNA, 10578 bp, Oryza sativa
tctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatgttgattaattactacaactgttttactgccttcaactaccgtttttaaatgctagctttatgcaaaagaacctctagcttcctttggttatatcttgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacagtcgggtcgcgccgacggctgggcaagcctttcttcaaaagtgcccggggtggtctgggctcgcgaggaagcgagccttgagagctcgtcggcgaccgcgttatcccgtctgggaacgtgccgaagctctatcccgtcgaaatggcgctccatacgccgcacctgacgcacgtaagcgtccatctgcgggtcagagcaccggtaccccttacagacctggttaacgaccagttgggagtcgcctaacaccaggaggcggcggatccccagtccagctgccaccctgagtcccgcaaggagtccctcgtactgtgccatattgttggtcgcccgaaagtcgaggcggaccaggtatctgaggacgtctccgctcggtgaggtcaatgtgactcccgcaccggcaccctgaagagacaaggacccgttgaactgcatcacccagtaggcggtgtgaggcagctgcgaggggcccgagctggcctcggggacggagacgggctcgggagctggggtccactctgccacaaagtcggcgagggcctggctcttgatcgcgtggcgtggttcaaagtgcaaatcgaactcagagagttctattgcccatttcaccacccgtccagtaccctctcggttatgcaagatttggccgagggggtaagacgtaaccaccgagacccgatgcgcctgaaaataatggcgcaacttcctcgaagccatcagaatagcgtaaagcatcttctgggcctgagggtatcaggtcttggcgtcccggagggcctcgctaacgaaatagacgggccgctgcacctttcggcggggccgatccccttcgtcaggggccgcatctccagggcgcttttcgtccgagaggccgcgcggggcgcactcggcttctgtgtcgtcgacctcggggtcggagggcaacgggcgcggccttcccgcagtggccccggggccatcctgtgggtcgggggcgcctggcaacgtcggacaagcgggcagagggccagctccggccgtcgggggcctcgggccgccgttcggctcgggggcctctcctccctgctctctcccgggtcgaaccgacacagggtgggggtgcgcggagcgagggttgtcctcgtcgcgctccacgaccaacgccgcgctgaccacctgcggggttgccgccaggtaaagtagcaacggttcatctggtttcggggcgaccaggaccgggggagaactgaggtacgccttcaactgagagagggcccgttcagcctcctccgtccaggtaaacggcccggaacgtttgaggagcttaaacaggggtagcgccttctctcccagcctcgatatgaaccgacttagggcggccatgcagacggtgacgcattgcacatccctaagtttgctgggggggcgcattcgctctatagctcgtatcttctcggggttggcctcgatgcctcgggcagtgaccaaaaacccgagaagcttgcccgcaggcacgccgaacacgcacttgtcggggttcagctttatgcgggcggagcggagactttcgaaagtttccgctagatccaagagtaaggtctcttggttgcgcgtcttcacaaccaagtcatcaacataagcctcaacgttgcgtcctaactggctacccaaagaaattcgagtagtacgttgaaaagtagaacctgcattctttaacccgaagggcattgtcgtataacaataagttcctatgggggtgatgaatgcagttttttcctcatcctccctaaccatgcgaatctgatgataaccagagtatgcatctagaaaacacaaaaggtcgcaccccgcggtggagtcgacaatctgatctatacgtggtaaggggtaagggtccttaggacatgccttgttgaggtcggtgtagtcgatgcacatctgaagcttgccgttcgccttggggacgacgaccgggttcgccagccactccggatggatgacctcacagatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcaaagacgtcggcgtttgcccgcaggaaggagacgagcgcgtcttcctatttgtcgtccagaagaccaccgattcatgtggtcttggacgggccgtcgcccagggcaacctccttgaccgggacctcgtcgcacgtgaccatccgctgcctcggggcagccgggacgggggcgctgagcctctcgtcgccaccctcgggcttggacgccgcggcgagctggtccgaacgctgctccatacaagcaagcgcgacttggaggtcgccatggacggtgatggggccaccagggcccggcatcttcatctggagataggcgtagtggactgccgccatgaacttcaccaacgcgggtctccccaggaccgcgttgtagggcagactgaggtccgccacatcaaagttcacccgctccgtgcggaaattggcggaaccaccaaaggtgaccgggaggtcgatatgacctagcggccaagtgtgccccggcgtcacaccgatgattggctgggacggccggagcaccatccccggggccttgatggcgtcaaaggctgcgggagaaaggatgttgagggctgcacccccgtcaatgagggcacgccccaacttcacattgcaaatggtgggggaaaccaccatcgcgatctgtcctccccgggcaacgcacggcgggtggtccgtctggtcgaaggtgagggccacctccgaccatcgcgcccgccgcgtcgcctcatgggtaggggccgcggccagaagctctcgcttcatggccttgaggctccggcgagaaacgtgagcgcacgctcccccatcaacggtggcgaccgtggcctgaggctcctggaaccccagttatcgtcgccatcgtcgacatcctcggcgggggccttctgcttggcctcacctcgccggttgccggcgggggccgccggggccttgccctcacggcgctcctgtctcctctcctcctcccacttcctcgtctgctcagccaaacttttgaccgcgcggcagtccgcgaggtcgtggagggaagtgttgtgcacggagcaccacttgccggtcgggcgctccctgctgggagcgccggcctccttctttctgtcgctcgcaagcctcccctttcgggtggcccgcgaagcgccctcgacggcgaggacgtgcccctcgtcgtcggaaagggccgacctcttcttcctcctcctgtcccgccgccctgatcgagcagcggacccgggggcggccggagctgccacaccggaaccggaggagttccaggtccaggcctcctccttgcgagccacacagtccgcaagctgaaaaagctccgcggtggtctggggctccttggaggcgatcttttcgagcatgcgattgtgccgcacgcccccccttaacgcatagatcactgcgtgtgcggggatgcacggtatagtgttgcggacttgacagaaccgctgaatgtacgagcgaagagactcatcatcccctcgctgtaccgcgtgcaagtccgcttcttcacctgggcgcggatatgtgccctggaagttcatggtgaactgctggcacaaatcctcccaagagtgtaccgacgcgggtgacaagttcatcagccaaccccacgcctgaccttttaggaccatggggaagaaattcgccatgaccctgtcgtcacccccagcagcctcaatcccggtcgtatagatctggagaaactcggcggggttgacgcttccgtcgtatttttcggtgatggtgggccggaaccttgggggccaacggacgttccgaaggctcgccacaaaggctcgacagccggcaccgccaaccggggacatgggaggctggcccccatgcccaaactgaagtggcgctccggacgaggaagcgccctccgttgcgtgggcagcacgacgaccattgcgtcgacgctcaatattgaggcgggcatccggccccccacgcacatcttcttgggtcggaggcgtcgacgagggaatagcagacgaacggcgggtaacggccgcctttcgccgcgccctccgcctcgacgacacggagccggtggtagcagcgccagaggccttgggggcgtaggaccgcccgccggcgcctaggcgctgctgcgccgtcatgaccaagttagccacatcatccagccaacgtcgagctggagtctctggatcggggacgacgggcgggtgacgcaggagcgcgcccgcagcctggagcgcgccctggggcgtgctgccatcgccgtagacgaggaggcgacgctccccgtctcgccgtccttctccatcacccgtgggtggcgaagtcgcggatctttcgatcccctcgagcgcctcctcccgcccaagacttcggcgagagggagacggtggagtacgagctcgacggcgcgggttccgctccctgtcgtcaccgctagcgctcggagagaggttgtgcgccactacccgttcggccattgggctgagcgggagaaacttggcgcacacgaaagaggacgagggcccgaaaaacacacgcgccccctacctggcgcgccagatgacggagcgtgaggctcctcaccgggagaccgcgcaggcccccctttgccggttcggccgggggcgctgagtgaggttcttcaccctcgatctgtggaatgtacgcgagagagcaaacgcacgagacacgggcgatgtagacaggttcgggccgctgggaagcgtaataccctactcctgtgttctggtgggcatgtgtgagaaaaagttacagagagccggcaagcaagagagttccagctctagaacccctcctttttcctcctccttttcctcctctttttcttctctttccttttttctccccctcttctcgtgggcaaggtcctccttttatatttcaaggggataccacatgcaccacttctaactactcttcctttgggtggagacccaccctatcttgaccaaatcttgacacgcgcctccgccttgaagctgaatcaacgcctgtctttgaatgatgcccaacgccgtcacttgtcagacacaggggatcaccctgtcatttcttcatcttccggcggagatttgcaatggccgctgttcgaatgaccctccgatgggatgggtcatacctgcctccactccgccggaagctgatgcaatatgagagcacggttgtctgctgatgacgtgaccggcgtcggaccagtgacagaccggtcattcttgtccactacgcgtcagttcggcatgccacacacctgcccttcttcatacagtgccttccttgcaatggttgcgatgaagcctggcatgaatcgagccgggactgacgtgctaatcccaggagttaccacgccggctccagctagggatgagtgccaagaggctctcatcattccgacgggacggggcgaggcgtatgacaggctgcctgctgccatctaacccgcgatctgaccggtctgtgaccggtcacacactgcgaccggtcacggaccggatatgcgtgcgccatgccgcattaaatgcggcgtggcgcgcttgttcatcccgcaataaatgcggttaggtgagcgccgctgtgcccacctaacccacacacgtggcgccaataccacagggggtcggggcgccccagccctcggggccgaaacaggagcggcccgacccctcggggagacagaggagggggtggccaagtctccctcgggcccgacccccccgagggggtcaggccacgtgggtgaccgcggctgcccaagcctctagtcacgatacccccgatcccatgtcaccgacagttagtaagtatggtttgttaacatttgtcattgttaaatgttagtagagatattaaagtagtcgtatggtttaatgagttgttagttagtacatgtaattaatttcttatgtgttaaaataggtagaaggttgcagctgatggaagccgccgccgttgccgccaccgtcgtcgccggctcgtggaagcgtggcttgaggggtcaagcgcgaccatcgccgccacctctagctcgttcctgcctacacctacccggccctgccttcctttagcgtgagcgctaatggagactgccctcgccgccaacacatgcttcagcgaggatagggtgaggattgaggaactagaaagccatatgacatgtgggccctacaaatttttgtatttggtattactgactggattaccatgtgtgcgtcacatcggactaaaaccgcttcggagtgagttaggggggtaattcgtccggtataagtagtttagggttttaaatgtccagttttgtggtttagggggtaattcgtactaacacgattgttcggagggtaattcgtactttttcctttgtgttttgtctatcttaaatttggaaattactgatacgatcagtatacttacggcattttaatttgtagagttgagtagttaagacaacaaaagctccaactactaattcaaaatataatattttttattactcttttctttttcttcacctttatacaaccaagtttttgagagagagggagtacatagctcggttgacagaatgctgccaagacctagccactgtgtagaggtgtaagttccaaccacatcctaaaaatatattcctagcatttttcatgtttcttcgttttaacaccacgtttgcactctgctccacttggtattatcagtttttgttctttcaaaaattcataaattgtatttataatgaatcaagtgaatataacattaaaagttgctgtggtgtagtggttatcacgtcagtcttacacactgaaggtctccagttcgatcctgggcagcaacagtttttttattctgcattttatttaatccttttccatttttttctgcattttatatctaacccttttccttcaatttcaatgccttttaaattccttttccatctacaatttcaatgctggatcatctgccgcgcaggtaaaaaaacatcgacgaagcgaagtgatctgtcccttcagcaacagctagtcagctacgattcacaaagcggaatcacttccagtgagtctcgaatccgccactccaacgaagcgcacacgagagagaagggagggaggaaagaatcgcgatgagaggcgcgctcggcggcaggagccgggcgcggcagaacgcgatgcggtcgggcctggtggtgctgggcgccgccgccttcggctacctctccttccgcgtcggcttcaagccctacctcgaccgcgcccaggaggccatggacgacaccacccaccacggctccgcctccggtgccgccgcccagcctgaccacgccggggaagaagacgacgtcgcgacgtccaaggacccggccgtcgtgctccgcgactgaggccgctcgtcgaagcttccgtagaggttggtgccttttgcttttggttggttgtgccattccgtcgaacaccttgtgtgcagctcgtagcggagctgcaatcttgcgcggagagtgctgttgctgaataaacacttcacattaccaacagacttgagcatgcatgtcgttctcttcatagaacacagttactgtcttgctgatgaacataagtgctgaagtgcaaatgggcgctactgaatttgtcgagctcttcgattctaataaagattctgcttagatttagcatgttgtgttttttctttatctacgccctccgcgattaatgaaagcttccaaacggctaatcaattcccatgccattttttgagatggaacttccaatttcatattgttatagcctagataaatgtgattactgatgagattgttccaagtagttcaactcagctcaacatagtcagtcagcactcagcacccaccaaactgagcagcaaaaagtccactttacgtccctagaattataggttgagttttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagccccctctaggggcaggagacaacctgatcatcagatcaatacacacccggcggattcaaatccccaaacaggagtagggtattacctctcattgagagggcctgaacctgtctaaatcctttgtctccgcatccatccacttttaggtctcgtgcgctacccccttttattattgccgaatccatgtttcgacagttggcgcgccaggtaggggtaaacgccgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgctgtttgcatgtaacgccgcggcactactcttgccgactggtgttttcgtctgcatggctggcctattatgccgctgctgttgggcgtcaacgacttcaccgccggcctgcctccgttgccgccgagtggtgcctccgcctacacggctggcctattatgccgccgttgttgggcgtctacgacttcaccgccggcctgcctccgttgccgccgagtggtgcctccgcctacacggctggcctattatgctgccgctgttgggcgtctacgacttcaccgccggcttgcctccgttgccgccgagtggtgcctccgcctacatggctggcctattatgccgctgctgttgggcgtctacgacttcaccgccggcccgcctccgtcgccgccgagtggtgcctccgcctacacggctggcctattatgccgccgctgttgggtgtctacgacttcaccgccggcctgcctccgtcgccgccgactggtgtcctcgcctatacggttggttggtcacaccaccgttcatgggcgtccacgtctttaccgaccggctggccttcgtcgccgccgctgttgggcgtctacgacttcaccgccggcttgcctccgtcgccgccgagtggtgcctccgcctgcacggctggcctattatgcggccgctgttgggcgtctacgacttcaccgccggcttgcctccgttgccgccgagtggtgcctccgcctacacggctggcctattatgccgccgctgttgggcgtctacgacttcaccgccggcttgcctccgtagccgccgagtggtgcctccgcctacacggctggcctattatgccgctgctgttgggcgtctacgacttcaccg

SEQ ID NO: 41582 - DNA, 3978 bp, Oryza sativa
ctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctatgacttcactgccggcctacctccgtcgccgccgactggtgtcctcgcctatacggttggttggtcacaccaccgttcatgggcgtccacgtcttcaccaccggcctgcctccgtcgccgccgagtggtgcctccgcctacacggctggcctatcatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgggtggtgcctccgcctacacggctggcctattatgccgccgctgttgggcgtctacgacttcaccgccggcttgccttcgccgccgccgactggtgtttttgcctatacggttggcggacttcgccgctgttaatgggcttcatcatctacaccactggcttggttccactggcgccgactggtgtttttgtcaccattgatggactgctttattcccacatcggctacttctgctgtcatcgagggaacacgacaaagctaagtcatcatttattttattctttatatgatattttgtcttttcctttgcctcactacatcaactggttcgccgttgactagtgagtcgggggctattgatgttatatcatattttttaaacaatttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataaatttattttctgctcttaataattgcaaaagtacctaagtagtaaattctgatccgtgaaactttgttccattaatgacgaactcatgtcactcatatgcatgtttgggaaatgcctaggccgactcccgatgcttggggactatgactagtcgggcagagtgtttaaacgtacagaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaatggattcatggctttaagcttatctcttacgctccaggaatggatcagtcagaacatcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgcgccgctgttgggcgtctacgacttcaccgccggcctgcctccgtcgccgccgagtggtgcctccgcctacacggctggcctattatgccgccgctgttgggcgttacgacttcaccgccggcctgcctccgtcgccgccgactggtgcctccgcctacacggctggcctattatgccgccgctgttgggcgtctacgacttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactagtttcttcacttccatggctgcatgattctgccagtgttgattggcctattatgccgctgttgttgggcatctacatcttcatcgccggtcgtctcgtctgctgctgactagtgcccttacctctacgtctggtttatacagctaccactactgatggacatcatcgtctttcgtcgccgactggttatgctgtcgccgactagtgcttttattttcacaactgcgcgtcttcgctaccagcttgcttctgttgccgccgactcgtgttcacttcatcacggcgatgcaactttgtcatcatggtggagcgacttcatctttattatcttcgtcactggcaaactctattgctgctacttcgcaagttttgcttcttcaccaaccacgacgtctttgtgaacctcgacatctcggcatgcgatgccgtgttattttactacaacaagtggctctccaatattcaagatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcgcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaagtattttcttcatcttcatgattggtggatttcgtcatcgtctttgatgcgtgtctacatcttcaccgtcggcttgctttcatcaccaccgactgattatttcgtcgccgccgactgctctgtcgttgttgttgggggccttcatcttcattgctagctgacctgattgctgccgactggtttcttcgcctctgcggctgtgcaacttcatcacttttgattggaatcactatcttccctaccaccaatatttttgccacctctggtgggcaatattctctctatattggttgtcttgtctatatgctaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctgtcacatcctgattttcgtttcaagatttataaattatttaataaattattaatagaatttatattaaatgttctttaagttacaagtgaagttaaatgtgggaaaataaatttcttaaatctaaaacatggatggatttaatttt

SEQ ID NO: 41583 - DNA, 735 bp, Oryza sativa
ggcctttatgccgccgttgttgggcgtctacgttttcaccgaccggcttgccttcgccgccaccgactggtgtatccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtctccgcctgcacggctggcctttatgccgccgttgttgggcgtctacgtcttcaccgaccggcttgcctccccccctccgactggtgtctccgcctgcacggctggcctttatgccgccgttgttgggcgtctacgtcttcaccgaccggctgcctcgaccgccgccgactggtgtttccgcctgcacggctggcttattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactagtttcttcacttccatggctgcatgattctgccagtgttgattggcctattatgccgctgttgttgggcatctacatcttcatcg

SEQ ID NO: 41584 - DNA, 997 bp, Oryza sativa
tgcttgatgatacatctgtctctgaaagtggccactgtctcatgcttcagctcgtctccattgtagaacaagatcagagagaagtggctcttcaccctctcatctctgcagacatgctcaatcagtgtgctcttcccgattaacgcgggaccaatgatcggaagaacacctatgtcattacaactaccatgaggatcaggatcaatccgcagcaagaaatcgatgacttgttctcgctcgatctgacggctgaacatacacttgtccagataaagatgcgtgctgaaaggttgccggtacataaccggagggcagctcatcagaaacacgatgaactcctttgtgtcagcaatggcgtcttccaggctacgaatcatggactccaaatcctgaaagctactagttctagcacgagagaaacggattcgcttggcaggattgagccttgacattgcaaacgagcttctcacctgttcatcttctttctcctcctctttctggaggagatcagcccggtgtctgaaggtgtcgaggacgtagtggcctctgaacagctcgtctctcatggccttgagctgcgggagcatcccttggttggtgatatgcctcccttctgcctcctcgacgatggtgtgtgtccgtagaagcagccggcgcagctgccgtacgccgtcgtcgatcgccgccggctggttgctgcagtatctgtccatgacgtaggagatggacctgctagtgaggtcaccgaggattgcagaaaagagctccatggcgaggttttcttcagagtttagacactgttaggatacagactacagtgatcatcgatgcagcgtaggtgtaactacattaattactccctccgtcccctgttacaagggattttgagtttttgcttgtaacgtttaaccactcgtcttattcaattttttttgaaattattattattttgtttgagacttactttattatctacagcactttgagcacaactttt

SEQ ID NO: 41585 - DNA, 3014 bp, Oryza sativa
aatcccttatattatgggacggagggagtaattagcaagctagtgcattttcacttggtcaggtcttggtctatggtctaaatttccgggcggaaatgaagtgacagagagtcaagttaagaccgaattgaagacttgatcggcaaagtgtccctcgtttttgcatgtcgtaaaaaaagatctgaagaaaatttgacggatcaacacaagggcttcggtgatcggtggtgtgcttgggtcgctatgcttttttgaactgcaacaacaagagtgttaatcaatggcaatcccgggaatgagattcatcaccgctgaggagtccgccaaggcgacccaatctcaccaatgatattcatcctcgtgatggattttctcagccttctgtttcaaaaggcggaacacgaggggctattgcaggatttgggaatccctcacataatctctctttatgctgatgatgtggtcgttttcatcaaaccgacgattgaggaggttaaggtcgcaactgaaatcctaagcatcttcggtgaggcctctgggctccggacaaattttggcaaatgttcagccctgccgattcagtgctctgaggagttgcttgctgagatacagccagaattgccctgccctattgcttccttcccctgcaaatacttagtctgcccctttccatcttccggttgaagaaggaagacctgcagccattcattgacagcatagcccagcggcttccagcttggaaatccaaccaaatgtcgtcgataggtcgtgtaacaatggtgcaggctgtactcagtgcaatcccaatctacctgctgatttctgtcgacgcacccaagtgggtgatcaaaggaattgacaaaatccagcgcgggtttctctgggcaggcaaagtgcaagccaatggaggttgctgtcggatcgcttggtcgagggtgtgtgctcctaagaactatggcggtttaggcttgccgaatctggagttgatgggtattgcacttcgctccagatggacttggctacagcggacttcactaggtaaaccatggaaaggcctagacatcccggggtcgcaaaaagagaagagcttcgtggctgcatccacagtctgtcagctgggagatggacaaacgatcctcttctgggaggatagctggctgcaagagggctgcatccggtccattgctcctaacatctacgatcgcgtttcgccttgcatgcgccggcaccggacggtggctgaggcactaacggatcgtagatggatcaaggatatcgccggggcacttgggatccaagccatcctagagtatttgaagctttggtcgctacttcatttggcgacctgtatccctaccactcctgattctttcagctggaaatgggaaagctcgggtcagtacatctcaagatcttcttacaaggctctgttctttggtcggatctccttcctctcgaccccgatttggaaatcacttgctccacctcgatgccgctttttcctgtggttggtagcaataaacagatgttggaccgccgatcgtctgcgaagccaggggttgcctcacctggaccgctgtgtcctttgtgaccaaaaggaggagagcattgaccacattctggtaggctgcccagagtcgaggcaactttggtggtggacattaagagcgttaggcattccagattgtctacccatcaacgaaccatcctttcacctctggctttgtggaagccggatgaaattgagagagcaacatcgctggggctttgacaccattacaacgctgatggcttggtcgatttggaaggagcaaaataatcggatcttcaatcagcagtccaagtcttggatcgaagtggcgaaagcaatggtggaagaagccgtactttggaagtcgacaaatgcaggggtcccttccattttacctctgtgaggtcgtggtagccaaatctagcgccagatatcatgttagatcactagtctccagtatcggtcccgtgcttgtttttcatttctcactgtaaataacttttatttctcttaagggaaaaaatgcgctccttgtgtattccccaaaaaaaattttgatggatcaacgagtccttgttttgctgtagcgcgtcgtctgcatgtctggcctacagtacacgaggaaaatccacctcgatttgatgagcatatactcccttcggttttgtattattaacgttttaaataaggttaaggttaactttttataattttgattaccaataactttaaaatatataatttaaagacactatcacgccatatgtaaatttattttacaaatcagcataataaaaataaaatcatatttattatatatattatattacaaaatctagttaaagatatattttagagacagtgttattattgtttaattatcgaatcggagagaatacttactatagtcactgtagctcgtctgcatgtctggcctacacgaggcatataccccagggcccaagagaagaccgtgacgaggcatgcaccgcacgtgacgtcattcccgaccatcgccgtcgtgtgttctaggcttctagcacacgtctaaacgagattacaggacactagccacgtgtttttatcacttaacacacctgtgtgtatgtactgtgtcctgagattaaatactggaaaatgtgatcgagcaaccgtgtcacttttcaacaagaaatttataatttgattgttggtcaaacaaactgccagtatttagtgccgattcttagtacagctagcatcctagtagtagttatactgcagtcggtatattttttgaactcaaggaaaatgaattcagtatcacaggagagaaagcagtctactgcactctgcagtgtcaaccttcagcatctaaatcagttcagaagttaaaaaaaaaaggaaatccataatgcaaataaccattccatgcaccaacctactgaaagcctgaaccacatgtcatttaacctagtacataacacaatttgatatgtagctg

SEQ ID NO: 41586 - DNA, 8123 bp, Oryza sativa
cagtacaaagtaattttcaggtttaggtctcacaattacccaaccgaacttaggatgatcctggcaatcacaaggcataagggagttaatttcgtctctgtactctctgacgaacgcaacaaacctgctccagaatttggagttgaaattggctttcagtagagctcctccgatgtgtgcacacaagaagcagcctcttagcactgtcgcgatctccatcgccatggatgcaagctttggatgctgctctgggtctgtggctccaaatgcaagaaccttgaagaagtaccagtaggcttcgaatggcaggaaattcagcctcagagcttgtttggctcccaacctgatgatcttctctgatcggcttgtgatcatgattttgatctcatgtgtcatttgctttctgaaagaagagtggattttcttgagtgttctttcatcaacatctcctaagagctcaatgataagcagcaatcttccatccatggcatcgtttgattcatttcgatgcttggtttgacaaatttcactgaaagtttctgccttctcatatctcagatcatctccactgtaatacaagatgagagagaagtgttcacgcactctctgatcacggcagatatgttcaacgagagtgctcttcccgacgaattccgggccaacaaccggcaaaacctgaacaatttcttctgcaactgcaagaggctctctctgcagcaggaagctgatggcattttctctctccatttgacggttgaacatgcatccatccaggtacagatgcgtgctgtaaggctggcgatacacaggaggatagctcatcaagaacacgacgaattccttggtgtcaccgatgattctctcgaggctagtgacagtctgatgcagatcgttcgtgcttcttgtctgaatttgagtgttgctgctgctgtcagagaagcggatacgcttagcccggttgaatttggacagagcaaaacgtggtgttacctcgtcctcctcctcatctctgaatctgaaggcgtcaagaacgcagtggcctctgaacatctgctccctgagcagctcgagctgacggatcatcccatggttcgtgacatgccgctgctcagcttcctcgacgacggtgcggatccgcacaaggagatggtgcagcctctgaagattttcatcgaccgatggccgctgcttcgggtacctgtcgatcatgaaggttattgatctgctgacaaaatcgccaagaattgcagataagagctccatcaagaacccttctctgaagaaagtagtgagtgccatggatgcagagatgagagcagagaagtgcagttttgcaggtggtgttgtgttgtttgcttgcacaagagtagcaggactgaccaaacgccttatctaagggcagagtcaatgccgtgaggattgggtcacgaagtgcagatgattaggcgtacagaaactgtcaggtcagattcatcagaccaaatttactaacccttcctgttccataagaaatcacaggtcttttatctctgagatatcacatctttgacaaagattgtgatttgtgagttgaagtttggtacggtgataacaggggactaggttatttgcaccatgtagctactaataataaaaaaaacagaggtgttatgcattcttgcagaaaaaaatggcacaagtcgttgctggactcactagctgttgactgaataataaaaacagcggggttatgaattctacagaaaaaattggcacaagtcgttgctggactcagactgaaagcaacatttttgttttctggaacgaatagtaccaaacaatgcgagatttcatatcgatatagcaagaaaaaaaaagattataggcctgggactatgaaagcaacggaattagcacagcacagttccgttctgttcaatgcctgaacctttttgggaatacgcgagaagcacatcattgtattaagaaggaataaatgtatgtacaaaacggtccgaaaaattaaaaccgaaagggacaagatacaagagggggaagaagaaacaaaagcctaatctcccaaagaatttggcgacccatctccattcataggaactaccatgaccagtattgcggctctagccagtcgccaaagatccgcttcacccgtcatagccctagcaatctctgtccatggtctgctattctagttgaagacccgattgtttctttcctttcaaatcgtccacgctaccagtgctgtgatggtgttgaacccccggcgatgttccttggccatctttttgcgactgtgatacaaccaagaatgaaaagattgctcgttgagtggtaaacactcagaatgcccaatagctctaagagcaatccaccacagctggcgagactccgggcatgcgaccaagagatgatcaatcgtttcgtcgtattgatcacagagaagacagcgagccgggtgcgatataccacgactccgaagacggtacactgtccaacagcggttaagggcgaccaaccaaaggaagtaccaacaacaaggggtgccaccgtgccaaagacttccagattggcttgtgttggaggcgagttcttccaaagaagaggacacgatacgccgagcgggagaagtacagtcccgaggtctcccagcgccatgaaagcgtgtcgggttcccccaagagttgcatagatcgaaggaggtcccaaagcttgaagtactccaggatcgcttgcaccttcaacaccacacagatgtctcaaatccatctcatgtcgtgcaatgcctcagccactgtacgcctgttctagaagcgggcggggacagctgcgtagaaggccggcgccagcaattgaattaaagagccctgcagccaacatcccagaacaacaccgaaatcccgtctcccaccgagaataccatagacgagatgaggttgcctttcttctgtgaaagtggaatattaaacccctgccatggcttgtccagcgaggtccgttgctgccagagccatcgcgacctcaacgcaactcccaacctctcgagatcggggatacccaaaccaccatactctttgggtgagcaaactcaacgcaactcccaacctcttgagatcggggatacccaaaccaccctactctttgggtgagcaaactcgagcccatgcgacctgacagacgctgccagtgcctgaaactgacagggcaatgcaatgactgaacaaccagagcattcgctcaactaaggaaagcaagccattactaatctcgaacttacagaaatggacaagcataatacagccaacgtatgcttctaagatcttatagttcaaatagacatcagaatatggctcagatagagtacaaggaaaatgtaggttataactaaaaaagaggagcaaataaacacacatcaaacaccaactcgtctacaacatgctgtgattcgtgaagattgtaccacacatcgtgaaataaagttatggtagggtggaatctgggatttccatactaagatttcagaattgcttctagccttagcttttccacatagcatatcttgcactgttgtatctggaacatcatcttcaagagaaccttttgggtaaggttcatacatacaaaagtgtttgataggctgagctattcccttgatataggcaggatggttcattgtaacatcatctggatattcactgtacaaattgaggttatttgggatgtgctctctggtccatgcaagaactctgtaccaaaattgagcattgaaatttgttcttagtaagccggcaaaaacgtttccatgcatgaacgatccttccatctcctttgctatctccatggctatggatgctagcttcacatgctcttcggatctatacttccgaagatgcgtaccttgaagaaataccagaatgcttcacatgtcaatggtctcagtctaagaggtcgcgtggtcccgaaacttgtgatgttctcagatcgacttgtgattatgattttagtaccatgtggcatgcgcagttctgaagagtataatctccatttctcctcatcagcatacctggagagttcaatgacaagtagcaatcttttgtggaaagcattaccccgatgcttaacgataaaattctctctcagagtggttggtgtttcatccttcatggaatttccactgtaaaagagaatcagagagaagtgatttctgactctctcatcgatgcagacatgttcaacaagagtgctctttccgatatgtcttggaccgatgattgggaggacaccaagatttgaactaccgggtggttccatctgtagcaagaactcaatggcatgttcaagttccatatgtcgattgaacatacacttgtccaaaaacaaatgcgtgctgtaaggttggcgatacataggacggtactgcacaagaaattcaatgaactccttcatgtcagctatgaggatttctagcctatgaaccatcttctgcaaatcttctacctccccaccactgaataccgtttgttgaggtttactagttgggaaacgaagacgcttagcaggattgaatctggacaaagcaaatgaatggctcacctcgtcatctttggccttgtcttgaatagctcggtatctgaagttatcgagaatgtagcagcctttcaacatctcatctctaaggatcttgagctgctggagcatcccttggtttctgacgtgccgcccttcagcctcctcgacgatggtactgatcctcataagcagctgccgtagcctctgtaggttctcctcagcagttgcctgattgcagttgcagtacttcccaactaagaaggacatggacctctgataagatccccaatagctgcagaaatgaacatctccattaactgtgacctggaaatggacatcttgatctctcctagagtcccacacacactcactgaagtctgaagatgatactaatcgagtctgaaggttcttgggagctttgtcacttgttgcagagtaaagcttcagcgcaggatttggataataaactgtgttatctgcaagactgccacttcgttatatattattcttgtgacccagctccaacgattgcggcaattgttttgttggtggttgactggctgtgtgctattcaaagcttatctgtctcgaggaaacagaaaatatttgccactgtgctccagttcgcccaggtgtgcagacgtgtgtgttgcgcttgacttccaaagtttcaagctcgataatgcctcctagttgaacctgtcaccatctgcaaaaataagagctatacctgttgccttgccagtcgccggcacaccggtatccggaccccgagaagttgctcatcgctgcaggtaggctgatgcagtgaaacggaagctgggaaaatgggcatcctttcgtgatagcagcaaatcaagttgggccaatgcaaacctgccgtcgccgtcatcgatcagcagttgggagcaccggctgctgacgagacccaagcctggagcaatctgcacctgcatctcaaagtacttgtagcatgcctgaaaatatatgcagggaattcgcaatttgggttaataagatgaacaccagttcatcagcagagtgaatgcaaccagattctctacaggtgctgaaaagaaataaataaaaaaaaaaccctccgtcccaaaaaaagaccaatcctacctacgaacctggagacatgtgtatccaggtttgtagctaggaattcgttttttttttggggggggggagggggggggacggagtagtactgttgatttatgatttgaactgttgatccaacttcagagcaaaatactgtcaaacagtgtatgatggatgtgactcatctacttgccacaagtgaaacagcatataaacacctagaagttctagaacccattgagttctatggttgtttatagctagacaagtcatggcaatacagaagattcactccttccctgaaagcaacctaccacactaaaaccaactcaagactgtttcaccaaaagggcacaactacctaatatgagcacttcctcaccacacatctcaaaacagacagaataagatacaatgggcaaaccagcaaaacaagaccaaaggtcaaaggatagcactctcaagaaaaaatggtgcccaagactgagtaaaagaatcttagctttagcgaaatatttagaaaagaattaccaaataaacatcctttcctcagatcctttgtgaggaaaaagacatttcctttcctcacatcctttgtgctagtttccgtatcagttctttaattcagatcttcgtcgaaacagggcttaatgcttacaggatgtcttaaatattaagttgctagtatggcttaaatattaagttgctagtatgtttcccaaagagcaaattcacagtatccaaacatgtccgcgtacgatcttaaggatgtcttttactttctagtagaagattgtggtccacatttgatctccaaccccagtggtttcccaataatgcagtttagcacattcacaggccttaaggcacacgaaaaatccaagtggcataaaatacaactagctccagtaagcaatgcatctgtggctagtacaccaatgatttctgcaagtaattgtaattcagaatttggttaaatcaataagttatgaactttttacaatgcaaagcaccgtgttgtcctatgcgaactgcaatgtcacacatgctattttaagcaaagtacatgagtgttaactaactgtccctagtcataatcagtagacatgcttaagaactattcaccatgtgcaagtagcgaaagacaagatatgtaaaaaaaaaaaggatggtgcaaacataagtatatgcagacaagataaagtgcaaagttgagctcatcacttatggaaattttactgaattgagaataaataggtgatgaaactgagacaaggtttactatttacctgctgttttttaaggaaagttattcaatgctcttatttagttctgttaatcaaacatatgtacaattataagtatctgcccaagagattagaagttaggaaccgaagcatatgaaaaataacagatttaaaagcaacttctgcaagcacacaagtgattcatcacaagagtttcaaggctcgacagatcctcaacagtcttgaaaaactaatggaatgcaattatcacaaaagttgatgcaaatacgacataatcaataaggataaaaaggcttgacttcaataacgtaactgcttgtacagataggcaaatcaaggtgtacacagcgaaagcgaaacaccaccacatgacgagtttccacatatcaatggataagtaaacatatggaaagtaatgaaaatgatccgtcaccagattcaacctgctagaagaagaaccttttatgtgcaaaaatgctttcagaaattctcaggagacattcatcaaccccttcaaaagcttcgaacaaattcttgcaataagagctcttgtaaactgacatttcgtttaatttacctaatgtaaagaaaatgacactggggatggggggacaatgtgacacctaaactgaataacaactccacaagttcagaatatgcattgtgacatcagtcattgtggtaaaattaaatcacgcacacagatatagcacctggagttgcatcatataaaatagcagaaacatcatatggaatctttacacaataaaaagttaaaatcgcaatctaatgtgtccttgaagcttgactcatctggcaaatgataaaatcaaaagttatacaacttttatttgactcatcatttcatcaatcaccagttatcagtacatgagcatgggcattcgactgataaaacggctgatgatacaacactacagtacagattacccaaagcacgacaagtacatcagtttttggcatatcaacactacggattatacagagaggaagagaaatagacctcggcgcgtcgccctcaaatggtgtagtccgaccactgtcgaatgaaggatgtgtgatccatggattccccgggcatgtcctcatccttctcaacctcaccgttcttcctgccaatcaacctggctggattccccaccgccgtgttcctcgccggcacatcta

SEQ ID NO: 41587 - DNA, 1745 bp, Oryza sativa
gcgcgggagggaggggtgggagagcacggtggcgtaaagaaaggacgcgagcgccggctcggcgtcggcgtcgcggcgcgcctcggccttgatctgggaccagacccaggactcctcgtcctccgactccggcggcgcgaacgccgggaccacctccgcggggagcgacggcggcgactggggccggcggtggctcgcgccgccgccgtcgggctcgtgcgcgtgcggctggccggccggcatcgcggcgcggtgggatcgggtttggtgggcggcgacgcgagcggaggaggaggatttgcgggccactaccactagcatcggacgccgagaggccaaggcgtatataggcgacaagtggagcgattgcctacacaactcagccatacagacacagtgatacagattatatactgggtgtcgctaatgcgcgcgcgcgcgactagtccagcccttacgtactttgtataccagttttatacgtatacgtataaaatttatatttactactccctccgtaccctaatataatgggttttaacattttgcttgcactctatttgtgtaaatataaaaaacaaaaagttatgcttaaagtactttggataataaagtaagtcacaaataaaataaataataattccaaaatttcaaacagtgaaagaaaaatgtcaaaatcccttatatcaggggggcggagggagtagaaaaaaagacccgtgcgttgcaacgggtaaatgatattttaatcgtattattgttatactatttagttaggataaaattgattgtggaaatttgcttgaatattttttttagaaaattatgagctgcaattaggagtctgactttatctcaagttagcatgcgagttttttaaaagtttcttatacaactcattttgtatttaaaaaagcaaacgagcttaaaatccaactcaaatacggatttgtatttgcaaaagcgaacgaacttaaaaaccgactcaaacacggatgatgtaccaaaataccggcaaaaacatcttcaatttttataatagtagagataaatgtaagtgtatttttatgtatgtatcaaacagaattatatgtgtaaattttatatgtatacatatgtattttggatataaaaagtttgctcgcatatatacaaactttgtatatatatgtgtataaagtatgtatatatacatatacgtgtacatatatatatgtataaaaaattttggatagcacatgaaaaaatgcaaacaagccgagttcaatacaatatgaaactttctactttatagaaactttgtatagataaatttcgtaaacaagaaatcagctgtttcagattgggccacaatttttcttaaataagcccaaaaaaagaaggtaaaagaaaagaaaaaaatcaataaaaaaggaaaagaaacgagaaaacagtgaactagttgcgcgggtggagacgcgtgcgtctagtcactgctccctccgtcccaaactaagtgcagccatgagtttccgtgtccaactttaatcgttcgttttatttaaaaaatttttgaaaaaactttaaaaaataaccacgagtaaagtactattcatgttttatcatatcataacaacaaaaatactaatcataaaaaaatttcaaataagacggacgattaaagttgggcgcggaaactcatggctgcacttattttaggacggagctacctaattagcattcgcgcagatttctacatagacctt

SEQ ID NO: 41588 - DNA, 12704 bp, Oryza sativa
attcctgcagccccagattgacctaaagcttcggcagaaacagcatgtagttgtggccatgttgacatgatatggtgggtttggacttgtagatgggcatatgtacgtactcatagaggcaccatacctttgtcactgacaggtagactcagggttcatcggacccacatgttagtgacaaagacacatatctttaaaggtagaggagcctgatccggagtgttacgggcttatggcgcaggtccgatctagagcatcacttcacaccgtcgcccttcaccgtcggatcatttcgacagacgtatagcaggtctcatttttccataactgtaattgcactggaaattcgtatagtggcactggaaaaatactaatcataaaaatttttcaaataagacgaatggttaaacgttgaatataaatagtgcaaaactgtacttattttgggacggagggagtacttattctttttcatgctgtactgtaacaggagccgttcctacggctacgagcgaatgcagcgccagacgcagacggtccatctgtcccacactcactgtcgtccgggccccactccccccccgctccgcgccaacgccggtggggcccagaccaccgccagatagccccctccgttcgtttggccctccgccttcccggattgggattatgcagtcgactgcaccgtgtgccattgtcactgacatgtgggccgcgcgcggcgcacgagacacacgccgccctcctccttccagttcactccactccgctactttttccaaccgtcgccccacgcgaaccccgacgccgcgccccccttccccagcctccgcatccgattcccatggcgtgcttggcggcgggcgccgaggcggcccctctcctcttccggcggcggctagcgccgtccccagtcgccgcgcgccgccgccttctcgtgtcgtgccgagctcgccgccgcggtctcaggttggtagcccagagcgcaggatcgcgtggttgcggcgtggtcggtgcacccggttgtgattactggtgtgttgcgtggtctcgttcgttcgttctcagtagtctgctcctgcggcgaaccgggggaatggccttttggggtttgggttgggttgggttgggttgggtgacaggggatcgaggaattcaattcccttggtggtgcgtgcttgtatgcatagaatgcttcgatcgtgaccaagtggggatcatcaacctctgaatgctgctctcctaatattgtttggcttaggttctgaaatgcttcttaatcaccggaatgttccacctatctgagaaaatatcctagcttatgttgtgtaatcatgatcattgatcaaatcatcagaaatcgatactgtcggaacgctttatatttgtacatttttgttgttttgattcatagaatatgtcaagaaattctgttaagcttagcttcatttttgcgggttctaggactgctgcagaacttcctcggaagagtacaagtaatgataaacaccataatagggtgaatatgcagagagatgaagcatctgtttccagtgataaagaacggcaagaggtaccacagcacattcattagcaatttcatatgttttccgattttgtgagattgatataatatttgggccaatttcacgatactatgtatgtggtgtagattgaagtccccaaacactcaatatcccccttttaatacaattttctgtgtttttatattatttttacataagaaactgaagtgaaacacattgtcactaaactagctaaacaatttaatatccaaaggcaatacctgatattggcaggctatcttcacagaaaaatgccgggtcggccaaaggttggccgaccaatttcttaagattggggagaaaaacaaaggaatgttacagcgacattacaatgtcgcgctagtccgggagagatcccagacacagcgtgaacaagcgaaagagaaagagacaccatggatgcagtagttatcatgaagttactgtttgcgtcaatttcgtctttatttttatgtatgctcctacttgttcactgttgcttcttttaatattttgggctttgtgtgtttcaacagaaatatggagatgaaaatggtatatcaaaccttcaattggaagatttgatacaaatgatacaaaacactgagaagagtaaggggctcctttcttttggataaatgatatttataatgttgtaggcatgcacataataatcattatcttcaaacgtatttgtttagatataatgcttctgaatcaagctcgtcttcaagcattggaacatgttgaaacagttcttaaagaaaaagaagacttacagaggaagttgaaaattttggagacgagattgtcagaaacagatgcacggcttaagctttcagctgaagggcagttcggtactgagattaatgactctctaccagtactggaattagatgatataaaggaagagaatatgctactgaaggatgacatacaatttctgaaaacaatgcttattgaggttgctgagacagagaacagtatattcacattagagaaggagcgtgctcttttagatgcttcgcttagggagctggagtctagatttatagatgcccaagcagatatgttgaagtctgatcctaggcagtatgatgcatggtgggagaaagtagaaaatttgggggacttgcttgagactgcaacaaacaaagtagagaatgctgctatggttctgggacgcaatcatgatttggaagataaggtcgacaaactagaggcatcgttggctgaagcaaatatatcaaagttctcttgttattttgttgatcttttgcaggaaaagataaaatcagtagaagagcgcttccaagtatgtaatcatgaaatgcattctcaaattgaactctatgagaattcaatagcggaatttcacgatattcttagcaagctagtggaggaaactgagaaacgatcactagagcattcagcaagtagcatgccttcagaattgtggagtaggatatctcttctgattgatggttggttgctcgagaagagaatatcctacaatgatgcaaatacattacgggaaatggtcaggaaaagggatagttgtcttcgggaagcatacttgtcatgcagaggtatgaaagatagggaaattgtggacaattttctaaagatcacattgccagggactaggtacactttctcctttgctagtaggagtaaagcctgtttataggataatactctgtctttatttagttttacaatttattgattaatgtagttctggcttgcacatcatccacatagcagcagagatggctcctgttgcaaaggtgatccttggtactcccttcaacctttcatcacgtgcatttcatttcattactactcctgacacaaatacatttctagttagtatattttgatatggttctgctgattagatgtgaaactactgatgtgatagttgactaagggtctaattggtagcctgggctgcggctgtgctgcagtcagctgctacagtcccttgcatgcagcatggcccactgctgctgctgaggctgcagctgtagttttggaatttgatttgttgttaatgctgattaattgaaatcctatcagttactctttaagtttgcttatatgcatgattctttaggttggtggtttggcggatgtgatatctggtcttggcaaggcacttcagaaaaagggccacctagtagagattattcttccaaaatatgactgcatgcagaatgaccaagttaataaccttaaggtatatagtttgtttctcaccgaagtttttggtcgcttcttttgtttgtttaagattttatttttctatcatgcaggttttagatgttgttgtacaatcctactttgaaggaaatttgttcaacaacaaaatatggactgggactgttgaaggtttgaagcatccctcagttcgacctttctgtaaaattaagtcataacattgaatcttcatcgacctgactaaatttagcatatgcaggccttccagtctattttatcgagccacaacatccagcaaaattcttttggagggcacaatactatggagaacacgatgactttaaacgttttgcatacttcagccgtgcagcactggaattactttaccaatcgcagaagaaaattgacatcatccattgccatgactggcagactgcatttgtggtacgtgtcaaatgcacttggctgtattggctaattgaccactgaaaatggatcatgctcttcttggttgatttgccaagttaaagatattaatttgctcatcttttactttgaaattccaggcacctctttattgggaagcatatgcaaatctgggcttcaactcagctagaatttgcttcacctgccataattttgaatatcaaggagctgctcctgctcaagatttagcatgctgtggccttgatgttcagcaacttgatagggaagacaggatgcgggacaattcacatggcagaataaatgttgtcaaggtactgaccattgaaaccgtgcaatagattgaattcaaatttcacctgtatgataccaacaaggttgttttgggttcattgttttcagggtgcaattgtgtattccaacattgtgacaactgtatcaccaacatatgcactagaggtgcgatcagaggtaattttcttgtaactttagttgtgtgtatttgattaactttagtttcagtagtaccttctaatggcgagattagtgtttctcaaaatttatataccagttttttttttttgtgtgtgtgcatgtgttttatgtgtgtgtgtgtgtggtggggtgggggtgggggggggggtgagagaagggaagaagaccataagttgatgcacaattcatgggaaactaccacactaccttgttgttcattatgcagtttatttattccagtggcattcctacatgaactgaaataagctgctgcatcataacatagggagttgtttaagagcttgactgcttgataaatccctttatatgtaatgctatacatatcactacatcagcatatccatagaatgcctcaactatcctggactcctggtgtttctagtttccattattcaatatgtcttataccctatattgttacaagtgttctaaaagcagtacactaggcaccaggtagctgccacgattagcatttaatggtgcattaggcgtctgcccagctttgggggctccagtgttgctatattaatgttctattgtctttcttttatgtcatatgctaattgcttggaagccccttgttaagttgatcctaggcgcacctaggcactaggcagcgtcttgccgaccatctaacgtctagtgccttctctgattagaagttcattgtagtagtttcagtttgtaagcgaagtctgttggcattctgttattgacaagctcttctggtgctcagggtggacgtggactacaagattcactcaaattacattccaggaaatttgttgggatacttaatggaatcgacacagacacatggaatccttcaacagatagacatctcaaggttcaatataatgctaatgatctccagggtaaggcagcaaacaaagcagctctcagaaagcagctaaacttatcttctacaaatgcttctcaaccactggtacgatttttaatcccctcatctactgctaaactggatacagaaattatgaccatgtacctgtacttgaattaagaattttccctcttgtcagctttgcagtttattttagctatctggttttattatattcccttttttttttcaagtatggtttacctatgtatattgataaaacagaagtgaaatatttacaaggtttattgctttctttcatttgttatagaagtttcgctttcaattcaagactaactacacactaaagtttccttgagcaggttgggtgtattacaaggctagttcctcaaaagggtgtacatctcatcaggcatgcaatatacaaaacagctgagctaggaggacagtttgttcttctgggctcaagtccagtaccacacattcaagtacattttcttctgaactatagtagggtcagctaacatgatcatatttgaatgtagagaaaaggaaataaaaaaaaaaacttaactagctcgtgaacaatctatatatctaaagctggcgggtctccccgccagctgattggtggattttgccaccatcaatctgttgacacgtgtccatttcacattggcgcgcagtaaacggatcctactaggcttcgctggtcttgcgcatcagcccacgccgattggcttgccccgcctggacgctctattgatttgctgacagatgggccatccttaaaatatcctaattattaatcctctgaaaaaacaactgagatgggccatccttaagagctacggcagcacggttagaagtcattgggaaaaatatatgcatgtaaaaacatgcatgtgaagatatatacgtgcaccaatttgaaataggaaattttaatatatatgtgtatatataagccctattttattattcgtacatatgacaaaattatactaccgtcacataataaaggatgacaatatcacaaaaataattcttattcttacgtaaaaataacaaatgtataaaaaacaatccaaaataattttaatgtaaaactgcatacctctaatcagtaaaaagaacaaagaccaaaaaatacaaactatgaaaaaagacacaaaatcaatctaaaaattatgttctaaaattttaaatttttaacaaataggctatgagagtgcttaccagtttacaacttcctttaatactattagtccaaagtatttcctccagttccataattcttgatgttttgaaaaaaaaatgagatcaaataattaatttgatgacactaaaacttggtgtggtgtacagattggttaaaatactttagtaaaattaaatattgacctatttattatttatattattatagaaattaatagtaaattatagatatatattttgaggtccatttaattgtccaggggtacagagtccccgtcaaatgtagcatttttaatgaatcttatataaaataaataaatttgggtaaaatctataaagagaaataggctaatcagccggcgtgccaaaaggcacgcctattttctagtctgtttatatggatggagcttgttttttatttgaaaaatagttgctcttgctccttttgttgaacacctctttacttattgttgctatagtgaacatgtttggtgctaatttactttgcagagagagtttgagggtattgcagaccattttcagaacaataacaatatccgactgcttttgaagtatgatgattctttatcccattggatttatgcagcatctgacatgttcattgttccatccatgtttgagccatgtggcctcacacaggtgtgcctttacatacttatattacgtagtttgtattaaatgtaaatactgaaacgtgccatttagcattatccgtaatctgtttctttatttactatgcactctatgattgtcttgataaattatattcctagatataaatatgcaatgcaagcaatttctctgatcgtacttccatcttttttttcctatttggtagaggatttattcttgccttattttttttgaggtgtatgatatatgatccaatacctcataatatgatcattgaaaacttttgaacacaattcagaagtacagagtgagaaaaataaaatgtgccaagatgtttttccaattagtcaatgaaattctgccctttacccttgaaacccacagtagaatatgttctcagatttgaagaatttcatcaacacaaaaataaacatgtttccagagctttccaaaattcatgagcacaagcttgcagttctgcaaagctgttcttggttcattcctgttgagcaattctgacatgttctgtatccacagatgattgccatgagatatggttctgtgccgattgttcggaaaaccggtggattgaatgacaggtaaatagttattaattaaccaactatctcccaatattattctccttaataatgtaaaatgcccccactcacctgctttgcagtgtcttcgatttcgacgacgaaacgatacctaaggagctgcggaatggctttacgtttgtgcatcctgatgaaaaggtggatgtcgtttcagttcatctctcctcttttggtggacacaactcatgtgggtgttccttttttgacaggctctaagtggtgcaatggagagagcgttcaactactacaatagaaagcctgaggtctggaaacagctggtgcagaaggacatgaggatagatttcagctgggcctcttcagcttcccagtacgaagatatctatcaaagagcagtggctcgagcgagggcagcagcatgaactctggcggtttagtgagacctgagcctttctctgacgcggcgcttgatgccacaggcacagattctgccttctgaagaagccgcaccatgcacctctctgatgtgcgaacatggcttcatctgcagcttcgattcttggaatggaacccaagatatttaaagacatgatccgtcagactcatgcaggaagccgagatgttccatagtgcagttatggaatggtcgaagaactaaaatcttggcacccattgtcgtgtcccagtgacagtgtggactatacagttatataacttatagtacgtgattgctcagtcgtgaaatttcactagcctcgatatatttatcatgcgctacggtgaaatgataagttttgttctttgtatcacttgcagtgtgctttgttatttgtgcaaagtcgtgtgtgttgtctatagaatattctttcgtcaaaagcaaagagatgagagacagaccctgttttttttcctgtttgaactctgaaatgtagaaaaaaatttcataggctctttgaaatttttttagagaacactacaattcatgtagaaaatttcatgtttttcttctctgatgtactcccaccgttaaggaaaggggatatttccattcggtcacaacagtagtcaaattttaaattttgaattgattggatttctcttctataagttttattggctgaaaatacctagatttctgtgcattaaatcagtatccaaaaaaaatatgtatgaaaattgaattccagaaatatttatactcctagatttaggaaccaagagaacaaaaatagaccaaaggtagcggaaccaatggtctgggcctggtcctgggcctgggcctgttcccatatgggcctcacatttcgcttcggtaaaaccgcctcatcattcatcacgtccatctatattctgccacgtggcacagacgcgagccgaccagaccagtcaactttctagtttctaggagtactgcagtgtggaggcgtgtccccgcaccgctctcctccccctcccccctctcgcctcgccgacctctccacctccccggcgactcggactcgtcgaagccgcgctcgcctacgaccacccatggcgctcctcccccgcgcggcgcggctggcggccctctccgcgccgcgcgcctactcgtccgccacggcggcggcggcgggcgcgggtggctccgcgtcgcccgcgccatacggcggggcgccgccgccggccgcgaactccaaggcggcggagttcgtgatctccaaggtggacgacctgatgaactgggcgcgccggggctcgatctggcccatgacgttcgggctcgcctgctgcgccgtggagatgatgcacacgggcgcctcccgctacgacttcgaccggttcggcgtcatcttccgcccctccccgcgccagtccgactgcatgatcgtcgccggcacgctcaccaacaagatggcccccgcgctccgcaagtccgtacacttgcgccctttaccttgcgttcttctttacatataaccatcaaatttgtgatttatttcgtatcgtctctgagagaagagtagcaattttctgttaggatgctctattttgcactttgaattggttggtgatgctgcttatatagacttcggtagaggagggcgattggattggggattttttttttgtcatgtcaagttgcatacgatgtttaatacttcattgtgcagattcttttttgccgggtcggccgaacgaggccgaccaatttcattaagaatgattctgtgcagatcaatttttttgcagattcttttttttatccttataggcgtcaatcccttgcgtgttcctcataggagtagataaatttgcgcttagtctgagcttcccatgtgttcacagcttcggttttgtatggcatatgccgttgaactatttttcctcttagattatatagagaattgtatactggtttagcatgcgtttgtaaatcagaggcacgtgcattttttagtgtcaggaatagaacagtgtcgtgcttgttcaaatatcataagggttcattgaatagaataatggttttccatatcaaaacatgagccatgtgtcttgtgaacatggttgatgtaagtacaactgctaaatatgcattcatatccacttctgttagttgaaagtagttaagttttgtacttaaagagtgatttcccttcattgtttcttttatttgtagctatgtagtaccaatattagaattggtactgtttctaatgcattattaggacttaggatatggagagtgcaattcgtttaaatacattttgaataaaattcataggtacttcgatgagtttaaacacctcatgaataaaattcataggtacacagtacaataatattttgtgtgctttatgtgttacattccaactttctatgctgaaataaaaacatgtccatttgcttactcagagaatcccatgaaagcaacaaatctaaatgtatgcatcttgtagaagaaagattgctggttccttagtggagtatggtcacatactttaattaattgtagtacttcgtccaaaaaaaacccttcaattgtagtacctttgcaaaatgtatgtatatggttatcctagggagtatagctatttttcttataggaatttggtttaacctctgcaagtgtgcctatatggttaccctacggagtaaacctattttcttatgagaatttggttctgattgccgacatgtttattgctttttgaaagaacagtgttttttgtgttgatgatctcatggttctcaaatctcaatgtgcgtgtattatgggaatcataaggaataaggaccaacagtaaaaaacataatattggttggagacctttaaaacatgcgtacatgtaatttttatgtgaactactaactgacagacacctgtgtaaacttggtgaccttctccttagtggttgtcttttattcactaccagctcaataccgatagtcgcacagctatagtttgcaatgttgctgacatttgtagctgtctgttgttctctgcagggtttacgatcagatgccagaacctcgatgggttatttcaatgggcagctgtgccaacggtggtggatactaccactactcctactccgttgtgcgcggatgcgacaggattgttcccgtggacatctacgtccctggatgccctccaactgctgaagctctactgtatggcgtcctgcagttgcagaagaagatcaacaggcgcagggatttccttcactggtggaacaagtgaaccagcacttctctgctttcctatctgctacgaatacgatcctgtcaaaatgttatcgagcttctgtgttaaataaaggaaagcgtgtgctttccgatcatcaaactctctgtagtagatgcagtgatagtgagctcctggctaccttgatcaccgttcatggacaaaaaaacaattggtgatgctgttgcggtgttgctgctttaatactatgtataatattttgtaatttgtgttgtcttctactagtgatgtaacattgggtatgacgctcaatggcgttgtgatgctgtatactttaccaacttgtgtaaatagaagtgatgataatataaaaaaaattaatagaagtgatgataaattgttaatggctgctatatgttctgatttctttactcatcagtctatataacttgtatattggagagttcagaagttaagtcatgcgtactttttgttttttttctttttatcccaatttctttctttttaactacagtaaatataaagatagaatgtacaattgctgaccttgcacgatgacgtgatatgtccacatgacgtttttatggcgtttcttttggaccgaaggactatgttaaaccaattgataaatcttgagtatttgtttggataatttaaaacatcaaagactaaattgaccatggggcaaaattccaaagcctatatcactatatgggctattcacccgcagataaagtaaaaactatccgggtaacaaacgaatagtagatagtaggaaacacctgaataaaaatactcctaaatcaaatcgtgatttacccaaactaaaccggctttgaccccttccccaagcctaaaagccccaacccttttatacctccccacaagagaggcaaaatccgctcgctctcagactcgcgacgccgccttcttct

SEQ ID NO: 41589 - DNA, 1267 bp, Oryza sativa
gacccgcccaccatcgagaggtgccaggagctctccaagcagctcttctacacccgcctcgccaggtcggtccaccctcacgatctccctccaccttctccacgatctcttagtcctccacatctgaattatctctattgtttagattgcgcactccattagaacacgatctcgatcacttccacattatggaaggccgaatatgggattctaatcatctatggcgaaacctaattatgttgcctaattagatagaccagcaattttggctgattgttttaattgaataaattagcagcacatcatgtaaagtgacaatgcaggaaattggtaccattgaaagtctggaaattgcagtgttgaaaagtgtgttatttttggtgatgttctcctgctatatcggaagttagaataatgatcagcgatgtctattccatccatcctaataatggaatctatgcttcccgtctcttagaagctgagcaatgcataatgcataatggtcatgttgtgaacatagtccatagtgatgcattgcaaccgtgttttgaggatgttaagtatttttgctgaacaagttgtcacgttgcatgcaattagccatggaaaacaagttcctcctaaattctatgtaaatgaagacgcaagagatgggtagtgggtttatatggtaatgtgggttgaaagtcactgatcttggccttagcaagattgatctgatgagaagcaagctttatttgagttttttttaactgtgagaaattactttgttttgagccaatgcttttctcttggacagagtcccagggatgtaattgttcctgatcagccattttgtcttcatttgtcttttgagaagaccgatactagttatttgtttgagctgcattttgcttgtacttcatagagatagagtagtagtttgtctatttcaccattattattcatccgtgttgtgctaaaagtgcgccttcagtgcacattcctctggttgtctttgccagtgctattatgaattataatatacatctgatatggtgccataatttgatgattcattacataggtgacagaagatacttgatcattcatttgataccataatttcactcacattataaggtgcatttcgtatcttcaatctctgtgtctttactgactagtgacacatttcttgcagccttcctggtcgctatgaggcattctggaaggaagcggatcaagtgaagaacttgtggagaaacagaaaggatctgaacgttgagca

SEQ ID NO: 41590 - DNA, 1175 bp, Oryza sativa
aaaaagtttccacccaagcacgagaaatataaaacattgtcaaataatatattggatgaatggaagatctacaagatattcaagtccaacaacttcaaatggacctagcgccttcatgtcaactccggtttggatgatcttgtacttgttggaaagcggtgcgtcgtcaccttttaaatgcttctggtctcatatcaaaattcatctcgagtcaacaggaatttcaaaacaagacagtttgaaactgaatttgggctttgggccttgtaatagattaggcccatctcggaagtgcctctctccacctccacgaaccagcactaatcctagctttattttcctttataaatagctttgtacgccctaaaaagaacaattgggttttgtttagttgaattttgccaagagtcattcaccttgtctctagttctcgttcgattagttgacgactatagattcagagcccccaactgttatgtgttgatttgtcggatcgattagatctatcacttcaatcgcaactatatatttgtgcttaattacctattcgcaatatttagattgcatcttatcttgttcttgtagtgttctctgatttgcattgcagggaacgtcaaccacgcgtcatggttggtacgatatcgtttgtggcatagtgattgcacgatgtcatgaacttgttctggttggtagccatgtcgcaaacatcatattcaatcaaagtgagagttatcccattaccaaaaaatgggccacgggagagagtgagtgtcatcactactgtagcaaactgttaccatggcttaaaaaaaagtaaaattaaggggttgttcagttcattgccagaaaaaagaaaaccttaccatttgttggtaatccaaaatttagtaatgccaaatttttgggaagatcacaatgtggaggtggtgttttgtttgataccttaccaaattttggtatagttttgtgagtagaagtttctagaattataaagtttgtagggattgacaagattgtaacaataaagtctcatttagtttgttgttttggaaacaaagtaaaaaagccctgaattatactcataacattccaaatcggtaaggaataagttcaccgggggtccctcaacttaacagtcagattttttaaggtcccttaaccacaaaatcagaaat

SEQ ID NO: 41591 - DNA, 4467 bp, Oryza sativa
attcctgcagcccataaatccattttcagatggttaagctccttgtctgcaaaatccctttgttttgtaccctatagaatctgcatcacagtaaagctttctgttaatcacgtcgggcttctgcagtacatatgaaccagctgtcagctgtcactttattcagaggaacctgaatctgcttgtgccagccaaacagctttacgaacaaggtaagcccaatcaaatcacaaacgaaaccaaagctggcagcacgtaggaaacgctttgctggtaacagaagggagttcaataacagcctacaaaattctgaaacgtaacaagcaactccgatatacaaattcgactgacatatcggggactcttgaccaaatgcgacaccattatttgtttgatcagatcagcacttgcacagtgatttacggatagacaaaattcaaagttgaccgcaaacataacttgatactgcaggcagtacatgcatttcacttccgaccaagagtggggaattgggattggtctttgatttctggagctggtggagctgcagagcgatggccctcaccatatccacccctgaaaccgccacgatccccgcggcccctgccacgaccacggccgccatagtacctctctccttcagctggttttaggaactcgttgatgctcacagactgaaaaaattgacccccaatcagtaaacactgagtacataattaaagcatttcttctaattgaaagcaccaaagcatgaagaatcccaaatgaacagataataggctaacagcagatcagacaaaatgtaaatgaagttgtaacagcagttcagacttcaggagtgtaaaatgaatacaatacaaaaggcaaagtaaatttaccatgaccagataaaacaggctgatggtaacaagtggttgattatgccagaatattaatagtaaaaatccattagcttgttaggggagaggtagagatatctaaggtaagatgggaacatgtaataccttcttagcacgctcatcacgttcagcattttctttcttcttcaaagcatccttgtcagatccctacagcgaaaaattatcagtccatcaatatttccatcggttgaagagaatggaaggattacaaggcgtaaatggcaaaggtaccagtttgatgaaaacttcatcattttctttcttattggaaagtggttgcatagacttcaaatccttgtcaatttcaaccttcctctcttcagtcttcaaagaaagaagtgctttcctcttctcctcccttaatttctcaaactcctcaagagtcatttcctatatcatcaaacatttgaatcataagagaggaggtatggacaaatataatacactcctagacgactgttgtaaaaggaagttataggagtaattcagaaaacaagggcacaattcacctaaaaattagtatgcaccaaaattatttgttcaaaaagtactcacatatgagcacacaagcaatcaaaagaaaacaagtaaccagccagaatggtttcagcttagagtactgttacttcatattgtggccaacctacaaaataattatgacaaacttatggccatatggctatcaaaatcaatacttcattggacagttgtttgtagtcagaaatggagagccctcaaagtctttagaagatctgctactctcatttttagccatttcctcagagaaaaaggaagtcattaagccatctcaactttgtggctgctggaaaactaaaaattgtgcaagtaccctttgggaccacagtgactaacaataaaaggaacattttcacacataaatccaactatgactaatcaggcaaggaaaagtgacatttttgaagccagcaacaagtcatgttcacaaaccttaccaattggcaagttcaaacgaattatattaacgtgtcttactttctataatactaaagatatagtataaatctaaaaatctgcattccatattgatttaagtgatcagaagtataccttatcctcttccttttcttcctcatttggagtgacatctttgttatccttgttctcatctgcctgtggagcaccctccggtgcgccttgcttctcagtaacaggggccttctcatccaatttcagggcttccccagtttccctgaccaatcaaacaacacaataagtacttatatctccatagtatggacatgaacagcttaaatgatgagccacttactgggcgagaatttcatcagtggtagttccccagttcccacgccccgaaccctcacgcttcatctcatacccacggccagtgccgctatggcgctcatatggcctccgagacatcctctcagagtcatcaccatacccacctcgtcgacctcctccctggaagggtggccgagggcccctctccctgtcctgagcgccttcttcacctccagctctgctaccaccgcctccaccatatcctccctggaagccattcatttcttcacctccaaagtctcggttttgaccatagcctcgcccacctctgcctcggccgcgttctccgcgcccataccctccgcgtgagggtgcactgccatctcgagactccctcactgaaacaaaacatgtattaaacataaccatttcactaagtaaaaagaagccttacataccagaaaatggtaaaatgaaatcaaaactcatatctttacaacctacatatccatggaatcaaaattttatgctgtacggaacaatcgttagaagaatcctatataagttgacaagacccatcatttaataatcctagagaataagaacaggaacaaaagcgaacgcgtatcccccagatctagaactccagaacctcaaccacaaaactcaccggcctgtgaagggggagccggcttggtggggaacttggaggcggccggatgcgaggagcccttcccgccgcccggagccgccgccgccgccgcggccttcttcgcctcggccttctgcgccgcgacggccgccttggccagcagctgcgcggggtcgtcgttgtcgtcgccgccgaggaggtcaaaggggttcgcggtcgccataggtgcgagttcgacggcctacaaaaaaaatcacgctacaagctcgctatcttcgtgtgtggggtgggtgactggggaactgacccctcctggctacgaggctcgcctgccggactgcatcgccatggctctccagccgccaagatcgagggcgtgggaaaggcaagagtcggcggcggcggcggcggcggagagagagaggagagagacgtagtgaggggggagagggtgtgtttgtgaggaaaggaataaaaccctagccgcaatcgcgctttcttttttttttttctttttgcccactagccgcgccgagccgagtccatatcctctcgctatcgtttcgcccgcgtgaaattacctcgctgcccctaccttcaacgcgacgtttacgcgagtttaggcgtgggttttgaagggtagttatggaatttgattttcgtgtgggccctacggatgggtgggggtgctgccatcctgggccggacccggggggtacgttggtctattgggccggaacgggatcctctgtggtgtgtccaagctgaggaaattatactccctcctttcctaaggttgttaacgattttgctatatatttgtcgacaaattttctctaacaaatttgacagatataattatagtataattgtagtgtaattacactgtaactatagtataacttgtatgtaactttcaaaaatctctttgtaatatgttatttcgataaaatggaggttgtgggaacaaatccttacatatatatgtgtgctgtgattttttttcttcctcaccaaaataaatcttgtaatagatttaacgattcaaaattacgtgaaacttatatacaagttacactctagttacatgcaagttacagtgtaattacatataagttacagtgtagtgtaattacttctgtcaaatttttaggagaaaaattgtcgtcaaatgtataggtggtcccggttgttaataggctgccttgttaatatgaacgaaagaataatgctcaagtttcacaccatccttgtatttcagtgcaatttttgatgtgccagtcagataagtttgtcaatagtttgtcaggataaaatgtactccctccgtcccataatatctattgtcaatggcaatctaggactgtttcgttatactatgaaatgttccatccggtactatgttgctatattatgggacggaaggagtatcaaataagaaaaactgcagcacgggaaaaaaaatcaggattaattgatagtacaacactgatagacatcttggacactgaaagatattatgaacagtcaaaacaacaaactagaactattggtttggttaattaagagttgaagttgacaacagactttatcttaagtaattagcctcaaaca

SEQ ID NO: 41592 - DNA, 1228 bp, Oryza sativa
cagcgtaatcggcacagtagctagggtctttgtttcacccagatgagctcaaagcatccagagataacaaacctagctaaatcaacaacatgcagcaccaaatcatccaaaaaaaactaactttccaccaatcagttactccccagcagaattttttttagaaataatattattttaatgaaaaatcacaaaattagtggccatccggaggaaatcgcgaatttggggaccggtcgaatagctgcacttcgataggccacctatcgaatggcaagcgttcgactagggctagtcgaatgctggggattcaacagggcagcgtattgaacggagggagttcggctggtcccaccacctggcgccgcgcggcttgtcgaaccgggggcgttcgacaggtcctctccaccgcccctgtcgaacaatgggagttcaacaggcccttttaaaggcgcgtccgacccggtcgagctgttgtttcattgttatcaggaccacatcgccatcgccgccgcgagtcaccccttgggtcgccgtgcgtgccggagggagcgatgggagggtgtagcaggccggagagaagcttgagcaggcgtcgcccaggaggaaagggtaggcgacggtctcaaccagcaaagttaaggtataaattactaatccctaagtatgaggcctatgaaattaaaaagggcttgtgatttgttaattgtttctcattgttcaatgttagtgacggagcgtgaggctcctcaccgggagaccgcgcaggcccccctttgccggttcggccgggggcgctgagtgaggttcttcaccctcgatctgtggaatgtacgcgagagagcaaacgcacgagacacaggcgatgtagacaggttcgggccgctgggaagcgtaataccctactcctgtgttctggtgggcatgtgtgagaaaaagttacagagagccggcaagcaagagagttccagctctagaacccctcctttttcctcctccttttcctcctctttttcttctctttccttttttctccccctcttctcgtgggcaaggtcctccttttatatttcaaggggataccacatgcaccacttctaactactcttcctttgggtggagacccaccctatcttgaccaaatcttgacacgcgcctccgccttgaagctgaatcaacgcctgtctttgaatgatgcccagcgccgtcacttgtcagacacaggggatca

SEQ ID NO: 41593 - DNA, 4632 bp, Oryza sativa
tgttcatcccgcaataaatgcggttaggtgagcgccgctgtgcccacctaacccacacacgtggcgccaataccacagggggtcggggcgccccagccctcggggccgaaacaggagcggcccgacccctcggggagacagaggagggggtggccaagtctccctcgggcccgacccccccgagggggtcaggccacgtgggtgaccgcggctgcccaagcctctagtcacgatacccccgatcccatgtcaccgacagtagcccccggcgttatgccagggcgatcgcccccctcgagggaagcgctcgggcgtgacgccactccttaggtctggtgaccggtgggaccggcctctacaggcgggcaggaacccagcggtcgcaaatcgcgcgcatcggctagggaaaaatgaccgataataatgagtggcctcttcgagaccgctacatttctcgaaatagcgcgcgaatcgggacgagccggttcatttcgcctggagatatgatgatgacgcttcggtcggcgagcgtagttaacgcgcgcacgatatgtcccatctcgactgccacggccgcacatccgcctcgtgcgccgcaaacgggcgagtgggattagtggaggcgtgggcgcgagaaacgagggggcgagatagtgggcgcgggaaacgaggagccaggaatagcgttggcaagggtataagggtgccaaggaagagattcgtttccttcctctcgccattattccccttgccttcgccgcttgcgccctaactcctcgtttcctgtgccctacctttgccgcactcactcgttctcaatctcctcctccgccggcgtcatggcacggggctccgcaccgctcgacggtagcgtgctgccgccttcccgcatcgtgagcgagaggcaggccgggctgccgcgccgattcatgccggcatctgccgccggccgggaggcggtcgagctgggcgagggacgcccggcaccacactacccggggcggtccgtcttcttcctccctttcgcaatggcagggctggtcccaccattctcttctttcttcatggatgttctggagttttatgatctccagatggtgcaccttacgcccaacgcagtaatgacgttggccatcttcgcgcacctgtgtgagatgtttatcggggtgcgcccatctcttcggctgttccggtggttcttcaccgtacagccagtgtcgccgccgtcggtagttggtggctgctacttctagccgcgggggccggtgctgagccgctacattccctgcgtcctccgcaagaaatgggacgactggaagagcgactggttctacatccccctcgccgacgaagcgcgcctccgacttccgagccagcccccagcgcaggtctccagctggcgggcgccggtagatctgggagacggctacgacgccgttcttgaccgcctggcgggtctgcgatcccaggggctcacgggggccatggtgtacggcgactaccttcgtcgccggattgcgccgctccagcggcgcgcccggggcgcctgggagtataccgggtctgaagactgcatgaggacccaccagggggtcagatgggactgggcccctgatgacttcaagatagtggtccaacgggtgctgaatctcagctccgtggaagcatccctcatcccccaaggagtccttcccctctgcagcgatccagatcgcaccaccatcctgaccatcatgcaggcggtcagggcgtcggaggaacgggttcctcgaggccacgatggcgcgggcgggagccacaggggggaacaatctaccccgggagggggtcgtgcttctgggccccgcgacgggggcccgggaagcagccgccctaccgacgcccgggggaagaggaagcaagaaggaaccccttccccatctcctccccgagggggcggggcggcgcgtgccagcagcaggcgcccagagggtgccgtgccgacgtcgcagtccgagggggaacgaaagaagaagcggctccgcaaggtgggggagaccgaaccacgccggggaaaccttatctcccccccaaggtggtcgtttagccgacctcctcgcaggttcgtccccgcgcccactgcggctgtattcattctcctatctcccaaggcaagttttcactcatccgtttctttttgtcttctggtttttcttctgcctcagcgagattccgtcgccccccccccccccgccattccaagtccggccagtccgaggctgaggagacggcgaccgtggaggcccggaggcgggaggctgaccggcgagaagacgcagaccgcctccgggaaaccgaggaagctgcccaggaggccgtccgggctcgccaggctgaggaagccgctcgggaggaggccaaactccgccgggccgaggagtccgtccgggaggcggaggaggcgcgcgcatgccaagcggcctgccaagcccccgacccgactccacccgaggcgacgacgacttccgaggccacccacgacgaggccacgggcgcaccgctcgggcccgacccctcgggcgacgctcgggacgtgccagcttcgggagacgctcccgagtccggcacgtcgatcggcgggccgtgccacgcggcgcccgcaccgaggcggctctcccctctgccttccgctgcccgactgaacgcggagcccctcctgcaggccttagccgccgcgaacaccacggtgctggacgggctaggtgcccagatggaggtcctgcaggcagagcggaaggagctcgacgcggcgtgggcgcgcgtcgaggaggggcggcgctcggtggaagccatggtggaggcgggccgcaaggcacaccgccggcacgcctcagagctcgaggcccgtcagagggagctggcggagatcgctagggaggtggaggaggagcgggagactgccctcatcgccaccgccgtgctcaacgaggcgcgggatgatctccgcctccaatacgggagccgggcggcggagctagagaagaaactcgacgccgcccggggagtccttgacgccgccgctgcacgggaacggcgggcggcggagaacaaggcggcgtcccagcggcgcgaagaggcccttgaagctcgcgccaaggcgctggaagagcgcgcccgcgcgagggagagggacctggcggaccgcgaggccgccgtcgccatccgggaggcaacgctggcagcgcacgaagccgcctgcgccgaagaggagtccgcactccgcctccgcgaggacgcgctcaccgagcgggagcgagctctcgaggaggccgaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggtgaaggagttggacgcgagggcgcgcagcggcggggcggccgcgggcgacggcgacctagccgcccgcctcgcagctgccgaacacaccatcgccgatctgcagggcgcgttggactcgtccgccggggaggtcgaggccctccgcctggcgaacgaggtaggtcccggcatgcttcgggacgccgtctcccgtctagaccgcgccgggcgacaggcgggcctctggggcgggcggaccgtgaagtatgccgccaaccaggggggcctcgcccagcgcctctcagagatggccgggaccctccagcggctccccgaggagcttgaggagacgatcaagtcatcctcgagggacctcgcccggggggtggtggagctcgtactggcaagctaccaggccagggacccggacttctccccgtgggcagcactagacgagtttcctcccgggaccgaggacgacgcgcgtgcgcaggtccgggacgccgccgaccacatcgtccacagcttcgagggtacggccccccggctcgcattcgccctcgattccgacgaagagggcggtgacggcggtgatgaggccggcgacccgggcgtgtcggaatgagcccccaggcccctgccaatctttatatagtttttcctttcttcttccgaggccttcgggcccccttcttgtatagactaacttaatctgcaatcaaataaagaggaaatttctgtgtcaattctatttgttgtgtgtatgagacgaggatggtctgtgccgcggtccttctgtgtcttggcttgaacaagggctcgtgcccaggtcccagcctcaaacggcacgggtcggagccagtgcctggggaaatccacatgtcgagactggccaggccgggagcgtggtgaccgagggttatggatgacccgattgtgggcctttgccgattcccccccggagttcaccacgccccggggcacggctcggttctgggccccttttggcgattttagccggcccgggccaccgtgggcaggatcgagcacgagcgtgctaattcaagccaagagttttcaaaaggaaacgatggcacagacacagtccttaggaaatcgagaatgcttttattgaaatacggaagagaaaaaagataagtatatgcatgtggtagcccccggccaaccctgcacgcccggggg

SEQ ID NO: 41594 - DNA, 9410 bp, Oryza sativa
gcgcgccgccttcgctcttccaaatagtcgaggtcatctctgcgaagctgatcttgatcagcctcgcaatacatggtgacccgaggggacctcagggtgagctcagatgggagaaccgcctccgcgccgtagatgaggaagaaaggcgtttccccagttgctcggcttggcgtggttcggtttgcccagagcaccactggcaactcctcgatccacgagtcgccgtgcttcttgaggatgttgaaggtcttggttttgaggcccttaaggatttccgcgttggcgcgctccacttggccgttgcttctgggatgggcgggtgaggcgaagcagagcttgatgcccatgtcttcgcagtagccaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgatagcgacatacagatactcgaacccgcccggggcccgcctgaacggacccaggatatcgagcccccagacagcaaacggccatgaaagaggtatgatctgcagggcctgagccggctggtgggtttgcctggcgtggaactggcacgccctgcaccgccggaccaagtcgaccgcatcgttgagagccgttggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgataaagggtcccttccaccagcacgtagcgcttggagatgcgctggacgcgttcactcccttcgcggtcctcgggtagagtcttatctgtgaggtacgcctggatctcaacgatccaagcgatcaatctaagagagctgggagcgctctcctcgggtcccgaggcctggactccgacgggcctcgggggccgttcaggcgcgtccgtctcccctagggggtcggtgtcacgccctgaagtttccccctctccttgctttaaaaattggctaaataaatcgtccgaagaaattatcttaattaacctagagctaattccctaattaataaatgcaattaataattggaattggcattgtgggatttttcttgggttccacatgtcacaatatattaacaggatttttagtggaattttcagagccttggaaataatttttaccaattaaaaatcaccaaagtgcaatttttaatcccaggaaaaatcctttcttccttttctttttcttttccttctttctctgttgggccgtcggcccactccctcccgcgcccggcctcccctttgttgggccggcccaagccgcccctccctcctctctcgggacgccgacaggtgggccccacctgtcggtcgtctccttcctccggcaaccgctgctgccgtcgaaaccgccctcgtcgccgctgccgtttcccgccgttctccgcgccccactccgcccgcacctcgcgcccacgtcgccgccctctcccccgcatctcccggcccgcatgcgcgcccgcaaatgggcgggaatcgatttgaatccacctctctctctctctcctccccacgtcgccggccaaatcgggagggttcccggccacgtcctcccctccctcgcccataaaagcactcccccgagtcccctccctcgtttcccccatttgccgtcctctcccacgccccctaccgcgcccgcgccgtcacacccgagctccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcgcttctcccctcgcgagccggtgagttcttccctcccctccatctccggccggcaattcaagccgccgtggtcgtcgtctcctctcctaacgcctctccatcttctcctagggtgtcgccgccgctgtccgtgcctccgcgtcgccggtcatcgccgccgcctttcatcctccgctttggtcgccgtgctcaccggtgacgctcccctccgctcccctttttccctctctcccgtgtgcgccgccgtcctatcgcgcgtgcgctgtcgccttcagccgctgccgccgcttttcgccccgtccgtgtcgcttcctgcgccgccgattgccgtcgccggcgaccgtgcgcgtcgccgccggttgccatggccggccggccggttttgaagccgagccgagccgtgcctagccgccgccgtgccgtccgatcggcctcccggccgatccggaccgtcggtcccgtggaccggcggtggaccccccccgcgtggtcccggtccacggtggaccggccaccttgtgccgctgacccatggggcccgcttgccggcgcccccttcctctctcttgaaccgctgacatgcgggccccgcctgtcggcgccgcccccccttccgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggcttcggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcatccttttacaatgtcatgtgggataggtcctaatactcagccatttattgtttaccttatgccattgataacttgggtatcaaaatgactagatgttggtttaggaaatacttagccatgcttagttcaactagcacacacatggggatcacattattacatagactttgactatgagcatagctttggattggtgccaccgcaatggtgtgagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaagtggttggttgggcctgttgcaacgtggtgtagcgttggacagtgtttggttaatgttgattaattactacaactgttttactgccttcaactaccgtttttaaatgctagctttatgcaaaagaacctctagcttcctttggttatatcttgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatatgcatatgcccttttgcacctggaattgtttcgggaaaatttggagttttgcctttttggtttgcgggaaaaatcttggtcgttctttcggatcggattttttttttaaaaaaaagaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacccgactcgaacaacgccaatggcaggcgaagagccgatcaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccaactggggcagaagttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaggcaggagaagtttctgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcggttcacgatgggacatcacggtggaccttccaccatgattatccggcagcaccgtccctaccacccgggtagcttcaacaagaaccaccatagtggcagccacaacaacagtgagcagcacagtctcaaccctactccgagttcactaaagattccagctcaatcagttcagccagctctgccagaacagcccaagaggttggtagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggtcgatttttccagccaacctcattcttctcgaatccaaggacctagatgtcatacttggaatggattggttgacaaggcacagaggagtgattgattgcgccagccgcaccatcaagttgaccaatgcaaaaggagaggtggtaaccttccagtccccagtgccgcagaagccaaggatcagtttaaaccaggctgctggtgaagaacaagaggtagcagtggagaaaaccactaagaagctggaggatattcccatagtcagagagtatccagaggtttttccggacgatctgaccacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggagaagaaagacaaaaccaagaggatgtgtgttgactaccgcgcactcaatgaggtcaccatcaagaacaagtatcctttgccaaggattgatgatctgttcgatcagctgaaaggagctactgtgttctctaagatagaccttcggtcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggtttttatcgatgacatacttatctactccaagtccgaggaagaacatgagcagcatcttcggctggtacttgaaaagttaaaagagcaccaactatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatctttactcaacctgatttgaatcttagacagcgaagatggttggagctgatcaaggattatgatatgggaatacattatcatcccggcaaggctaatgtggttgcagatgccttgagcaggaagagtcactgcaacgtcgcatgggtagaggaactatgctgtgaggttcaacgtgatttgggacatttgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggagaaagattgtgtgtacccgaaaacaaggaattaaaagacctaatactaaccgaggctcatcaaactcaatattccattcatcccggcagtaccaaaatgtaccaagacctcaaagaaaagttctggtgggtcagcatgagaagggaaatagctgaattcgtagcactctgcgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaaatggctcacttcattccggtgcacactacctactcagggaagaaattagcagaactctatctggcaagaatcatgtgtttacatggtgtacctaagaagatcgtgtctgatcgaggaagtcaattcacttcaaagttctggcagaaattgcaagaagaattgggaacccgtctaaacttcagcactgcttaccatccacaaacagatggccagaccgagcgagtcaatcaaatactagaggatatgttgagagcctgtgcgcttgactttggtggagcatgggacaaaagcttaccgtatgctgagttctcgtacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcaatctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgaacttccctccaacatgcttggcatccacaatgtgttccacgtctctcagttgaaaaaatgtttgagagttcctgaggaacaggcaagtccggatcacatcgaaattcaggaagacttgacg

SEQ ID NO: 41595 - DNA, 711 bp, Oryza sativa
cattaaaaaatggcttgccaagaataaactgcaaaagcaatttctttgtcgtgttattttgaatatgtctagaccaataattgtacttactgagtgcttgttgatagcgttcattttctctttggcagttggttgagattgtaccttcagctttggtgctgttcatattaaggaaactaccacctaaacgggggatcacacagtaccatccaatccattagatcagtccagggatccccaatgtgcccttgcaaattgttccttcaaactggtgagtacagaaatgtaaatcttaaccacggatttctttgtaggtaggttgcttggttttcatgtgaaaaaagctcaacaaaaattctgggatatatatagtttgtaaaaagtctaacatcccgtcatcccaaattcctgcaattgctgtactgcgacccaggagtattctgcaactacaggttttcttctgtaaactgaaggacaaatatgctttgattatttgtttgattatttgtaataatgtcagctttggtttattgttcctggtaaaagccccttgcacgcttcctcctgactccccagtggtacacattgttcattactacctttttttagcctggacaatactgggcaatgttgtgttccttggcagagtattttcccttttacaccttcctgttcactggattgcttatacaagctctgatcggcctgggg

SEQ ID NO: 41596 - DNA, 6013 bp, Oryza sativa
  unsure (1)..(6013): unsure at all n locations
nnnnnnnnnnnnnnnnnnnnnnnnnnnnnnnnnnnnnnnnnnnntaacatgataatgatatagcaacaaatggcagggtaaatttaccttgcagtaggcaattcacgtagaacaatgtcaagaacttgaagagcttcttgaggagcatccgcttgccttccagctaaaaacatggctaaatggtggagatcagcgcgtgcagcaaatttgatcacgaccttaaatggtctctcacgcctgaagacaagcagatgaatcattggaagatgaatttatcaaattgttgaatgttgatatgtccagagagtacctctgtgcaccttgcccaacagcaaggctctcttcctcatcctgcagaataacgtcaaaggtcctagaagtaaatggtaatggaccagctgtgtataagctcttccttccatcatagactggaagacggccacccaaatgagactgcctatattgtgttacaatttctccaatgacagcacgattgacaccacgtgaaggaacctcaggagttatagacacctgaaagcatgttaaatgaaagctcatgaaaaacaacaaaagttacaaagcttcatatgtataagtataacaaggcaacacataaacaagatcttacatcatactggtgaaggtctttgtcaggcaattcagcaaagaaatggttggctttcacgatgcacctatcaccaaatgtacccttgccagggcgcattggaaatctcactgatttgctcgatggtggtgctggttgaatggcctggctagtggggctttgaccctggatggcaagttcctgaaactgatgttggacttcttcgctgctggcctcaacaggcagcgaagatgggccagttcttgatggtgatggtgcaaccaccgtagcttggtactggtcttgtgaggcttggtgcagctcgggaactgttcttgatggactggcaggaactccatgtccaccactgccactcctgtgttgtggcattcctccttgccgttggacaccacggccatagtactcatgtgcttgatattcaaccggaccaccacctggttgatgtgatgttggccctccacgaccctggtaacgtccaccacgtccctggtgttgtccaccaccacgaccagcttgttgagcatattgaggattggcaggttgccaaccaccacctccatgctgttgagctctctcaggtcgctgtgaaggaccccgtccaggagctccagtggcttgttgagttccagaactttccccagcattacggggttcagtttttttctttctcatcatggctaaagctgcaatgcaaggtgcagttatagctttagtattattattatcataggctaatacaaatctaaagagtgatggaggcccaaggcacaaaatcaagtgcaaaacagataagaaagtagaatgaccaggcaaatactataataaatagaaagagggaaatccatcattgccatacaatcgaagatactacatctgccacattgaatgacctgaattacaacatggtttataatctttcaggcaacggcggtacagcacataatattacatagtctttgccaccatattaatgatactatctttgttatgtccccaaatacccccaaaaattcaaagtatctttacaaagtgcagctgctcccagattcatgcattaaaagaaaaagaggagttacaagcaacaagataaacttttttctttttccacatgagatgcagtgatcgacagtagtcaatactcaggtcagcatgctaaaaagtcagagaaagtgagcgagaatcattgtgaatactgaataggacgaaattcgacaaggtaattaaacaagtcacatcatcctaattcccttgacaatgttagaaagccacacaaatatgacatgcatgatcaagtgggagtaattttgctaaagaagaaaagtaaataatagggaaatgggagagatgggaacttggaaatcccttgacaatgttagaaagccacaaacaaatatgacatgcgtgatcaagtgggagtaattttgggaaatgggagagatgggaacttggaaatgaaatggaagtttgatgagcaatgtagtggaagtaattttgctgaggaagaaaagtaaataatagggaaatgcaaaagaaaagaaaaataaatgggtgcagcatcatcttgcatcttaagtactcattaggttttccactttcagaccacgccagcatcatcttgcctgtaagtactatgtttatacaaagtattaggttttccactttcagaccacgccagcatcatcttgcatgtaagtactatgtttatacaaagtattaggttttccattttcagaccacgccagcatcatcttgtatcttgcatctttaacttaagtactatgtttatatatatcggatggattgcatatatggttgcttatccagcatcatctttctttgcatcctaaatactatgtttaacgaagtatatatcggatggattgcatatatggttgcttatccagcatcatctttgcatcctaaatactatgtttaacgaaggattaggtatatatcagaaggattgcattgattaggttcttttccaaataaatactatgtttaacgaaggattaggtatatatcggaaggattgcattgattaggttcttttccaaataaatactacagatcgtgtataacaatctgcattgtaaacatcgaggtaaatcaggtagcaatagcatagaacaacatcgcatcaaccaacaaacaaaggaaatcaggtagcaatagcatataacaacatcgcatcaaccaacaaacaaattacaggatattgcagatcaaccccaacactaacacgtctcactcacgcggggcacctacctcggggcacctaccttacaaatcgagacggatggcccgacagggattgctgggtaggggaacgattagagcgctggaaccggtgactctcccccttcgtcggcgccggcgccggcgcaagagccggtgcggacgagcgcgggcacgacgcggcgcgccgggccgatggaggaagacgggcggcggcggcgggcgagcgcctagcggtagcggagccgaggaaggaggcggcggctgcggaggggggtcgagggctcggtgcgggtgcgggtgcgcgtgcgcggcgaaggggactaggggtaggggaggcgaggggcgagcgaaccggggtgaggacgagggtgacgggagagcggttttgggcgaggtcggtcgtgcactcgtgggctgcgtgtggagacacttttatcctttctgctttattttcgtgtcaatcttctccctgttttcctccgtattttaaggagtctgaaaaaccgaatggtaattgataaggagaaacatccgttttataatcttaattgctttcctaaatagatttctaagagcaccagcacattagcgataatctatacccaaaatttgatttttttagtttcctaaactaaatagggagtgaaaaagctcaaagatagcctaaatttaatcccaaaattaaaagtggatcttttgttaaactaccaatagaaatttctgtttttttcattccacacccagcatgctcccaacataaattttcagcgctcgcacacgtaccagagattgagagtcgctctctcaccctcaaaatccatggggaaggagagagaaacacaccaactagagatggggagttgctctcttacctttaaatccacatagcaagatatatggggatagaaaatccaaaactactgcagtgctttttggatctgttggatcggattttttcactgaaatctctcgaaatcaattttgggaataaaataggatgattgttggtgatattaatcccttgaatttgttcgcttctacaccctcgtatttcaaaataaatacatctatcgaaaaggttattctagttaaactcttctagtacttcttgtatgaaagttagacccaacaatggatcggagggtatgtataatagatactaccaaaattttatatttttgttaagacttatcaaattttgatttggtattaagagcgaaacgtccttgaatttttaaacactttaatagcggaagttgagtgttttaactatatctagtctattatcttaaaaaaaggtaaaattgaaaacttcaaggaccaaaacgtgcataggtacttggtataacattgagccacgatgctagtaaagcacgattttagactgttattttcgctattttattagactgtttgttccacgcgtttaaacatatgttttcccaaaaatattttcttcctttccattatttagataactcgttaataaactgtttgctaagcctatttaaaaagtaataatttatctttataataagtagagaatccgctctcaaacttgacctaaacgttgctgtggaagccgacagtgtagcctatcaagtctataaggacaacaagtccatggtcaagagctttcggaggataaaaccagtcactccagcatcgtatagaagcgaatgcgacgtatacaagtttgaagtacaaacatgaaaatctcaagaccacaactgccatgtactgttgtactaacacgtactacttcaagtcatccagtacgtagtggtacttttttatggatggtttttactcctggttaaactttttttgaggcctcgtagaagatatacttttcttgagatgtgcaagtcaatctgcacatgttagactagtctatctgtttatgcaaccggtttgatctatgcacaaggaagaacaagcaatcgccaggtttactggtaaaccgtccatacatatagacagctgcttctagtagatttggttgtgttataataatcgttgttaaaggaaatgcgtactaggagcagtacacatataatgtagggaaaaataaaaggaaaatggagtacacatcgaaagatgccaagtggggagtgggccggcccgctgacgcctccctacatgtcagcagctagccagtgggccagaggcggcttcggcccactgatggaaaaaaaaaacctggaccgctaaagcctcgaaacgtgtcaggtggggtccacctgcaaggcccccaccgcacgcacctggtgcggcacccacgacctggcccgcggggcccttcctcggtcagtgtggcttccgttaaacaagatcgcgcgggccccaccaacctccgtggctatttcggtttcacgtggattagaaacaagctttgtcttcccattggttattccactattattgtccttggcttatctgccaaatcgcgagtcaaatttcctgctcacctgtcgtatttggtacatttcatttttcctaatccttctcatcgaagttgcaagcatattgttcatctgtcaaattcgttctcctgttcattgatttgattggctaatgttctggcagtgcgaaggtttgctggactcaccgagagaacgccagaacggcagcatgtcgacactcccggtccagattaacccagctccgccgatcgaacattcgacggcagaagagcctgtgctagcaatcattatccctaacctgatcgatcagccgatcctctcaatccgtctcccggcccaggccgcccccctaatttggccgtatcccggtgcacgtcaaatcaagatcaagaacgacaaaagggggagctgcatccaccagcgacaggggaacaggttggaaaacaactgctttgttacaacatgcacgggagactatttagtaactgtagcactaacaccaaccgcaacagtctaatgggcatctcacgtacgtacagttcgatcgacaggcaaaaactgtgttcacagaagcaaagaagggaagaagaatcaaataggaagaagaagaactgaagaagcgaggatcgaggaagaaacagcgatcgcgatcggagaggcaactaaaagcgggaatgcgtgcgtaccttgatgggagtagtacccgttggggctgcaggaa

SEQ ID NO: 41597 - DNA, 2092 bp, Oryza sativa
tgcacccccgcggcgctgtttatggcgcgtaccgcgcaggccaacggcgtgtggttgtggagctcaggggagagtccttcacctacactcgccgcatttcatgccctaggaggctgccgtctcggccccccatggccggaaccctccacgaccccaactccgggtcaggaggcgaaatggcgcccactcctactactactcccatggtcgcgccgttcgcccagtatgtagccgactcctcctccacattgcaatccgccgccgccgctctggcccccacccaccgccgttgtagcctattcccccgcggccggccgtaaggggagagaagagaaagagaaagaaagaggggaggaagaagaaagagagaggggatgacatgtggggcccacatgtcagtgggccctacaattttcaatatgtgtgaatgacaaacgggtcccacgtatacgtttttaattcaaatgccacttaagtgccacgtcaacccacatactaggtcaacattgccacgtcagcgccacgtcagcgaaaccaccctccaaaaccaccaagggagtcaaattgcaccggtttcaatagttcaggtgtcgagatattcggttttacggtttagggtcatgaattaaattcgggtcacttttaagggagtcaaagtggacttattcctttgctatatatatgccgttttgttttttttccttaaaaatcatacgttttattttgacatatgattttcactggatttcaattttttaccgatcaagctgtcaagttagacctaatttcatcctttactcatttactccctctgtttcataaaaaatcaacgtagtacacatctagtattaggttggttttttatggaacgaaatgagtacattgatatagtccagctacacgcatgtatgggttggtttgattattcaaaaaagtaacgattgaatgaaattacattacaatttaaatgtagttataatgtaattaaattatctttatatttgtaattgcatttgtgtgattttgagtgatatataactagtctctttcgttagagccgacatgcctaggtgtgtattcggttagactgataaattcagtctaggtattcgttctttagtagatttctgtcaatggaaattaaagcatgatcagctctgaacaatagaattaaagaccgagcaattcagtcttggtcatgaccagattggacaatagaccctatgagtgagaattgaggagcataggcattttgcaaaaatctagctataaacaaacatcagatcagctgggtgggtgcaggattcacaattccgatgaaaaccaatcgaatttcgcgaaatttcgaggtttcgacgaggctttttcctatttttctagtcaccaattgaaatttcggttatttcgctcggaatttcaccaaagccgactggttttcgcgagctaatcagtaaactcagagaatttgtattcaaattttggtttataaaatttattcggaatctaccgacttttcaccggattttgcgaaaaatcgtcattctgtgagagcccgaaacggaaggttatctcggaatcgtaaaccccatgtgggtggggccgtgaggagaggaatacagagagagttggctgtattctttaacttgaggttcccaacctcaccccctcgtttactatatatattgttgggctggtggtgggtctactatcaaatttctatttgttaaagtatttcagttaaccatgaaagtggccgaatggaccgaataaaaattgcttagatccagtgattgaattaggttttatttgaaatacaaaatgggtctaaagtttgtaagttaaattataaggggtttaaaatgttataatttctttgaaatataaacaaaatgatcaatccaaatattaaaaattattcacggtcacagacccacgattatttgaagttaagtaacaagttctaaaaaatttttagatctgaaaaagtatgccaaacaggataaagtcagcggcagagctagcgtgggggcgggggctcgagccccgctaccccgctggactccatggaaatatgagggaggagggggggggg

SEQ ID NO: 41598 - DNA, 35192 bp, Oryza sativa
ttcctgcagcccggaagaagaaggttgagcccccctctcctccaaacctagctccgcctctggataaagtgaccaaatttctcggtccgagtcttttccgtttacgagttatgttccagtatgttttgcacagtacacgcctaccgatcgacgtgagctgtgtgcccgtgtctccggtcccttgtgctgttcgttcgaccgaacgacgtacgcgagctagctactagtatgccgttgtgccccgccggcacgccgccctctcgtgcactgcgaaaagcatctactacggagtacatggtacgcaggccacacacgcatgggccgtgatgcgcgcaggcagaagcgcgcgcgcggttgctaaatttcatgtacgtactccccggtggtccagtgggaattctggtcgatcgcgattgggtcgcgcctggacgcgcgacggctcgtgtcgtactgatcatagcgtatgtcaattgtccagattcatatcatagtttaaaattgctatattttgagatgaaggtagtacgtcatagcgcttgcgggcggcgtgccggtgcctagaacggaagaaaccaacaacgggcaacgtgcaacgagcggtagtgcgagaatcgcgtctgtgtctctcaggttttccgagtaacgacgcgattctcgcatgctagccacagggccacatcacaccatgatcgaccatgtacgtttcgatcgagcagtcaaagccggatcgtcggaggctcggagctagctagccatgtcacctactacctagctagctctcgatgcctatatgtacgtttcctccacgcagcaaggggtgaggtcccggccgttctgaatgtgcctgatatattcttccatctgcgccgtaactgcttactgcaatgccatcaaacagctctggccacgtaggctcacatgtactcgtgcaggtatgcataaacacacactggtaagcacgtacttgtacaagctagctagtagcctgggacgaatctaacatgaagacggtgatgactctaagcctccactattaacgcgagggccataggagtcgccacgaaacccctactaaacttttttacagaaaagctaggagagttgcagttttatctagtctgcttagtcctcctctcttcccttatacgtcactgggagtaactaactacgttagctccaccgtagctagctagctagcgcaatgtacagcggcaattatatacactgtgcatcccatcgatcgatcggtcgacaaaacgtgcagcgcgtttcctgtcgtccgtccgcccgcgcgcgctttctgagctgagccgagcagcagcagctagctagccatcgatcccattgaattcccgctaatgatggccgcgccatgcatctcgcgtctcgtctcgtgatgcggggcgtggttgcgccgcgcgcgcgcggatccgtcagatcgatcgctattgccgatgcccgccgcctggcacgctgtcgcgaaccctagacggctaccgcacacgtactccgtacgtagtacgcccaacgatcgatatatagcagccatgagcgcatagccatcagccaaagcccacaaggcaaacaccacacgcgcgacgtcagagagagctatagcgcttgcgcgcgcgacggcggcggcgacaagcgaaacggcgtggagagtgggagattgatcgatcgagcgagtggtaaaatgggaattagcggcgagaggaagggagccgcgaggcagtacaacaggtccaaggtgccgaggctgagatggaccgcggagctccaccgcagcttcgtgcgagccatcgactgccttggcggccaacaaagtaatgcctcgatcgatcgtcgatcagatcagtcacttcaattaattcctttctcctgctttcttgctgatctctgcttcgatctctctctggaacgggtgttgtttatccatttgtttgttcaccctcacttacgcgtgcgtacattcatgcgatctctgtcttccaatggcctcatgttctcaatggcgttgtttaactgcagaagcaactcctaagctcattcttcagctcatggatgtcagagggcttaccatatctcacgttaaaagtcacctacaggtcagcttcaattctcccgttcttcaggcgttattttgctatactagtcatcgaccatggaattataagaaagtacaccagaatttactgtttgtttaatttcgacagatgtacagaggcacacggcatggcattggacaaaacggtgaggctttgttaacttagttcttctctttcttgggaattgggattggattatgctttacaggagctgattatagtgtaataattcgacaatgttatacgtgcctaattattgtatactaattacattactctatctgaaacaagagatctaaacttcctgaaacttcccagttctggttggtgtaaattaggacctcactttgtggttgtggacttgtgggggctgtaattcttcagcacacatgtgaattgctaatggaaagctaaaccgactttattcttattcttttctcatgttaccatcagatatgcagccacagctacatctgaagcagcactcattcggcagtgatgagcagagccccaaggaattcatgtgcccacccataaaaaggttttgctgccgctagctttttctagctagctcccaatagtgctaagttaaaaagattatctttagtggcctaatctctttaaggcacaagcaccttttccatactcattctctcgctcttctctttggatgaacagggccaaggtagggacagaagcttcaggcaaatacagatgcatggaagggagcagtgacatgaggagtagtgctcctcctgcaggcacccggtacttcatcgatgattgtatgcgactgcaagaagtgtccatggataggaggagatcagatcaacacgatgctgcagctgccgctcgtgctcgtgctcctgctgctgctgcttcaagccttcatcaggcactgggattttgggtgcagggaagaagagaggagccctttatggtacaccaggtaaaaagaaaagctaaaagaaaccttagctagggcaagaacaaaaggcttatcaaaagaagatacatctagctctcttgtcttaactgctttgccgccactgatctttctcttcacatgtctctcactatctctagtcttttcttcctagctttatgcatattgctgcatggttggcgtaatatttttttcgtataattctcccagatgctagctagatttgctgatacctacctcctttccctcatcgtgcatactataacatgttcacttatatggaactggactagagtgtccaaagatatactaggacactttacctattaggacttgggagtcatatctctgattggcatcgatatgggcatgttcatgcacatcccagcaaaggtcaacaaactccagacgtgtccttcaaaaaagagagagagaagaaaagaacaggattaatagaatttatacatagtatagaaatactaggacagtgtggtacatacactgtcacagttgtactaggcaccagtatatataggacactgccacaaatggcccttgagagccctgttttctgataggaacacgacggtggtgtaactttgcctcagagcattcccttcagctcatcgacaatgataagccaaaagaagtggctttttgcagaactcggttgctatccttgcagttgcacgcagcagtttcatgatggacgatgatggcgcggtgcggacggaaagaacaagatcatgaaagctctctggtgcccctgctccggctgcaaattagtagcaaaagttgactagtgtcaaatattttgctttggaagcacattagctcgatctgtagctccttctgtgtgttacagtttcactgcactcgtatatatgggctatcaacctgcatatcagggaaataaatttgacagttgcagcaggacaaaacaaagcctgtcttgcttgaaatgcagttaaacatttagaacagtttgatatatcttcctaacctttgctgtgtcgttggattttgcagattagtaaacccaaagcacatcaactgaaccatatggtcaggaacatgaagatatcttgcaaggagaaccacgaaagtagattcttcatggtgagaagtgcaactagagatgaacaagtcaagaaacgcgcaccgccgctgtcgctagccgtcgaccagaaagctgcgaacgctatctcctcctggcccagcgaggccagctgcgttatctcgccgtcgccgaggaacttcagtactgactgctctgggcctccagggtgcagctttgttggccggagagttaacctggaactttccctgtcaatatgtggatcataatttagatcattaatattaataattatggtagtttttgttgatcagtccctcgtcatggtgctattactaatttctgctgatctcgtttctcgtgaaacaccctcgaagctgtgattgctgatcgtatggatcaaggtatcagagcaagttcaaacttataagctagctactcgacacacgatttacagacgagtatattacttcctccgtttcacaatataattcattctagcatttcccatattcatattgatgttaataaatttagataaatatatatgtctagattcattaacatcaatatgaatgtgagaaatgctagaatgatttacactgtgaaacggagggagtacacaatagcaggctacacggttcctaaacatgaactcgctccgtcccattttaagagcggacttgagttttcgtgtccaactttaattgtccatcttatttaaattttttttatgattagtaattttattgttattagattgtaaaatatgaatagtactttatgcgtgacttatgtttgacaaatttttttttatgattagtaattttattgttattagattgtaaaatatgaatagtactttatgcgtgacttatgtttgactttggcaaggcctctggtagaagtggctagaatttcaaacgcaaaacagtagcatttcagacatgtacccttttttcccctcatttgagctttgtgtgctagtttggccgcgtttagttcctcctccaattttttcttgacgtatacggacgcacatttgaagtattaaacatagactaacaacaaaacaaattacagattctgcctgtaaactacgagacgaatttatcaagcctaattaatccatcattagcaaatgtttactgtagcaccatattttcaaatcattgcgtaattaggcacaaaagattcgtctcgcaatttacatgcaagttgtgtaattgtttttttttcatccacatttaatgctccatgcatgtgtccagacatttgttgtgacagaatttttagaagtttgaagggaactaaacacaacctttgtccattatctttttcaaaaaaaaaaaattcccttttttcaattcacctccttaaccctagttagacacatcaaggaatgcaaactttgggccctcatgaattcaaatttttcacaagatctttgcaacataccacaaatacagtttaattcatacatgaactatgaaaggtctgcacattttaactagatatagtggaaatgaaatgagggcggcctataagaaaaatcacccattaccagtttgccaccgactttgacagctcctgcatctgcaggaatgtgctgaacaaagaagattcctcctgtcctgaaattgttattccttgtctaaaggcattcagcatatataaaagaatcaggtgataattttgaggttcgcaagtgtatatataaatggaatttcagagtagcatactagcatcagtagtgatagctcacatgttgcacagtatattatgtgtcaggagatcaaacagtagtagcttaaattcaggcttgtatttataagcaatatgtactcatgggtatactgtagtagagctaccatgtgcttttctttcttctccctcgctctgctggaaggaacacaaacagaatgattaaaacatagtcagctcatgtgcgtgcgtgtgttgtctgtttcgagttgttgtttctcaaaagcctaagagaagcaaacatgtcacgtagaccactgatttgctggttaaaagattgacaaatacaacactattctggtcgccaaaagtaaagaaaacatctaaaaaggtggttaggaatatatactcgtcagtttctgtgcttacctttgatactgcgaatggcatcatcttttgtcaaaatcaaaccatttaccacttacccaaaagtttcagactgacagcatctcatctcaagtacacattattaccatgatgagcaccacagtagattgcagggaaaaagtacggtggacgaaacaaaagccatctcagtagctgcttcttcagcaacatgcatgcttttgtctgaactggccataatagataaagttcagaaaacagtagaacaccataatagccagcgacctcatggttttgacatcgcaacatgcaaaaataacgacaagaagtaccctccaagagctgcatgaacgaactctgcagggctgcaacttatacactgacctacccaaaaccagccaaacagcagttggtggggactacagatgatatgatgcgtagaacagcacgcaaccatggaagggtttgatgtttgttaaaccatctcgaccatagaagattcaagctgccgcagagttgtaaacttgaaatgagcagactgatcaaattgtatcatctgtattatgcccatcacggtgccatctgattgatatcaaccaaggaggcatcacttcttctttgccgcttttgcatcaggcaccaaagccttgacacagagacgaggcttagtcgagatgagttcagacgggagaacggacaccccagccactgaagatcccagggataccccagaaatagggagcatctccactagtactgccacctggacattagaatatatcatttattgtgcaaaacagtatgcaagatttatgcacaacagtgcaaagcaatttccaaaaggccatagatctaaaacttaagtttttctctgtatttaaagtaaaagaacagagaatataattgcgtattcaaacatgatagtgcagaagttatctaaaagtgtaagttgtcctctacgcttcaaagtaaaagagcagataagtatacatagaattcaactttacatagttattatgactctggataaatggttccaactttttatctcactagtaaattagtttgtttcattttactctcatcactcctcgtttatattattgaaaagtgaattataacatttggaacccatggtagaagccaaaaaacacgtaaagttgtgaactatcagaaaacctagttggccgttgggtttcaaagttcaaacaaaaagacgtggtgaaagtagaggtatacttagcggaccaaaaagattattattgaacaatcttgatgatgacaactttgatgaaaaatattgacttactgacatctgctgcatccaaaagtaaacgtgctgaaattgcaggatgtcagataatcacgtgtcaatactgtccaaagactcaaaaacttatctcagttgtcatcatgatcgagtggaaaataacacgctaacttcactagtcagcattgataactttgttgtttttccaatttggtgtctttagattatggttctttaaatcctccatgttagctggcaagtaactctgctaaagtattgagaggttcattcaaggaaccgattttacctcaggagatctgagatccacaattgagttctcagcaactgatttgacggcaccagcaacgaccttgaagcattggtccctgtccattaaagtttgttgttttgaaccttcattgccattcttctgccctttcatctctgtttcatcaatgcctcttctattatacccaactgcgaactttaccataggttaacattatatgaaatattaacagttgatatgtttccacgagataatgctgccaatgctaaagcccatgccattttcaagatagatacaattataaaccgttcaaagcatgaagctatttcaatgggtaatgattaggataacagaaatgcgtaattttgttacttgtgcatagcattacagtaccattttagagaactaaaccaaatacaagaaatatttttaactcaacacatgcaatggcaagagaactggatatgagatctgcaatggcaaatatatatcacaaaagaactggacaagagaaatccagctatagaactggattgattggattccatcaacggtttaatccaatcagtaaatgtaagcagtgcaatatgctgtgtaccttgataggctcatcttggtcttccttactctttacaaagtcaagaaataactttgacacagtagtatgtagttctgcttctgacagaacacatgtttcctgaataggaaatatgcgatgacaccatctgcccattgaaggttgaatagtttcaaatcagaaattttccagtgcaactagagtcaatcatggcatacggaattggttggcagaaagacgcactgctgccatatttcttgaacaaatgaatggtaataggttgcataaatcaaatcgctatgatgcaaatctagaatagaaaaggacaaaatgataataatattatcttcttctgctttcttagtgatctggtctacactgcacatcattcacacattcagcatattagcagaaagaagcaagcaagcgtaacatattgcgcagtcactaaacggtaccgaaattaacaagttttgaagttgaaaactgaatcaaggttgacaaacttaactatactcttttaaaagggagtagtggtggtggtgagtggtgaatctgctagtaaaagaaattatgctagacaaagcgtgctctagaaatagtatgttgtaatatgtgggatcgcttattacttttcggcacttccatatgacagctgaagcctgtagttaataaatcaactttgttaacagcattttgagagaatgagtgtctaatgaagttaagaacttactgtggagatttaagcttgccagaatgcagtgaatgaaacatttgtgtaagcatttgaacaacacgaaggcctccgctaggaaacgaaaagaaaagcaagccacttcttgacagtttaaccagtgagagatttgaagtgtcgtcaacatttttacttgttttggagtgaggtgaaactgagtctttttctacactgcctgttacagaaccagaaaagacacagcgttagaaaaaagacaggtaaccaaaccatccaaaatcacaccctttagattgaatgaatgaatgtggctaataagttatgaaatacaattgatgctaaccagttgtttctgaagcatcacccttctcatatgttactgcatctcctgaattttcaatatctggtgtctcggaacatattttccttttctttgctgaaacttccgtatcacttggttctgacttttcagaactatagctgtttgcatgaccaatggactggcgaaaaacagtagcacacccagtatatttcagaatagagtgtaaggaagatgaagtggaaaatggttgcccaaagtatgaataaactaccacaatcaaaggtaaatactacaacttaaagttgctctatacttgcaagatattcagatggtagcaaatgtgctgtaacattaagttttatgtgctagaattatccattgcagaagaacaaccaaagaataaggagcaagacctacattttcaagaatggaaatggcttcctttgttgcgcttttctcacgttctgtaagaagatgatgatcacatcaaatttttgcagtagtgaatagaaattaagtgtatatgtagaatttagctatatttaagatttgttttaataaatatctttgtaagatctgtcacagggtagcagctggattctaaaataacccaatagtaggaataagatcaaaacagggataaaatgtaggataacccagatcactcaagaccagcagaactttccagaataaccgcaacctaagtggtttggctgatgcttcagcacattacatacctaagaacactcctggctacacaagcggttacagattttattcaatccttgactcagtgagcatgttacaatttccagaatgcacatacagcagaccaaacatcattacttatttttttaagacaatacacctttggtctctcaactctttccatggtttaagttttcacccccaactccaaatcgtttgaaatatgtcgataaacttttgaaagcatgcagatatcccttgcaaaaaaaaaagcatcagttttgccatatgtctagttagtgtgtatttggcctacttgtcagccccctctcagcttcatcttctagctggactacatgaggactgaggacactggcaagtatagcgaagttttttcttctcaccatatttttttccttttctcctatactgcattatgacaaataaaagtacaatagttgcaggtgatccaccacaaatttataaactatgccaacattaaacagttgtaaatttgatttacttttcagcacatacaactacagttcatcaactactaactgacaagtcaacagaagaagtgtctggcagggtcgagtatacaaccattgggtaagctaaccgatatccatacaacaatgtactaaaaactcatacaccaaagtcgaagggtaacaaaaaggtagttagttctgcgcctccaatatccacatctaatgatctaaatgctactagtaccttttagcgtcacaggggtcactcgaatgaatccactaacaaatccaccacctgaagtatctagtcttcccctacgtatccatatccaacaaaatagtttttgctaaaatagcacgagtaagtctaaacatggatgaggggcacgcactgatggggcaggtgatgaggaagccggagtgggagcggaggaggagggagcccgacgcgcggtagtcgtagcgcgggaggtttatcaccgccgcgtgctgctcccatggctgcagcggtcggtcgctggctgcggcggcgggggcgggggcggcggctggtggctcagttggaggctcgcgggccggcggtggggtttcgatttcgggcttcggctccggttcctccgccgccgccgccatggagaagcgccgaggatttctctctctctcttcggtcgcactttgggcggcgccgaggtccgaggagggtttggggtttgcagacgtattctgttaacctgttaactcgatccgaaggcgtatttctgttggttcccgtgaactcgaacagaaagcgtattctcttcctttgcgtaaactctcctcacgcgcattgcttataggatcaaaataatcgattagagttacacatggaaaagtctaggaccggaatctgatatagtcacggagcttttcttactaagttgatttcagcagctgccaagtactccatatgtctaaattcattaatacctatatgtatgtgggaatactagaaagtcttacattgtgaaacggataagtacctgagatgatgctagtagatttgcgatggccggtctattcatcttgtttatgaaaagatacatctgggtccaggtatgaaaaaacgtacgcataattggaagactatagacaccaaccttacaatcatgattattgaattattggtatatccatgtcctgtcctgaaagaggctatttttgaacaatttccgtgtttgtgcagatacgatatgcacactgttgtgtgtttagggtgctacttacctttatttcagtgaagcatacacaacaaccacacgatccgactcatgtttttgaaaccttacaaatatataaagagattgatgttgtttatcgttgggtcgatgaagatgccgactgatgtatattaaggagaagggagaaaactttacgaacataccctctctagagggagcgcaaatacagtgcgtcggtacatcgcctttacaacattaagaaattacaataggttgaaatctctctgaaactggtgttgtggcaatactcaacaaactaaagagcctttgattttcaagtttcccactcatcacacatgattgcacacaactaagggaccgacgaggttgttccatcgaatacccacatgttgcgctctttctagatctaccaagttacgaggatgactccggcgtcgaacgtcccacggtcgaccttggaaacggagtgctaggcagtaagccaccaactgggaaagtccgaagacgatggagaacaggagagactcaaacgagtccgaatctgtacccaaacctgttgcgagaagggttgagaaggggcaaccctggaagatgtgttagtatgactggccatcattggagcataggtgacaaattggcgcgagcttccaacctcgccgctacaggttgtcagttgttaaacaagcattgcggacggcaagaaacatgaataacttgtatctcgccggcgcgcgggatttccaaatgatcttgccgagagggcttgtttaacatatcgctaaaatttagcgttaacaggtttcacaaggtgcaaacatatagtgaaatcaaacttcacgaataacaacacaaatatgaaaaatatatgaactatgaatccggcattggccatggacgattaagctcgagattaagatcactttcctatagatactaggaataaaaacttttcctgagatcacattgagtagtaattcaacctgataaacaaattgcactcagcttcgtgggagaggcaggaactccacattgagtagtagttcaacctggcaaataaattgcactcagcttcgtgggaaggatatgcatccgataccgagatctaacgattagttgaagaatcggcgtgtctgccaagattgaagtgcgtgatgtatatgaaccgacccatatcaagatctaacgattggtcggttagggatggagttaccgtcaccactatgttttattttttaaagtgtatatagtattagtataaatatgattctcaacgaaaagattagcatttttttgtccattaatttgcaggacaccaaatatgaacagttacaaactattaattgagatcagagttgctagctagatactacgaataaaaacttctccaggcgcacaccatgttgagtagtaattcagcctgaaattttactcagcgtaaataatccaatctggcggatagcttcggcgcgaatctctgaagcatcggcttacccgcgacagctgcgccggacaggactccgccgaggatgccggcgacgatcatcgaccttgggccggacgcgatgcggtagagcgccccggcgctggcccccgcggcgacggtgttgacccagtcgtcggcgccgtcgcgctggtcgcggacgaagctctcggtcccggcgaagagcatcgcgacgatgccgaaccggttgccgaaggcgcggccgacggagccgctctggttgagggcgcggttgatgcgcagcttggcggactccccgcgctcggcctcggcggcggcgcggcggaggcccacgagcgcgccggacgtggcgccggcgaggtagctgacgccggtgtagaacgtgaggttctcgccccaggtgcgggtctgccggaacttgtcctcctcgaagaggcactccggcgaggtgggcaggtcgtagagcgcgcggtacgaggtggggaaggcgaggccctcggggcgatccggcgagtagaagcggcgcccttccgtgggctcctgctgggcgtcaacggcgcgggacatggctggctgatctagggttgccgtgggctgctgctgccgctgcgtgccttctgggtttctggacgatcggttttggttgccgccgccgtgtgccgggggtttaagagaggggagtggtctccgatctgcagtctgcgccttcgccgtgtcgccgaagaaaagggggagggcggagccgtgcgagatgcggactcgaaacccagtaggaaaaggaaccacaacgcgacgccacggttccgacttccgattgagaaaagagggtgtgggccggtgaggtgggccgtgggtgtcggccttcaagtaagtggtctgccagcgcggcctccctccgcctcctctcggcctccacacaactgtgcacgcaaggggctaggcggaataagtccagtaggactccctcaaaatataagtccagtttatttgaattccttaatcgcaaagatatttgaaactggctccgtcgtggaataagagaacatagtatttgcaaacgaaaaacagtttgtgaataaaatttttatacacgtgtttttagcgatctaaaagtaaagactgaaaaataaacttcgatgaaaaaaaacccaaaaatcaactccaaattgagagttgaaaatttaaattttggctgataagcataagcaaaagaaaaagatgaggctgtggtgtaatttgacttcatagattattgtaagagtggttttcgctgaggtggcaggttaacttgtctgctttcggccagctattgggcccgccaccgcgtcccctttctcaaatgggctcgactttataacaggccgggccgtgcaagcgccacgtagctgcacaaacaaggccgtatcgcgtcgtgtcaagctcgatctagagttgcaagacccccaaacccccgtgacctctccgccgcagccgcaacagcaatggaggcgcaggcggacgccggcggcgacgacctcgccgccatgcgggagcagtgccggagcctggaggaggccatcggcttccgccgggagacgcagatgggcctcgtcgcatcgctccagcgcctcgtccccgacctcgtcccctccctcgaccgctcgctccgcatcatcgccgccttcaacgaccgccccttcgtccccaccccgaaccccgacggcggccacggtaagagccccgccgccctcaagccccaccaccgccgcgccctccctgacccggcgcgctccacccgccgcaagacctcgcccggatcctcccctgcctccgtcgccgctgcccccggcggcctcgacgccgtgcgcaccatggtcgccgtgtgcctcctggagctcgtccccttcgccgagatcgacgccgccgcgctcgcccgccgcctgcaggcggagagctcatccgccagcgaggccgagcggactgctctcgctgacctagccgccgaactcggcggctcggcggcctccgctgtagtcctcgccctccgccgcatagccgaggacaccggcggtgtgcagatcgaggaggccatgattgggggcaagtcgatgacgatggtctgggccatcgaccggaacaagctcctcaaggagctgccagaatccgctactttgccgctactccaacctcctccagccccccagatgcccccctctgagaccgatgccggcagcgcaatgataccaagaacaccgcagcagcagcagccgcagccggatatgtggccgcattcgatgcctccgatattcccacggccaaggggcatgacgatgcaggggatgcagagggtgcccggcgtgccaccagggttgatgccgctgcagcggccattcatgggaccagctggagttatcacaatgggtgggggtgtggggcctagccctaaccagcagaagcagaagagcgaggaggacgaacttaaggatcttgagttgctgctgaacaaaaagacatatagagagaagcagaacaccaagaccggggaggaacttttagatctcattcaccggcccacggcgaaggagacggctgtggcagcgaaggtctgttttcccttcacctatgctagtggttttgttgtttgcactgtgtagttagtgatgctttgggttgctgatttgttattgatgtagtctcacactgttagtcctgtagtagtaaatgagctggcagtggcggacctaggatttgaacccagggtaggcctagcaaaaaaaaaaatctgaatgcaatacaatatgattcgatataaaatgtggtaaacgatacggtatataactctaaatggttcaatacaagtagaaaataacaaataagtttgaatcttacctaaatggtccaaagttggcatggaccttttagaatgtaccctcttctagccgcatcttgatcgttggcatcaaaacttgaaatagaagcccttaagcctggatcatgttcaatatcatcaacatcataaagcagcggcggttcttcttcagtttcaattgacccctgttgagttatgtgtcttagtgaatatgtatatgtttagggactaaatgtaaagaccattgcatacaaggagatgggggacaccaggtccaaatcatccaaaatttacagcatggtatcagagcaggacgatcctgcttgattttcttgcaatccctagcaacacgagttaatgtggaatgctggtttgcagactgcagtgaatcatggtccagaggtagtcctgaagagatgaggttgatccatgtttttttttggtgattagttgcatctggtttgctgcctgctgtctgtaagagtacggtatgttttttgccaaggaaatccatccaagccttgccttgtgatttcgctcctggacttgcattttcttcgttgctgtctcagcctctcaggtggcgttgctgctgttttctttgccgtgtgtgctgtcgagagttgcagcagacctgtgtagttgtgtgaccttgtataagttcagtcttgataaatctatatagaagtttgtgttttgattgggttccaacctgctcactaagaaatgagtgagccaactacagcaggggcggctgggcgctggcggcgtcgggcaggacgccgggaccgcgggagccgggagctcgggaggccgctgggcaacggccggacgtgagacggagagggcgcggccagccggccaggggcagagtcgcggagatggcgcggccgcgggggcgccggcgcggcgcgcgaaggcagcggcgttgccgccacggatgggcgtgcgcctggcgtgagccgggaggccgccgaccgacggacgcggcgggaggagcggcggcgtgagtagcggcctcaccggacggtgggagcgccggagttgcgccggcctcgcggctcgagggagcgctgtcgccgttggtcggtcgggaggggagagtgcacaggagagaacagagaagagacttagggttttttttgtttgttgggccaggcttttttcatgggccaagaaaaaataaatacctgatcttctctaggccaaattctagggtagtcctgggcctacctggactaccctctgggcccgcccctgtgagctggtctacttatgcattgctgttgttaaaactatcataggacgcataacagctagttgtcggaggcacactgctataatgaacggtttatcataaattgcttagattctgcactgaattagtgcgactgtcaaagtaaaactgttaaatgttgtttgacccatctgcattgcctatatattgtcaacctctcgacacttataacttccactcttccagttcttacacatttaattgtaataatatggttgacatgaaaatcattcatcttgttttgttaatatggttttatgttcatgcagtttaaaacaaaaggtggttcccagctgaaggaatattgtaccaacttaactaaagaagattgccgacgccaaagtggatcttttgttgcctgtgataaggtctgtggtgatagtgtcctgcaccccttttcacaatgtgtacttccgcacgttacattttgtctacttttaacaacagtagagcaaaacctgttgtgtttgattcaatcacttaaaatgatgtgcctatccacaatcatggcctctttgacgatgaaattatcctgttaacatattaggccttatttctggttacttgaatttattccaatcaaaatcttcacatttttttccttgaatacttgaatagcttttgttatctggtcttttagctgttcatggtaacaactaatctggaagtaactgtttatatttcattctgagcaggtccatttccgccgtattattgctcctcatactgatacaaacctaggagattgttcttttctcgacacttgccgtcacacaaaggtgactatggcatatacacccttgtattttcctctattatgatgtgtgtttttgtatcttacatatatcctataatctgtagacctgcaagtatgtccactacgagcttgaccaaacaccagatatacctccaatgatggctggtgctcttgcacccccaaggcaaataaggctccagagagctgaatattgttcagaagtagagcttggagaagctcaatggataaactgtgacatccgaaacttcagaatggatatcttaggacagtttggagtaattatggccgatcccccttgggatattcatatggaattgccatatggcacaatggctgatgatgaaatgaggacccttaatgtccctgctttacaaactgatggattaattttcttatgggtcactggtcgtgcaatggaacttggtcgggagtggtaagtttccagaactatatttgattagttgtcttcagcagtaccaacaggttaattaataattgcgtagcattttagcattgttcatatcctaatgccccttactgagtgcagatcatttagatatcccacacttcatactcaaataactcgataggatatagatgctactgtaataacaagttatgtcatattcattcctttactgaattttgtttttacttaatgtctactgccaagtgtaaactttccctgaatgaactttcagcctgaacaattttcttactgacaactatgttgcttgtttttaccattcttcagtttggagctctggggttacaaacgtgtggaggaaattatttgggtgaagaccaatcaacttcaacgtattattcgaactggacgcactggtcattggttgaatcatagtaaagagcattgccttgttggaataaaaggaaaccctttagtcaacaggaacattgacactgatgttattgttgctgaagtccgtgaaacaagcagaaaacctgatgaggtacactcgcttctttgattcatggttctatactcgccgcaaaagcattgtgttttttcttataaaaaaattctaactatagtttataatgtttttcttccctactgtaataataaacatgctcatttcaaggctatactcctacattctttaaatttgttttgctgtgcagatgtaccccatgctagaaagaataagcccaaggacaaggaagctggaactgtttgcaagaatgcataatgcacatgctgggtatgctcctgctgtgtattcttcttcccctagattattttgtcctcaaactagatgctaaccatttacgtaccatttaccctttttctttgtttgctcagatggctttctctgggtaaccagttaaatggagtaaggcttgttgatgaagggttgagagcacggtacaaggctgcctatcctgattcagaggtgcagccaccatcaccgcccagagcaagcgcccctatagatggtgatcaaggcacatcacagaaacctactgtatcagacggcgagaggcctgcctgatgtgaagcagtcggcaccttactttgaggactatgacattgaggaatcatcgtgcaagaatacaaacactttggacgacataagtattttatcactcgtcagctttaactccggttgtaaaattagttaagtcggtttacttagaagttactccagttgtaaaattagtaagtcgattgtttttggtcgcttgaggaatgcaggaggagggaagaattgttgggttttgtaatgttggcagacatccatcttgataatggaacgcgtgagccattactgatcttgttaacatgtcagcacgggcaaatcctgaatgcaacatttgttcccgtcctggaaaaacagcatgtacgttaactcatgctgggatggctaattagcgcaagtgcatcgccacacttttctttagtattttccgacgaaactttttaactcaaatactacaactttttaactccagagcaacattacagtacacaaggtttttctaaaaggttgacataattagagtacaaaactttaacgacagtatcatgtttgctgctaagaatggatttcaggttgacataattagagcacaaaactttaacgaaagtactgcttcatgtttgccgctaagaatgtatttcttgcgtgattcatgaccagtgactatgttaacatgactagagtagagaataagctcaaggcgctgctagatttgatgcttggtcgctcaaggcgctgccaagctgatgcttggtcaggcctcatcctcatcctcggggccttccttcagcgccttgatgaatgcgtccagagattactaacaagaacaataatatattgtttagggtgttaatgaagtatttacctaatgaatcaattatatgttgttcttgatgaaaaaaaaaactagcctcgatgaaaagttgcaaagatcagcgctgaattcatcaatgttcatctcatcaatgataggcattttatcaagcgttgacaaaatgacagtcaaaccttctttcttgtaagaaagtacacatgttagaacacggttggatcaaaggtaactctcaattcctatatttcttctttcttgtaagaaagtacacatcttggaacacgattggatcaaagataactctcaattcctatgtttacttagcatcatgaaacaccggtggaagaccggtgacatatagatcttataagaactcatccctttcaccttgcacgaaagtgcacttataaactttccattttagacaacaccttattgagagctgtcgtaacctttctaatcacaacatacccaaatcaaaacatgcacggcagaaggcttgagagcctttgtaatgtgccataaggtacatgactaaatgaattaaagtggcgggaattaaataaaatcttatttcagcccattactttcgtaactggcccgtcctgtttagcgtgagcgtggcctgtctaccggcaatgacccgacgcagggcgaactaagcgtggcccagttgtattctgcggcccaaagaccacgaggcccaatagcggtggtggccctacgtggggctgatatggtccatccgatttgatggacggctcggatcagtcccgtgccgatgaaatcgccggtcggaggggggaggggttcgaaaaccctaaccctaatcccccttctcccctactctcctgatccaatctctggtgatgcgagagagtggacaacgacgatggtggtgacgacagtccgtcgaggtggagcacgcacgcagcagcgatagcgagtggcaccggcttcaccggctgggaggcgtgcctgagggcagcgccaagccaagccacagcgtcaacagtccaatgaagcgggcgcgcaagtagaaacgggtgccgagataggctgggcttcgacggcggggggtgggggcatagtaaaaaaagccggactggtaagtgacccggccgacctctcggttcagcggtctgccggtctgaccggtgacccgggcggtcgaactgcggttcacaaactacatgtatattacatattcactcatgtaatggctagctctttgctcttgtaactcttggacccgggttcgaatcccatgtagtgcaccatttcttgctatttttgccaaaaaaaagaccaccagctgcaccaaatgggcctttaaacagcccattgtggcccattagtatggctagccggttcaaccagtgccggtttagtgtccggttcgccgaaaaccggccggttcaggcgggcaaaaataagaccaacagctgcaccaaatgggcctttaaacatcccattgtggtccattagtatggctagccggttcaaccagtgccggtttagtgtccggttcgccgaaaaccggccggttcaggcggttcagagcggttcgattgcatgtctggtctttaaaggaaaccgaaccgtggtcacctttggttctggttttttccgatctaaccgccaggaactcctagaaggcgcgcaaacggggagcccaacgcaaccgcgaggaggcgaaggtgcatgtccggtttttaaaggaaactgaaccgtggtcacctctggttctggttttttctggtctaatcgccaggaactcctagaaggcgcgcacacgggaagcccaatgcgaccacgaggaggcgaaggtgtggcagtgtcgcttcccggtgagacccacacaacggtggggtttcccggtagaattagggctccaaatccggtaagaatatgaactcaagcctaattttcttaatttgatttggatttggatttgattcagattttggggtactcttcaatttggggatttcgggaaaattgaaaccagatgggattgtcaggtgctattgggctgcaccttgggccgtgccagctattctccaagttgagcccaagtaagcccaaggagaggggacatatacaaaggcaacggcgacacttgggagggaaggaacataactagcaatcggcggcttcggctacagcagcggcaacgacttggttcggttgaaccttgttgatctctattcctctcccaccctctctcttgttactcttcactaatacttctagaagcttccggaatctagtagcttgcatcctttacatcttctcatcctgtccctattgtattttcctgagattgcattgaattttagttgctcttgagattattgagttgagaagaagaggttgctaacactcctcttctacgcccatgctgctttctcccatcggtcgagcaccctggaaagatatgggggaagagagtggagagggagcaaagggaagtagaagatgtggttacactgatatgtgggatccatctgttcttttttaatttttgtctttggtgccacgtccccatcatgtcatgtaaaatgcttacaatactgatttgggactagggatgacaatttcccccgcggggccgggtcccctgcggggacccgaccctacgggggcaggggccatttctgacccgtgggtgagtcgggggcagggcaccgcatttgggcggggagcggacggagaggatattgaacccgggggatatattacccctcgaaatgtagcccatagaaggcccaacaagcccaacttagcaaaatactgtgatatatgagcaaaaactaaacatgctaaccctaccttatcctctcccgtccatcccatgcagccacacaggcacggaggtggcacactcctctcgcctcgcttttcccttctagatctcgccgctctctctccgtctcttgcggtctcgccgtcgtcagtcgccctcttccctcccctccgacctcctgtcctctccagtctcccctttccctcccatctccccacggtagcgcgcaggacgacgcacgggcggcacgcggggaggcgcacaggcgggcgtggcgagggatgcggcacggcgcataggcgcgacggctggcaaggggacaggcgcggcgagcgggcgacacaggtgacaggcgaggtgaaacacaccgagaggtatttcactaaattggtgaaatgttgtttgtttattgagtgaattgttgtgtcaaagtatttgtgaactttgtggtcatgcatgcattcagatcatggacggaacgatgtatcatggaaatatttgtgttcttgcttgattctatatgatagtcttgaaaaaaaaaatttctgattggatgaaaatactacccaatacggggccctggtcgggttgtgggccggggggtgtcgggggcggggcttaatttgcccccgcatctccactcgtgccaggatcggggacggggccgttctagtctaacccgtccctgccccgccccgttgccatgtctatttgggactatatttctacggttattgcggcattgggatgtaattcgaacggcgtcaagttgagcgaccttgagtgaacttattccttctcaaaattggggagcttgcgactctggccattctgctcacgcagtcacgctaggcccaaggcccaaaaacactatccagtgggctcaaactagaggcttctcttctacccagggtttagcgtcggatccagtctccaccggagcgcggggcggcggattccaaggcggcgatggagttctgcccggggtgcgggatgctgctgcagatccagccggccaccggcgggaaccgcctgcgcttctactgccccacctgcccctacgtctgccccgtcaaaaacaaggcacgcctcttcttagctctctccccccctatcacttcgcctccctacttcgtctgcgactttgcgtattgctgccgcggcctccgcgtttgattgatgcctttcgcagatcgtgaagaaggcgagactagtgaagaaggaggtggagcccatcttcagcgacagcgacgccatgaagaatgcccctaagaccaccagtgagcccttcgcccttaactttcttgttaagacaatacattgggattaattgttgtcttaactttttttgttgagacaattcgttgggaataattgaacttagcttctccattatactgtgtatcatctgtatgtcatgaattgttgattatcttgccatttaaatttaggtgaaaaatcattgctattgccacaccaatgggaaattttgttctaaatgtacttgctgatttttgtactagtaattgtttttttttcttttcttccatccattgaaatgtatagctgggtaatctagccgcagtccaacataaacgaaagtgttttatgcacatattctgtcttctgagtttgtttagcttatgtcgatacaggagacatgattgcttgttcataaaaaaaaaaaagagatgaaaaatatactaaaataaaaggctcaaatttacttcacagccaagcagtgctggtttgaagcataataaattaatatacttcttaagctatgataaaatccaaatagcaccagatttcgtccaagtaccttcaagaaacttgctactcctatgtatttcgttgtttaaagtcatcattgagatgggaatgttcattaggggatgtctggcacatatttattaggaaaccagatgattgaatagttatgggtgcttctagttttgatacattgttaccatggccgtggtatactatcatgcatgtgcgtgcttagttccttgtaaaaaaaaggagtaaaatggtggaccatcagtgctttcttttttcaagcatctattctgtacactttcaacacaagataagattgcttgttgtgttgacagaataagcttgtatcttttgatagtggaaggacaaaaaaaaagcatttttcaaagctgtacctgaatttatttagctgttctgattataatggcatgtctccaacccaacgcaaataagttcaatattttaacaatttccacgtaaagaaccctgacctaacatatggttaaacattttaataaagttctaatggttgtctgaattagtgaccctagaggtgacattctgccatacataatcctaaatacattcaatgattttgattttcagctacatgcccaaggtgccaaaatggagaagcatactacaggcagatgcagattcgatcagctgatgagccaatgtctacattttacaagtgttgcagagaagaatgccaatttgattggagggaggactgactttagtaatatttcttgtttaatgtgtgtggatatttttcctgctaaaactatgtaatcatatgaaaccttttgtaatcagctcatgccgcagcaaagagccaaagaaaacttacacatgggaaaccaacgtaccacaaaatatcgtgatattttggtctaggcgtgtgccaaagtcccaacctatcgtggtgttttgtctaagaatccgaactgaagactggtccattaaggcattaacccaaaaaagaaaaggcttctcacaccctcagaagttagattttggtctttgttgccttgttggtgttagagatgtagattgtcctggtctagaacacgagagcatgaataaacgagaagattgcggccataaggcctcccgctctgccgaatgatctacttaggttatcatcaacaacagcattttgcagcaattacggcatcaaacattcattaacaccatcaaaatatcatgctgtaaactcttgccaaacggcttaataattaccaacaagctggctttacagcattgcagactacagcaacgtttaaactaaaaattattaacgttgctcaattatgtatgaaacacaagaaatgttgaaccaggaagctggaacatgaacatctgaacattctttcttatgatgttcagatgaaacacaaaacttgactttatacatcatcatttatctggtaaccacttcttccgggctccttccaaagcttcttcccgcatccttgttaattcacgaaaccattgctcgtactgagcttcaatcagaccaagctctccatttaacacatctcgattttcagtaattgaaaccgatgcaccgatcaccaactccgagtgatgtgatgcttgatccatctgaaagattgcaaaattacttgaaccattacttaacggatgtctgcagcccagtttatcggttcctttgtacgcaccacattccagtgtcctgtattcgtcaacgccatactcactaagacttttggaactcccatcaagctgaacagaaatgtctgacccttcagagctatttggtcctcctagattggttgcattcaagagagaatcaatataatcacttggtgatgcattggcttctttcgaatgcatcataccttcaactagtacataatcatgtgtcaactccgatggatgctgctgggaagtaattacgtgctcactttcacccattttagattcgctggaagtactcattactgcatcattcatcagctgctgaccagggacaagattcactatcaaaagatcaataaaatcagcaatgaaagtaacatcacagtctgctaactccaactgctcgaccatttcagcagcaacagacatagctgtatcagaatccaagtagaagagaaaatgaatgttccttgcatgtcctgcaaaaataaaaatgatatcgtatcacgagaacacaaaagataaattcaattaacaatagaaagtcgtaccacacaaatcggcaattcgcaaaaccagtgatactgaattgtcatcaagtttctcgcctgttagctttagctctgtgtttttgttagttcgcgtgaactccaacacagatctatgtggaccaccaagatcatttctcttgcatgtgctagtacacatagattcattggtgtcaacatccatgtgcaaagcttccaaagagacatctactgatttgggtaatgatgacggaaacttagtgccaacaagaacactagaattatcagagcaaagaaaggggtcttgcaatagttctttggcagacagcctttcagaagcaggaactaaacatttatcaataaattgttttgcctgaatatttgtgattttagccagagcagccggcttgacaccctagaaatcagagatttagataagatagtgttgaggcacaattatacaaagataaattaataaatacttaccttagatactttcttaaaaatttgagctgcatttgtacattcactgtaaggatactcaagagtgaacatctccaacatacacattccaaatgagtatatatcaacaagttcatcataattctcatcatatagctcaggcgccatgaattcaggagtacctgcagaaagtggacccatatcacagggatgtatcaggagaatgcagaatgttttctgtggattaatttggcacctgctaacatgcttagatgagaaaaacaggtgactctcacagttttgtattgtggacctatttacattagtttatgtttttaagtgacatggttggtgcatcgaactcaattcagacatagctgaatattgtaaaaggaatgtaaaatatgaaatgagcagcataggatcaacatgtaagatgtaactataagaatattgtttaaagggttataaatgtggtataagcaagtcaattttgagttaatggaatattgaaaccccaagtatatcggtcacaatacttgtgtgtgtaacacatcagatataaatgttgacaagtcagatcagtaatggctaattagctatagaagtggttgacattgcccatggattatgcatttagttgcacactcaaaatcgtcatttagtctgtctctccaaatcagaggacaataattcagaaataacattggaatcacaaagtagcagaaggttattaccaataacactttttgctctaggcgttagcatcaccgtggctaatccaagatctccaatcttaacttctccatgattcccattgacaaaaatgttgtcacacttcaggtctctgtggataattggaggttggtgggtgtgcaggtaatccagcccacggagtacctgtctagcccaattctttattgccttcaagtcaacacgtggatgtttctgacgatacctataagcaaaaggtaatggtgtcattccacaagaaacatggtagtattaagaaggcaagactattacttagttgctacttactgcctgagacttccagatgtgaaaagttctgtaataacattaattgtcttcttttgatcatcaacccaataattatagaacttcattacgttttcatgcttgagagactttagtagatgaacttcagagtatagccgttcaagattatctggagattgcataacctcatctatctccacttggctccatgcaacctcaatgccttcaacctcatcaaatgccttgtaactatatccgaattaagcatggatgcaaatagttacaaacagcccgatgtaaacaagagcacagacagaaaatgagcaaggtagcattaatacatttgcagctattgccattagaaatgtataccctggatcccattcgatgtttgttctgtaacagtgttgaccgtactagacaccagcaggcagcaaattaaagagattaacctccacgtaaaccattaaacctaaatcccacagcaattagtaggcctaaaagttgaaacagataaaactccttaggtggtcgttagtttgttgcttaggccctgtttctttcagcttaagattattataatctagattattgagtcagattactataagctagattgttataatctgtagtagaataagcggttagttgtttctttcctagattattaaagcctagattattgggtttgcaagtctaaagagggagtgggatggcatggtgggtaatttttcacccaataatctggaaaaagctcacataaatgagcttatcagattataataagctggactccagattataataagctatttcaataagttgtctgtttcttttagcttactcccaataatctggattataacccaagctgaaagaaacagggccttagtatttcttacctcttaggacgatatttggcatagatatataggtgctaaaaggctgccaagacatgagacgattgctagaatactagtagtccttaagttgaaagtttggaacctgaaattctctaatttgaacgctgtttactaccctgcttggcttcttgtgttagccgaaacatagttgcatatatggttaatgcagcattttttcctagattttgaaaatgtgacaacccattgcaatataaatatatctctttgacaaagaagcacaaaaacaaagaagagattccaaggacatacacagtcttcatagctcctctccctagcacctcattgtactgcaccagggaaaaagttcagatgaatacagcaggcagagttcaggagtggcacatttgtggataattttgacaaaattgcatgcagtttttttttccttttggtaatcgtttgagcaaatttccagcattttagtaatgcatttcaaacatattaaattctatgagcaagcaaaatttagataagcctttctgtaccagtaaactagaagcctgaaaattttaatgcaggtatccgttcatcacaaacttaaatagactagcatgggcatgtcaaatcacgttcacatcagatcaactaaaatggaagaggttcctatcagaaaataaatgagaaaaaaacttacgcgtatgtaccgcctggtcggatccacctccacgcactcagcatcgtccaccttatccagatcgccgaacacctccatttcagatcaccccacgcgcacgaacgaatcaggaagcagagaggaagcagagcgagatgagccaggcgagatcgccgggacagcgcgtggagcggcgcgggcgcccgctacgcacggcggtcagcagctagagccggcgaccgatgcagcggaggagagacggcgcggggcggccagttaattatataggatcgccgggcgttcggtgaagggctcggagaacggggccggcgacggcagctcgcggcggcggcggctgctgcggagcgacgtcgccttcaccccacccgcaactcccatggcccggcacccggcggacgccacgcggctggcgcagcacctcattcttctcccccggtcggtctcctcccttcgtcgtcggcggcgcgggcggatcccatggagggctacgcgaacggggacgcgggggcggcggccatggaggagaggcggaggcaagggctagggttaagaattcagcggcgcgccggtgtacggaatccggggaggaggcgaggagaattaaaaggggaaaggtaggtggtggtggggagcaaaaggtgggagagaaatagtaaaggcctggacctttattacggttcgggagcagcagctgcatctgtgaactgggatgacgctcatattactccgtcacacaatgttagcattttttatatggaaacggtatttaaaaaacaggtaaaatgattggaaaaatattataattggttggagaaaaaaatagataaaaaattaaatagaaaatgattgtgattggttgagagaaaatgttagatagagaaatagcaacattttagaataagatattgtgttaaagttaataacattttgaaatagaggtagtactcccttcataaaaaaattgtactccatctcatattagatttatttttttatgcaatgcaggaagtacgagcgattttggattgataccaaaatgtgtcctaccaatttattggtatcttgaatagtaatagtatggatttggattgaagccaaattattgataatgccaatgatcaatttgtcactaatctagaaccttcttctttatatcatcaatatttgacatcatattggtagtaatccaaacatgtataataaatttctatcctaccaaaaaaattggtagtaccaaaacatgtcaagaatttggtattaccaatgatttggtaaggtagagaacaaaacaacccctacatggtacgcaaactcatatatactgataaacggtgatacagttaatacgcatgagcgaaaatccatttttaccaggcttgccgttctttttttttcagttgagaataggatgaaaatttctggattattgtgaaaaatcaaaatgactgccaaatacaaagtgaatacttattcattggttgggtctagataagttcaaccgaaaaagtttgatgccaaattattcctcatgagaatctattaactttcggcctcttgcttttttaaggagattcggagagagaggaaggatgcttacagcctagattaggcattctatacattctttttttttagaccatattatctacgtgtacaacatgttacttgtcatataaacgtgaaaatacatacaagaatgcttgtgctaggcgtcgaaaccatcaagaaaaattaggcaggagcaaaacatccacccgcccacaagccaatcccttttctgtctctttttcccatttccttctccttccccttttacctctccttgagctagtggtggttgtcgatctggttgacaagggaaaacgagcatccgttgttggtaacttgggacatggcgaccacatgtttcctcaaggcgtcagtattgttgaagttgtgtccatcagggaggtgacaatgaattcgagataggtgaagaggatatgtgaacatattgccggccaaagttataggctgatagcacatcccatccagttcatctccacaagcgatggctacatttggtcctccatgttgtgcattttctaagtgcagtttcccatgaagccatagagtgcttggagttggaggtgccaaggtagactgtaacaccctgaaaattcaagacaataaaaatcactaaaattttaaactttttaaaatttttacatcatgctggatgttatggttgcttttgcttgccaaactataaattgtcataatggaaaattaaactaaagttatacaactaagtaataattataataataagatatttattatgaaccctataaatatttacgtacaagaaaacaaagccagaaaaagggaaggttaattactaatttaatttatgaatcaaatattaaatacttgaaccatgtgatgcgtgccatgaaatataaacacttaggaaatgataatcgttcaaataaatggaactctatctatagaatagttttactgggaaaaattaattagatattatataatttgaattgaatcataaatgctaaattatagaaatccatgtggtggtaaaaccaatccaagaagataaaccaatatgcgtgaaaacagataaataccaaaatcccaaatataggaaattatagaatctttaataaaccttaaatattggacaatattaaattttgggcaaattcacattgaacacttaatacggtcacccaaatgcttaggagtaaatacaaaattaatttgcaacttttctcaatttatatatcaaccagagccgtaaaagtaagaaaataggaaaactaaggaaaatatataataataataaggatatgttcaatattaaatttgaatataaatttcgatggaataacttagattttgtgtgaaacacattgttaggtggcaatagtccattttctaaattagaaaaacatctaataaaatccaaataaatcaactagcactgttcattgccccctaggtgctcgaccctgtcccatcaccgccctccccctgcccgcgccgcgcctagccctgccctgccctgcctgtcgcgcctagccctgccgcgccgctgccttgtgccccgcgccgccgcacgatatcgtgtcgccgtcgccgtcgctcagacgtgccgtgcgccgttgcttcgctctgcgcgcgccactgccgcgccccctcgcgtcccatcgtgccgcgcgccgtcgccgtctccggtcgtgtcgcctcgagccccacccctccgctcgtcacgtcgccatcgccatcacgtcgtcatcatcaccgcgccgcgtgccgtcgccatcgccgtcccgtcgactccactgccgcgccgcgcgccgtcctgtcgccgcaccgcgctctatcgcgacgccgtcgcccttgagccccgcgccgctgctgcgccatcgcgtcaccgccgtcgccatcaccacctcgagccccgcccgcgccgcgcactgtcgccgtcgcgctcgccatcccaacgccgcgccgcgccgtcccgtcactgcgtgtcgccatcgccccgagccccgcgccgccgtgccatcccgtcgacgtttaaagccggccacccctcccccgagccctataaataccccctcctttcccttccctccccacgccattcccccctcttctcccctttttcctctttcttcccctccaccgacgccgcattccgccgccgctgccatgccccggcgtctcgccgccgccgcgccgcaccccgccgccgttgccgccggtccgataagccctcccgcctcccttcatcgccggtagccgcgccgcgccgctcggccgtgagagagagagaggagaaaacagagaaagcagagagagagaaaatagaatagagaagagaggttagagtgggcccccacgtgattagtaaatagtaatccccttaatctttattagttaagtctattacatgtaggtccgggtggttaaaaatctagttatggagagtttatagtttcgagtctatgacaagcgggccctactaggtttaatggccggtttgaccctagtcaaaggagtcgggcccacctgtcatttgcccatatggattcctttagaaagaaaagtaaaataaaagaaaagaaaataggaagaccccacctgtcagtcactatagcttgtggataaggttgtattataaataaatgaattaggaacagtaccatttcgcaattattagaattaattcaaatttgaatctttacactagcataacttattcattttagctccgatttgagtgaaacttgaacctaaattcatctaaattcataagctttccaatggtatataattcactatttgataaaatatatttataattattaaataattaatatcaagatgatgcataataattaacttaaaaatgtgctaataaataaaattgatattgtactgtgaagtagatgtcaaataattgtctttaacacgctttctcactataaaacctatgtaaactaattaggagcattgtttcaaattaattaaagcataggaaatactagtgccatttattaatatatgtcaatatataattatactcatgacgtccaaattgtataaataatgtttagcctcatactttgtgactaaaagttgaacacacgtagatgagtctttaacttgtttatgagagataataacagagctagtgtgactaaaatcacccgcacgaaattaattaacggcatttcctatacagtagtatatgtttaggttggaaat

SEQ ID NO: 41599 - DNA, 8176 bp, Oryza sativa
ctagttataaatcttgatctcatataattatagttcaattgtaaattaggattattcattgtaaaattatgtgatgggataatctgtaaccataatatgattatcctaaacaactctaacatacaaagcatggataattattaaccttttctaatttattgtgacaagtaaaatattttcataattaaagcaaagcctccatcaataaaataataatacaaatggttccctgcgattaattgcttgatcccaaatccatccgacgacaacagaacctctagtatatgaccattttatttagatcaatgcatgtgtagccataatccttccatagccattagctagactaaaccacatattagccagatatgtatctcgtttatactacgttggctagctcctaaatagaccaccatgacaacagaaagattaagaaactttagcccttagcatgttggaatccatcagcaagcgcgaataatatgagcaaccctaggttcgacctcatcaaatatattttgtttgtgcatatttgattgttgcttgaatattggtttttcttgcgtattatagaaattgtgtatcgatcagtcgtaaggcaacgtctacaacttccaggaggtgaaggttgaacaataattatatcaagaataaggactatcatgcgcaagtcatcactatgacatgataagatactatcatgcgcaggaaagtcatcactattccttgaacatgttgatcccaattgcgaaattattttgtttacaaataaaattgcatgcaatgaggaacatcctacttgtgattatgccatgccttgattattgtttacccccttattccttcgtaaccatgtttacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccatattgccatgatgttgatgacatgatttgtggaaggagaaataaaactaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctaccgtgggacaaccgttgaggtagggccgagaggcgtgccctacatcggtgtcgccattggtaggactgccatgagtgtgtgagagagataacttaacttgaatcttaatttaatatgtgtatgagacttccctttcccgggagcgccagaactcctctcactgctagaaacatggacacttagagtgcatgaggatttaagttcatggagcgggtactgccaatgcgaggttatcgaaaagctttgtcgtgacgcgtctcatgtgttgggacgaggctcatgtgttggacaattgcggagtgcgagtaaagtgtacatccactgcagtgtgagtaaaccaaatctattcgaatagccgtgctcgcggttattgagcaccgggacatgtattatacttggctagactctagattcttaacttgtgtgggatgggatattgcatgatgatttttatgctgatggagccacttcctgagaggagggaaggtggacgtcctcagaaaaccatgacgactcaatggcgggaagctatccttgggatcacaatggatggtggacagaaccatcgttgtttaatgtgaacattggtactaaaatttgatcagtctatgctagattttaggcttctgaaaagaattgcaaaacttgctttgcgcaaaagaaccgtggctattccttaaaataccccctctatcatatgcattattgttgtggtggcttgctgagtacggtcggtactcactcttgctatttatacatcttttaagagagtgttgaagagaagcccttgtcggtacgcttgcgtatccaacaagatgatcggagtgcggtctggttctaggtctcgttccccagtcgactgcctgtggcatattaaccgggcccttatattatttggtcttccactgctgttctctgatagttgatgggctacctggccctaatgtaagtatttaactcttttagcctgaattcattcgtgatatgttgtgattcaactatgtatgtgtgtaccaactactgattcagggattggtacagataaacacagaagatttccgatttacaaaatcggaggtctacatagacagagcaggagcttacgcaatcagcaccattggttagtgtagcctacgataggaggtgcgggctgtggttgatgacgggttcttctcaagtaatcatgattgctggtaatatagccgccgtggtggctatgcgggagaggaagacaaccaatcttgattggcgtgcttttttatttgacgtatcaacatttgaaattcaatgttttatgcacgaggagagaaatattccaattagaattggactatatttcacatttttatttttattatgaaaatattgtagcggttggaacttatgtgtcatactcatacatagaaatgagatgtttcaaattagtttggacaatggttcgaattttagtttgtttttttatgtttcgctccatttctcaagatgttttatctgtgtctctcttatgttactttattgcgtactagtttgtcatccatttattttaaaatgtcataattacttttttttcacaatgtataattaatgctacagttatggtcaactgaaataattacagtttagcctgatttttcataaaggcccccacattataggtgaaacacactgtatcattcttagattgactacgttctttttagcttatttatcgaattattaaaacaacttgtctattccacgtttcaaattaaaaatatgtttgcaagaaagtttcttctaccgtattttttagattaattgttttaaatatatgttaagtttattccttagaaatctaattaatcaacgaatgtgttgctagcaattacttcatccgtcccaaaaaaaaatcaacctagtactggatgtgacatatcctagtattacgaatctggacatacctctgtccagattcattataccagaatatgtcacatctaattctacattcgtttatttcaggatgaagggagtatgtaaattgtttccaaacaaatcggtgaccgaaatgacaacgacacaaactcgatctagaaagagcaaagactaaagagcgacagggacagatgatccattgataattattgtacatccgacgtgacgcgaggcggtaaccggaaaatgatatgtgatgcaactttggaataagttcaccttaggtccctcaatttgtcaccgagttctaaattcgtccctacatcacaaaaccgaatacaatgcatcccacagcttagaaaaccatgcaaatgaggtccctcgacagtattgtctccgattttggctaacgtacgcctacatggcactctattgactaggtcttaatcccacgtggcgcttacgtggcaattcgatccgaaaaaataataaaacccgtgagacccacgtcagctacacacataaaaaatgatggtacccatgtggcctcacatgtcatcctcactaccctcttctttgtatctatctttttcttttctttttcattcttttttcttcttttgcttcgcgtccggcgcttggtgggagcgccgtgccggcggagagggcggccgacgggagcgccgcgagggaggcggcgagctcgtcgggccggcagacaggagaggagcggcggcgctcgcaggccggcgggagggcgggagaggagcggcggtgcgcggggaccggtgggagggagcggcgtgcggaggccagcgggagaggatcagcggtgcacgctggctggagggtgggagggaggggagcggcggcccatgccacgccggcggagagggcggccgatgggagtgccgcgagggaggaggcgagatcgtcagggcggccgacaggaaaggagcggcggcgcgtgggagccggcgggagaggaggcaacgcgcagcggccgacgggagggagggagaggagcgacggcgctcgccggttagcaggagggaggtaggctcgccggcctctccgccctggttggcatgtctcccccctccccgcctgtccctcatttactttttagttttgctcatttattttttttcaggatttaactgtcacgtatgcgccacgtcaatgacacgtgggacgaagatctagttaaagaagccacataggtatcacgtcagttaaaccggggtcaatactactgagggatctcatttgcactggttttgtaagttggaggtaaccggttttccgtaccgagtatgaaaatcagactgcgcgacaaattgagggaccaatagtgaacttatcctgcaactttcagccaatttacggccttattgtctcaggcctaaccatcttcgtttcggaagaagaatctcggcctggaaaaggcccggtccaagaacgggaggcgagacggaccagcgacgcgtctgtgcgacggcatgtcctaaccgcgacgtgagcgcctttttgttgaccgtgcgtgcgaactgtcgcaagatcgcccgtgcatagacgccaatctccggatttgctgtcgtgaccgtgccatctgcggtgaggcggtgagcgacacaagcatttctctatcgtacacaccacgcctctccaggatgcctgcaagaccagtacaacatccaagcacaataagaacagcactcgcccagagaacacagcaaattaaaccaccgatatccgcttgatcgcaccacccatttttacacttttccgcgcgtgtacttacactgcctgcgaccgccgcgatcagacacatggactgcaccaaggcggagacacggaatgctccgaagtggcagatgacgatgccgccggcgggaggcgagtcgtcgtcgtcgtcgtcataaggtccggccgagcgtgcgcgggcacggctggtctactgcgcggccgcgctccaagccaaggtgtccggctccgctaagaaggtttggaagattggcacggacgatccccggaaggcgacgtacggcgtcaaggtgggcgtcgcgctcaccctggtctccctcttctactacgtcaggcccctctacgacggcgtccgcgggaacgccgtgtgggccatcatgacagtcgtgctcgtcttcgagtacaccgttggtaaaaaaaaactacaatttgcgtgcacaaagccacaaagtcgcaactcacgaccgtgcgacgcaccatttgattactgccttattgagtttggctttgcttgcttgcttgctatctttggtttgcacgtacgcgtgtaggtggtagcatgcacaaggggctcaaaagattcgcggggacgatgagcgcggccgcgctcgcgctggggatgcattgggtggcgagcaaatccggcgaaacgttggagccgttcgtcgccagtggctcggtcatcttgatgggtacgtgtccaacatcgtcatggccattggcgtagctagggggtagtcctggtgggctcgggactacccccgaatttggcccagggagccccacccccccaaaaattttagcccagacttaagcccaagaagccagcccaataagaaatgaaaaattagaaaggctagggtttggagttcgctgcaacccgacgctacttcgtttcgcacgcgtgtgacgaccgcccatgccgccgccgttcctcctttcccggcctcgccagctcgccttgccctcgcattggttccgcagctcccacctctcccctgtcgttctttgtccgccgaggcactgagccgctgccgtcgttgacctcccggctgctcaatccatggagaggcggactgacggaggttagtggcgccgtcacgccgctgaaccgccaagcgccgctggtcgccggcgccgggagcccaaggcccctggccggttggccctagttgattgccgctcctcccccttgccctgcctgtgccagcggctgccttagtagcctatgacgaggtgagtttaagtgctaactggtgaattgaagctatgagcctatgaaatcaaatagatgtatatttctaactgtgatttgtgcatcagttagttagtgaatgactgaatgtgtgacgttgacttgctatggaatgtgaattagtgaattagagctatgaactgtgatttgtgatagtgctaattggtgaattagaactatgaactgtgatttgtgaatcactgaatgtgctgttgacttgctgccattttattttagtttgtaggatttctttggcaaattaagtagtagttttgataaggttggttcgagaaattggaacaaatccgacgcacttgacaaacatgtagggttgtaacaagtaaacacaataaaaaagcttcagagaaattatttatgaaagatgcaccaattgctatatttctaattttgtatggccttttctctaaattttgatctgtatatgggatttacggtgattgaaaaattttagtatgtgatgtgaacttgtgatccatgaagtaggactacccaacaaaaatttcctggctacgccactggtcatggcaacatactactacgtatgttgcagctactgcagccaccttctcgcggtttataccgacggtgaacgcgcggttcgactacggcgtgtccatcttcgtcatgacgtacagcttcgtcgccgtgtcggggtaccgcgtcgacgacctggcggcgctggtgctggacaggatagccaccatcgccatcggcgtcatcatctgcctcgccgtctgcacgctcatctgcccggtgtgggccggccaggagctgggcctcctcaccgctcgcaacatggagaagctcgcgtccgccgtggaggcctgcgtcgaggactacttcgccgaccccacggcggcggcggccaggtcggaggggtacaagagcgtgctcggctccaaggcgtccgaggactcagcaggccgcgcgatgggaggcccccgcacgggcggttcggcttccgacacccgtacgaccagtacgccaaggtcggcgccgcgatgcgccagtgcgcgtgctgcgtcgaggcgctcatcagctgcgccggcgcgtcgtcgcgccagcgagccccgcccccgcgtctcctcggcgatgcgtgtacgagggttggcgcgtggtgcgcgcgggtgctcaaggaggcgtccgcctgcgtcgccacgatgacgacgtcccggggccttggcttcgccgtggcggagatggacgccgccgtgcgcgagctgcagagcgacctgcgggctctcccgcccatcctagccgaggaagcgtcggagacgtcgctggcagaggtcatcagcacttcaccgttgctctgctgctaagcgaggatcgagggcgtcgtccacgccgtcggcacgctggcgacactcgcggggttcaagccggccgacgatgctgacggtaccgataagccagaagccgaggtggcacgttcggacgagtcaccgcctcaccggaaaatctggcaaacacgcaccttgaacagagtgaacattttagcaagtgacaaaaaggggtacaagctgctagtaggtgtcaaagcagaacattttagcaggattccaatttcaaaaccgtggtgcagaggtgcagtgctgcaccagtacgtatctacatgttcaaacgttggtctctgcttctctgggccttagtgaagaactttcggcccaagccaaaccaggctttggtgagaaaatgtacagcccaagatcagatctggacttggacagaaatattaggcgggcctgatgctgatagcttccaggcagcactggtctttctattagcccggtgtctactctctacaacaatttcagtttctaaaaaggaataagttcacttcatgaccctcaaaagagacccgaatctaatccatggccctaaaccgcaaaaccggatatcttcacccccaaactattgaaacgtcagcaaaaccaccctccaaaa

SEQ ID NO: 41600 - DNA, 2478 bp, Oryza sativa
tggcatgggatgagacggagtggagtgcccgccggggcgttgctggcggagcaagtgtgcggctttccccacatggggttgaggacgacagcgaagggaaggtaaaggtggtggcgggagggacggtggtgtgacaatggcctcccttctcaccgctgccttcatcctcactcgtgcttcctcctcccttacagcggcgagcggaagggggaagagggggcggcggcgcgacgacgacctcccctcatcaccgccgtgttttgccggggaaagggaaggaagagaagaaagagtatgcgacactaacgtgcgggccccatagggtgacttagcggattggaccaagccaaagcgccaagtcagcgaaactgtcctctaaaatcgtcgagagagttaaattacatcggttttcacagttggggggggggggtgtttcaatctccagcgccaaatttgctatgagatttcatcgttcaagataaatagatggatctgttcctttggacgacattggttttatgcctttatccacagtatatcagcaaagaagatcctttgattataaaaatccaaaaaaataaaggttttatgtatacctaagcatgatttcagccatgggaagcttgatcaaatctgcaaggaaatcatttctggtttacccatgggagctgaactaccgttggcccgttgcaatcatctgaaggataagctagatcatatgtcattcggaagcttccactgatcgaagaacgagatacatcactatgacggccaagggacaattatctcctacgaataagacctgcaaaccttttgcagacgattggtagtaccgatcatatgaccgatgcggaaatccttttataaagactgtcaagttgatcatagaaaaataatgcaaggatagctgaaagtataagatcgatccccgcgtgaatgcacgatatatctcctcgaaataatgttcagagatcgtcagaactttataaacacgcaaaccactttggctaatgcttatgcattacccagcggatatgccgcggaacattatctcattgtcatcacttatcactcatcacttcattagtcgggtcgggctaaagatcatcaaactgatcaatgatcggtcgagctagtgctccctgctgccatttcacacttgtatgtgcatgcatgtgtgtgaccgaattatcatcatctacctatttcttccatccaaactcagtgcacaaattttgtactccactagccacgaaccggctgggccaactcctatcctggttttctctggatctcgtcaggtgcagtgcagggagggaggtagtgcattgtatgggtttgcagcacgccgccgttgatcaggcagacatgggcaacttttccgttccatacgggctgtccaatgtccattgcccaaattaaatccaagataaaatcaatatccgcagcgatgcgatcagaaacatgaggcaatatatgcgcacaaaatccccctagtgcgtggcgctgctgtactgcaacagagcaaaaaccgtgcatactgccagagaaagaaaagcaatggcagcaacgcgcggacgaaagtgtatttggaaatgtttaatcgtggcctgtccctcggtccctgtaaagcgaccttatcggcttgtgcgtatgttgggtcctttctggtagagtacaagcggtacctgcttctggtacgtactgctgctactaccgacagttttcaaaaaaaaaaaaagaagaagaaaaagaaaaccaaagtataaaactcgttttataaaccgagaaagaataaaaatcagttgagtagattgagtttttatgagataatgatgttctcaaaatttctctgaatttcgagtgcatggcgtttaaggagaggggaacatctgagctcatatgccttgcagtgttcctgtaaaaatatcaaataatgttctgttaatatatgtacaaggtagtagtacatcatgaatgcgacgatacatgccgacttttatgacagtggtaagccggttttattcgtcgtgtaagccgtggtatgaagttgccaagattctctccactgtaaatcgatagagttattctgttaatcaccagaagaagctagcaaagagcggtggctcagccagtttagattcaatcatgtattcgtgtgttcttccggtctgactcgtcccgctggttgattttgtgcggtttgatttgatggacgtttttaaagtttagacctgttcagggtgcttcgttgtagtctggctttcatgtgtcgacgcgtcgtgatcatccggcacgttcagcgggtgcactttcatctcggtttgtcccttcttgtcgtcatcatcctccacctgcttgaagctggcgaggctggccagcgtctcgacggcgtcgacgacgccctcgatcctcgccgatatctctatcagcagcgacgccacggtgaagagcggcatcgcgtccatcagcgacatc

SEQ ID NO: 41601 - DNA, 8230 bp, Oryza sativa
gacgccttggagttgagcacgcacttgtacccctccgacttggccgcggcgggcttcgccgcgaagtagtcctcgacgcagccctcgacggcgccggcgagcttctccatgttgcgcaccgtgaggaggtgcagctcctggccggcccacccggccagatgacgacgcagacggcgaggcagatgacgatgccgatgccgatggtggacatccgctgctgcgccaggtccagcagctggtcgacgcggtaccccgacacggcgacgaggctgaacgtcaggatgaagatggtcacgccgtagtcgaaccgcgccttcaccgttggtatgaaccgcgagaaggtggccgccgcagctgttcaccatgcacgtacgcacgcacgcattattttacttgggtgtcagcgttgcacgtagtatgtgactgtgcaagtctttgtcacggcttacgaaacgagcctaacaaaacaggggcactacgtacggtggaggtaggcttatcaaatacgtacccagtaaaaacagggagccgctgaggatgaacggctcgagcttgtcgccggatttgtccgccacccagttcacgccgagcgcgagcagcccggcgctcgccgtcgcgacggctctgttgaatcccttgtacatgcatccacctgcacacacgcacgagtgtacaaaaacacggtgaggaacacagcaaactgacatgcaagagcatgcagaattcaccacacgacgttgtactactactcaccgacggtgtactcgaagaccacgacaaccgtcatgacggcccacatggcattgccgccgacgccgtcgtacacgggcctggtgtagtagacgatggagacgagggtgagagccaggccgactttgaggctgtgcaccgctctccggggatcgtcggcgccgatcttccacaccttcctggcgaagccggccaccgccgccctgaccgcgaccagcatcctcaccacccacgcccacgccctctcggcgacgccggcctcgtgctccaccgtcaccgacgagccctccggcaccgtcacccgccattccagactgccctgcacctgcgcttccctcgcggcggcgtccatgctgatggcgaccggtacacgagcgccgctgcacacaccagatgggtccctattgtaagcctcgattctctatgtacgcaacgaaaatgcggcctaaatttgcttcaattcgctcgcctttggtaagtacgactgggttgacctctgctctcgttgctttcgtttctgtggcaattattttctggacacacagatatattcctaggaagagtaaagcaagctaccaaagctagtttccaaagagaggaacgtgacaaaggcttctggccaaatgtgatctacctccctatgttggaatgaagtgagaagccatgatatggcttcgtatatatagccatgagagctccggcgtattggactttgacaagggagcacgatcaagggcgatgcaaaagaacgcttgttgcgctgcttgtgtcagccaggcaacgacgaccttgagcacacgaaaggctgggtacctgttagctgcggctaacgggctaaagtgcaacaaccatacagtgcattttggaaagaagattgccgctggaaatatgccgggaagtgggatatcgccaataggacggcgaggtgcggtgacgactatggtgcgatttcttttcaccttgttttgcctgccacgtacgtctgtgcactgttgtgtccctgatctgacttaactctcacttctacgtttgtggcttgtgttcgggcgcgactataaactctctaagctcaacgtgttaccagaattgatatcacgcctgcagcctggtgaagtggtgagggtacatgcaggtacaagcttaagctcgaaaccgtttagctcgttgacgaaaagcaaaagcaaaagcaaaacggatttactattttacttgcgatagatttttgacttctatcatttactttttcgttcgtaaaatctttcatcaaaattcgtattctcgtgtactcaatttacggtcacactcagttacagagcacttatactcagttacaatgtacttatacttagttacatagcacttacattcaattacagtgaaccaaaattatattttacaacagttttttttctagatttacgatttttttttatatatttgtctctttttcttgttatttcatttaaaacgggctatatccattggcatagttattaagaccagaccgaggatcgaaccgctaaggcacacgattcactggtttattggtcggaccaatcaaaccgctggtttaaagcggttcaaatagatgtgtgttataatacatgaacaacatgtgacatagctcgatggttgagacactccttgaaaagaagttcttgggtttgatccctcttagctcttttcctgttttctctaattcgaaactataaatctattgaaagattaataggtagtcccaatgagactttattgcatagtctacgtaggtgataccccgcgctttactgcgggtctacgtaggtgataccccgcgctttactgcgggattcatggataagtatatattaaatattgtcgaaatgatgaaagctgaaatgttgagaaaataatgtgaggaagataatttggcacatacttgttgatctttataatataatattgtagatgatgtgtcatgcttacatgggttttaaataggttataatagtaattgctagtgagtgaatatgtggcatgcttgcatggaattgcttacatgggttttaaataggctataatagtaattgctagtgagtgaagatgtggcatgcttgcatgggattttaaatgggttagaacagtaattgctagtgagtgatgatgtggcatgcttgtatgttgagctttagcttctaataattattagtgggtaccaactatatagaaagtatagattgtttcacctgcttcctatttgaatgacctccaataattagcagtgaactagaaaatggacaatatgccactctattcgtgtgatttcaatgaaatgccacatgctagaggaacgaaaactggagtcctcatccctcttgggttttcgaggcatcaacggtatatgaactaaagtccctaaccctcctaggacttcagggcatcaacagtacatattcaagagacagacaatatctatatactcaagagatttatattatctacatcttcgaggtgtcgagaagagagtcgagatctatatgatctagctatgtcttcaaagagttgaagatacaacttgcaatttttggcatctccttcaagctatgttcataactccttcatcaacgacatcttcgagaaactcgtccaaatcaacaagaaaacctatgacttggccattggagcggccaaggattccccgggcatgtagtgtgccccggatcacggagcccgccccgaaacaagttgcaagcgactcagggccccaggctagggcccaagcacaccctctacctgggctctccgtggagaactccgcccatttataggtaatggtgggtccggaggataaactttgaccaacaccatgatttaactgcagagtgcagcaacctggaaagcagctcaaccgcatgcttcaaggacgtggcatcgcacgcgggctcccgcatgcccacgtcaactgaaggaataggagggacgtgacatgttgcccctcgttctctcccacttagtctcacctcggcacctcgtggaggctgactgatggcccatgacagccgggcatagactttcttgcatgcagctccacttgtcagccgctaggtaaagttggcatattttctaatcaattatcttaagtttggctaagtttataaaaaaatataataatattttcaacacaaaatatatatattatgaaaatatacacaatattatatttaatgaaactaatttggtattgtagatgttgttaatgttttctataaatttaatcaaatttaatcaaatctaaagaagtttgattcagaaaaaagttaaaacaactttgcctgtttcctgagagatatggaaaaaaaaagaaccaaagatctttcagcacaaggagctctcggcgtctagcccattctccaaagtcagcgaggaggccaaaatgtaggcactcatggatgctagaaagctcaccgcttggttaactttgtcgctagaccggatctccggtcctaacttgtagatattttgtctctctatagttttctcatgctcttttaatgaaattggtggctcatcaatttgtttaaaaaaaactttgcttaaatcaactagctaccactacatccacaatcatagcacctgggacaatacacaacaacatatatacaaaatatatttggaattgctgaagatgccgccgcaaccatcacatcttgtttatatgaactatggttgacctaaaaagagttaggagcatatgattactgtacatgttagctatacttaaacgctatggatttaattaatactacctccatattttaatatatgacgctgttgactttttgtccaacatttgaccactcgtcttattcaaaaaatttatgtaattatcatttattttattgtgatttgattcgtcatcaaatattctttaaacatgacataagtattttcatatttgtacaaaaattttgaataaaacgaatggtaaaacgttggttgaaaagtcaacggtgtcatacattaaaatacggagggagtagctatcagttagctttatcattaacatcaatagagagcacaaatgctatgttgctctctttttcaacaatatcaatcatttatcactcgaagcatctccaagagctttgctagatggctctccaagaaaaaatttgacaaacttgagaaagtaaccctccaacacccttatcaacttgaccaaagtcctttccctgttggccaaatctgatcagccaaaatcgttggccatctatgggccctaccgtccgaatctcccctttcccctccctcgccctccctactctctcgcattgtctctccctctcctgcattgctcacttgcattgtcgcctccctgttcgagtgcaatgccaccacctccccttccgtgcgcagcgccgccgcctccccttccgcgcgcaatgccaccgcctttcctttcgtgcgttgcgtcgacgcctccccatccgtcgtagtgttaggccaacaacaacactaacttggccttcatccgctaaaagtagcaggtggcccatcgcatccctgatctcccacgtcgttgtcttccgccttgccgacttgtcgccccctccttctccggcctccgagcgccatcatcacccatcctgatttgcagctattgtagaagagggtttagacactggcatgtggacccataaaatttagagagtgagagatactgttggagcacacggaaaatatagagaagaactttttaactagctagcttaccaaatgagcaaatagaaatcaagtttcgacaaggctctggaagatactcttagctaggtcgcctcttgacacccctatgtatccatacatcattggtacttttcccttgctagatgagttgcaacggatggcgcagcggcggccgtgcaaggcgcatgccgtcgcactccgcacgattttcccgtcaattattataccggatggaaaagagaaggaaacattcgaagacgacctagctagagtcatagagcaaattacctagttccaagttccaacgggattggccatgaaccggaaaagaaccagagctccactcatctaggctctagcgtacttcgtgcgcgcgtacgaggccggccgggtagtggcagcagctgtatccaacagatctagtactagcccgctagcgcggccgaaatatcacgcgcgcgcgacgcgcgatagccaacttgcgcgcgaccaaccggccccgccccgcttgcaactacaactagtacttaagctagaacgcgatagatagcggcttctccggaccccatggccatctccatcgtccttgcttgtcaccaacatcatcgcgcctccgtactacgtactcctcccgcactttggcgtacggcgacgccgccatgattgctagctctttctctcctccggtgaatgcatgctcactggtcagtgttgctgggtggactcgatcacgatggtgtcagtggcgagcacactcgggcagcgcatcaccgtcgccgataaggacgctgcgtcatccgtgcatgcgcgctctctaggtacgtagtgaagagatcgatcgacacagaatctttgctttgctgcgcactactaattcacgaaacttccttcttcggtagctgtaaaatatcagtgcaccggtgtatcctgttgcgcattcgacttcacccaaggagctgagcgagtgagagtggccgtaactattacctgcacacaggtggttgcattctcaactgaacagtcgcaaagctatggcactcaccggactgcccgttctggtagagtcccagatgaaccggcaaaatacggcgagcacgcaaggtgcaggaaaacgcaccttaggatattctctgctttagacagagatccccgttcctctttatgttctgaatcgtacgttctaaagcgagatacacataaaaacggcaccttccccggtttctacatacgtacgttatcgattttttagagcggaatggataacgctgctagcgcctagctgtggccactgcccacagcggcacacggttcaaagtgaagcactgtcatgcacattttcgagccaccaaattgactcactccacactagtatatgcaactgtaccagtacaagttgtgttttacacccctagtatagtctagttccttttcttttctacatcaaacaactttgcgctgcacgattgtaataagaagtggtgaccgatcgaatacctgcatctttgatgtagaggttggtttgatttctactagtatcatcaaagaaaattgcttgtgcaaagatataatggatcataaatacgtcgaactttccaggcatcacaatcagattgttcgaactgaattgacgccacgttctcagcacaatcagcagcgcgtcgtatcgtatgcgtgcttgcttcgtgcgcgcgtaggctgttcggcatttggttctacactgctacggctaccgtgtcggagacgcgtttttccggcttcatcgatgggtgggtgccaagcaccgaggcacacagcatactaagctgctctgctcttctatgattgttcaattaattgtgccctggcgctgctggaacacagccgaactgcttgtgcgacttgacaaagcgcagcaactaccgaataatgttcgcctcatccctttctcgttcagataagagggccatatgcctgtaataatgtagcgagctctttttgaaaatatacgatggcattcaagaattgatcggaaaaaaatggaggcacacatgagtacatgacgtgttagaattatttactcatgatccaatttacttagcttaacacatactttctccgtactcgtaaaggaagtcgttttgaacagcgatacggtctccaaaacataattttgacttcttgtttctataaaaactagcatgatggcccgcgcagattacgcggctagcatcattatattttctctcatataatagcatatatattttctcattatatttttcaaatatattaaaatggcaacataattttaaattttgcaataactttacaaaactactaatgtgtaatattcatattatattgtattacgtgttagttattaattatttttaatatcaaaatttagtaatttgtaaattatatatattcctatatggactctagactcgtcttttaatatttatttttttaattccgaattttctgtaaattgtatttctatatacactctatgctcttcttgtaatattatttatttttatttctgaatttttattatttctaattgtatttctatttggactctaaaactcatctttcaatattctttaatttttaatttcgaatttcagttacttctaaattatattcctatattgactttaaactcttcttcccgtgtttttcttaatttcgaattttagatatttgtaaattatatttttatacggactctaaactctacttttaattttattatatttattccaaattttag

SEQ ID NO: 41602 - DNA, 1870 bp, Oryza sativa
  unsure (1)..(1870): unsure at all n locations
tctaattcctgcagcccctatactctacttctaatattccttatttttaattccgaatttcagttattttctaattgtatttatatattgactctagtctcctcttctaatattccttattttttaattccgaatttctactatttctaaattgtatttctatatggactctagtctcctcttctaatattccttattttttaattccgaatttcagctatttttacattgtatttctatatggactctgtcttttctttttctccgattaatgtgagaatttctaggccatgagagcgaacgtggagggtccttttttattcctttaataatataatagatatttattgaaaagtgatatatgtatacttttatgacagtatttttcaagacaaatctattcatataatttttacattttcaaactcaacttgagagttatttatgatttatattctcaaggtttgtcttaaacattaacctaaacgactttctttacgagtacagagggagtaatcaccttgatataaatgtaaattaaggtgtttactgaccaaatgaattgaatccataagttgcttctgttcattttcttccttttgtccttcttcccttcttcctatttttcttccctgtgttctgtacgtcgggtagaggatgcaacgctaatgcacatagcactacgaatcccttctagtgcaatacatcaatcggactctattagggttttgggatttagcgtaggaattagtcgtcacttcttctcaacactttctttcctttcatttgcactagtggggttcaggggtaatccggatagaactctaggtcctgttcgtttccactaaaaaaaagtgaatgaaaatttggatactcatggcacgcttttcaaactgctaaacgatacgtttcgtgcaaaaactttcaatatgaaagttgctctaaaatataatattaatctattaatcatacgttattttttttagataatggaatagataacatccggcctttgctcaacagagttacagccaattattacattctatcactcgaacaaagagtgtagttcaaatagaattaaacacacccaaacattataaaagtgaccagaccaagataaggaacacacaattattcaagtatatttgtgaacctccatccatggttggcaaaaagttgcataaccgtcgtctcaagcttacggcatgcaaccttcaagagctctccatcttcatcacacttttgcaactgtgaccaaaatcggagccaatatgttgccctgaaaattgcctgcatatatgaagcagatagtgatttgttaaaaaccatatcattcctactcaaccacaaagcctaacatatagcagaagctcctacaagaattagttttgcgtaaaaacttaatttttatcttcatcttcgtttacaggagaatagaacatcacctaagtttgttaccacttatcatagtaacgtttatctcttatcttttattttcttatttgtttcttttttgttagggaagagaacgatgtaacttatctctccctaattatcttggcaataactgataaaatcaaccaccacaacgtagtagtacagagacttacagattgctgcgcattaaaatgttgtttatgcagaatatgtaaattatggaatatatattcagttttctcttaagtacatacatgcatgtgtggactcggatcatttcgtttttacttgcgaaagtacgacaccaatagtaaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41603 - DNA, 4874 bp, Oryza sativa
atactcaagcttggggcatacgagtacactgcaccgggacgctgtttggtgcgcctaattaaacaattcttacatggctgcttagcccacaagacagtcggcggtcagctgacggtcagtgattagcgattaattatatagaacgggtttgtgctttgttagtgcgatgtttcatggatgcatagaaaatagaaatgattgtttaaatcaaggcagtttcttcactcacagtctcacacctgcatgcaaggacctgcagcaaccatggtaccaaactaccaggaaggtgcttaggcttcttccaccacaagataacgaaacacatgcaacgaaattattgagactaacctgatcaggtttcactgtttgtttcaggacactggcaccaacgctttattagcaacatactttatcattactggatcgccaattagcgtttagcgatgacagcatgatctgaagcaggtagatcagaaacattaatttatgttttggataacgtgataattaaacagatccgaaagtacaaacaacgagtgcacttgtacgctgtcacagcatcagaacttcacaggaagtcaagaagaacagagcgctatatgaccagatttttctgacttctgacggcgaccgtagttgcatgcatgatcgaccagtccttgctggattatggacattgagcatgtcatttcgtacgtgctgtagtatacagtatactcgtgtggtctacagagtatatcagttcgattgagatcgatggatatatcagagagatcaagacttaaaaccgcagctagcaaagtctggtttcccggccagctagctgatcaaactaaatgacgacatcaactaaaattaagtgacgtttttctgatggctgatgcatggcgttatatataaaatatactcagtgggcacatgacagactaataattatataaattaaagaggaattttcaaaggcgtgcagtttttctcgtgttaaaattgctgacagtgaagtgttgacggtttgtatcggaccacgtattttacaacaaacttctacggtaacagctagagctagctgtccatgtagatatccaactagccaataagcgccgtgtgtcaattatctgaattataccctatttgtcgtggcatacatggagtgatctgaccaaaaaaaatgccgaaagctagggtgtgtttagttcacaccaaaattagaagtttgattgaaattagaacgatgtgatgaaaaagttgaaagtttgtgtgtgtagaaaagttttgatgtgatggaaaattagaagttcgaagaaaaagtttgaaactaaactcagccctagtagtattaattagctagctttgtctactactccttctgtctcaaaacaaaaaaatgtagagttatatgatacatattttaaaattacatacacatttatagttctagcatatgtcatattcagttaaaggtttttatattttaaagagtaaattacactttggttcatgttttattacctaagttgcacattaggctaggcattagcaaaacttttcactttagacaagattttatcaccaaattttgcaagttggaccagtggcccacgcgtcaaccactgatgtcttcttcctcaatcctcaatcccctacgtgcttccctgctccctcccgattcaatcgaatccactgtgagctcctatggttaatcccttcgagcacgcggacctccactggtgagctctttctagccttacaaactcaccactcatcactgcgccaaagcagacctgcttgagcatataccctgtgccctacatgcagtgaggagtgagaagcccccacatatcccatgattatagctcaagctagccattgccggtaggtaggctccctgacctgagttagcgctagagctcaagatcaaactctaacagagctgaccccgtacgtatttcatctaaatcttcctgtttgcgctacgccatcccaagctcatgtggcagtatgtctaggacaatttgaggtagcttgtcgtgatgggcaatgaggaacgtaggtggtggaggcatgcaaacctgttgggagtaaggaattgcaggttgagatgcaattgcaaagatctggagctcaagctttagctttaatggtggtgtggtggtagctcgttgccgatggtagccaagaaaggatcaacctagtccattgtgaaacatattgtaagaatacctggtctcaagtgaaagcatgaggtagaccctggttcatagtgcaagttgggtaaaataaccttgcccaaagtgtaattcactctattttaaaacgaatggagtatatatgttgtttaaggataagacagtaatatcgttatttctccattttatatttgacagccttctttgtttattttacaacctttgtagattattttaaagatatattccctctatcctaaaaattattcaatccgatgtgtgtgtgtgtctatacacacatacatgctatctagatacatcttcacgattgatttttttcttttttgcaagaggagtagtccctccatccaaaataataacatcgcttttttacccatttcacacataccaatataaattaaaaaatatctttcactttatcaaatcctaatataatttcactttattaaatcctaatataattgttcctcactttatctagttcgaatgtatttttctcacttttataaactctaatgtaatgattacttaaaagatacaaattattttcaggacaaataagatggtgaaagataggttagtttttatgagggagtaagtctagacttggggaagcaactttaaatggtctacgtggttacgagtgtatatacgattccaatttaaaatagaacgtttccatgctgatgtttatgtatttaattaaattcagtgcgtgagaattttgtgagcttctcgcggatttacactgccagagagtgtggtgtcacgatgaaacgacacgcatgggtgtattagtacatatatgagtggtgcttgatgctacgtcgtgtaacgtacgtgtagtaggttgctaattgagcatgtccatgctgtcatttcgttattagtagttgtaacaagctttcttcagccataatgcacctagcacacctttgtttacagatgaagcaatcgtaactgctactgtactagtactatacgtacgattaatgcatactgtacgtgatgatgaatgacacgattgtttatgtccgattgtccatgatcacacataaaaagatcaacttgctatatataaacaccaaaagaagattgccccatgaattaaaaaaaccttaaaaacaaaagaaaagcctgaagcccctccaaaatatagtactaacatcctcatgttgatccgaaaagattcccacctgtcagtgttgttggtcttgtggctcaggtccaatgtaccaagaccttctagaaggaatctatgggggctcgctccacttgcatctgcatgcatgtgacgcagctcgcatggagtatataggagtaaactaacgagtctcaagaaaactaatcatcgccatataccgagattttgagaaaactaatgaacaaccaggtttatttggttatgggatataatcgcttcttaatttgctcaaagcctgcaatctaaccaaactgcgagaaggtctttgccacacctgggacccgtttggttgacaatcataagttgctatcaaactgtcaaactcaaattaagattatgtgctcaaaatctaattagcacaccttagcaagattaagataatcttgtcatcttttcggagtcattagtaatagtatgtactgtctaattcgctagaaggaataaaaatcatgatatttaaacttgattaatcttaggtgtgacaaaatcatgagaaattgcgtccggcaatcaaacagacccttgaccacatcagcctcttgaataaaagtatttcttcttatttattggatttattagactttatcttcttatttgttgaaattgtttagttgcttgtaataaatgatgggagaatggcaaatataccactacttaattttacctcctaacttggaatagccattaaaaaaactgcaaatttaccactagaatagcttccatttaccattgttgtttgatgtgtgcaattaagaggctaaaaataattcataaaacaaatgtgaaaaatcaagggaataataagaccgattccctatctgcctctcttcaaaccctggcagcactcatttgttccctttgcccatcccctcctctcttccttgaggaaacctagatcccaaatccccttattacctgttcttttaaatcgagagcaaattatcggatagatcggtcataataaggtacaagatggcgatggaagagttacaggatatgtattttagccggtagcaaatcgagcaggcggcggtggcggcttgggtgacggactgcggaggcacgcgcaacagcggtcgggtttgcagcggcttgggcagtagcagcagcaggcgactgcagcttgggcctaggtaggcgctgaggcggtcaattatggaggtagctacaaataaaaacgacgatggcggaggcgggtgttgcggcggtcgattatgcagtctattgcggctgagaagcgcaggcgcagcagctaactatggtgatagcagatgagcagcatggactacatcaacaacaacaacaacaacaacaacaacaacaacaacaacaacaacaacaacaacaacatgaggatggctgttaatcttgcaaagttgtggcagctgttactgtggcttttataattttcataaaaccaagatttctaatgatgtttgttcaatctgtcaatccgatggcag

SEQ ID NO: 41604 - DNA, 37476 bp, Oryza sativa
ccgtgaccccgctcatcctggacgcgtcctgtctgtcctttgtgcgtaataaagtgcgtgtgtccacatgccgacgtggaggaagggccccgcagccccgctgcgacgcaccacgccgtctgctgatgtgtcgctcgcgctgcctcgggccagcgtgcggccggcgtgcgggagcggcgtgtctggctcgggaccaccacgtggggccgtgggggaacttggtggccaaggcaattctgtgtccgtggccttcggtgaacccggcccatgcgccgtatagtataatccacacatgacacagcgcaccgcgccaatcacagtccaggaaccgcgagaatttttttatttttaacttggcgagatttctcgctgacacggtcaatcggccactgcacacgggagtgtacaggaccaagcgggtcaattacggctaatcctaaatacagcgacgacgggcggttcgtgggtactacgtactagtagcatatatccatcttagagtaccatctaaatctatgcttctaatttatagtactctggatattttctcacggtaatcatagaaataaaacgcataaggtaaccaaatataacttaaaacagatgaagtttaaaagtcgcaccaaaaagtccaaactttaggagacatcaccttctgcatccctcgacccttctcttcctcactcaagtctacttttccttttgtgttctgtctgtacatatctaatgctcttgagctgtgttatttcttatggcttcccaacctatctctatcattttttcatatgcacgcttttcaaactgctaaacggcacatgttttgaaaaagtttatataagaaagttgctttaaaaatcatatcaatccatttttcaaatttttatagctaatacttaattaagcacgtgttaatttatcgctctgttttccgtgtggtggggaggggttccaaaagaatacagccaagtgtgtaaagcgatatactcaagtactcaaccctagtacaaaggtatgcgctttacaaattatagaaaagaattaaaacagttgaaatttagaaactccccaaatttaaaatgttcacgttaataaaaaaaacaaattatcaaccctagtataaagatatatacacgctatttgcgtattccagaaataaaattaaaacaactgaaatttagaaactccccaaataaaaaaatgttcatattaataaagaaaatcaaattaccaccatgagttaagaatactactatacttgatgtagatgtagctcgtgcatgcaggcactatatgagctgtctgccacagttaggggatggccatggatggaccgatgccttgttttctatcgacgtcacgatttatatctctgcgactatgatcacatacggatgctaatgtatgtacagtacgtaaggatggtcacatgtacaggttataatatggagcaatccatgtcgagtcatcggtattctatatgccaattggtaaattaagtagtacggagtagtagttagtcagtcactcagtcttattgcttagttgcttaagacattttgtgtggagttagctgattaattaaatatctcttgccaagggaacagcgaattgatcatcgaccaaatacttggttatttgctagctactcaaatacactcaatacttgatcacaacgtacgtctacacttgtactcttcgtctacgctcgtctcccgagtttatagtgcagacaactaagtttcaaaaaaaaaaaaaaaccaagttcgtctagaattggcctttcgatgtgtaaaataaatatgcgcatgacctatatacttcaacctgaacgtgtcagaaagaacatagattgaacacgcaagctagtgggtgttaatggcgtgcatatttcatcaaattcagtgaggctatccattttacatttccccgctaaaaaagataagggtatgaatagagttacaaagtctagcattttagcgacccacttactctctcctagaataattagatattttattactaaaaccaaggagaaataaaacttcgaccgtaagctacttggttgcatacatgtacgtgggttgctctcgctattattaacgacacgacgaaattaaatgctgcatgcatgtcctccattcaattaaacaccgcatgtatattttcccattcgtaagatgctcttttttttctccttatacactcatcatccttgtatagacttaaaaaggttaacaattcttaccctaccaatcatctgttagactatttggctctgtaggttgggatcttctactcactcgtttttcacagacacatttctcgaacggttaaatgatatgtgttttgcaaatattttctataggaaagttgttctaaaaattatattagtccattttcaaggttttttttcttcaaatacttgattaattatgggctaccttatttttcgtgcagaagaaataggttgaacacactttcgaacacaaccttaattttgaatagtacctgctacctatatgaattgaaaccaattcttgccaattcgatagagttgaaacaatacaacactaccaaaattttgatagtaccaaaacttatttaaaatttagtgcggcaagtttttgatacaacttcaaaccaaaaacaaccctttctatcaaactgatgccaaatttgatatgtttgcagctgcacgctgctatcacacccatctggctagagtcaccaagctgctcaatcagtcaaaccgtcaaagtatcgaccaccacaacaaacgtccccggtgatgatgtggatcaccacaacaacaaaatacttctggcccaagtcggccagtaatcaacaatccggtctacggacacggtccaccccccgcacccagctctcggcccaggaggccgctcgcgctcgttccacgaaccttccccacggcgcaacccctctccgtgaacccgcccgcatcccacctccgcggccgtggaccaggcgcagggaaggtgtcgacacttcggctgcgcgagcgcatagcctcggttttaatagtcggcgaacggctcgggccaggccaacctgcgcctctcgaaaacactggtccgcctccgttcccctctcctctcggctctcttatctcacccttcgtttcgctcgtctccctcccgccgcagcaggtacgcgacgcgagctctcgtcggctgcgatgttgtgcgtgctgtttacgggtgacgggtcggactagccggcgcgtgggctcgacgaggcgctgctccttcgtcgccgcgggtttctgatttttgttttaattttcgtggtgttttttttggcgcatttgctaggtggggggattcgagtgttgggaggtttgcatgctctgtggtggcggtagagttggtggtggtggtggatacagatggtcatggatgctggggtgcacgacgtgtgcacgatgctgcccggatccaagcgcgacgcgcacctgccgctgccaatctacccccaaatcgccgccgccaatgggttcgcgacggcggaggagttcgacccgctgctgttcctttcgcccgatgcggtttgcggcggcggcggcggcgactacctgaatattgtctccgcgcagcccatctcggcggcctccaccaacggcgcgtcgccgccgagagatgtctcggtctctgcttcggcggcgtcgtcggcggcggcgcagcatgacgactccgaggctttctcggatatcgtcctggggtacatcaaccgcatgctcatggccgaggacatcgacgagaagttcgagcactacccggtgaacgccgatgatctgctcgccgccgagaagccgttcctcgagatcctcgccgaccagtcgccgtactcgggcggcagctcggtcgagagtcccgacggcagcagcgccgccaactcctgtaacagcctcagtccctgcaactgtagctcgtcctccgacgggcttggcgccgtgccgcagacgccggtcctcgagttccccacggccgccttctcgcagacgccccagctgtacggggatctgatccccacggggggcatggtggaatcgggcggcgcctggccgtacgacccgacggaattctatcagctccagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgaggcgaggctggcaggtactggtagtcaaatttacaagaactacacgataactcggcttccatgcactgatgtgctgaaagcgtaccagctttatttggcagcttgcccatttaagaagatctctcattactttgccaatcaaacaattttgaatgctgtggagaaggccaagaaagttcacattgtcgattatggcatatactatggatttcagtggccgtgtcttattcagcggctatctaacaggcctggaggcccaccaaagcttaggatcactggaattgacacacctcagcctggtttccgcccagcagaacgcacagaggagacggggagatatctaagtgattatgctcagaccttcaatgttccttttgaattccaagctattgcgtctcgatttgaggctgtccggatggaggatctccacattgaggaggatgaggttctgattgtcaactgcatgttcaaattcaagaatttgatggatgagagtgtggtggctgagagtccaaggaacatggcattgaagacaattaggaagatgaacccacatgtgttcattcatggggtggtgaatggatcttacaatgcaccattttttgtgacacgcttccgggaggccttgttccactattctgctatcttcgacatgttggagactaacattcccaaggataatgagcagaggttgctcattgagtctgctctatttagccgggaggcaatcaatgtgatctcttgtgagggactggagaggatggagaggccagagacatacaagcaatggcaggtacggaaccagagggttgggttcaagcagttgccattgaaccaggatatgatgaagcgtgcgcgggagaaggtcaggtgctaccacaaggacttcatcatcgatgaggacaacaggtggttactacaaggatggaaagggcgcattttgttcgcactgtcgacatggaagccagataatcgatcatcttcatagcttgttcagctctaattattgcatgatattgtaaatgtagacctgttcatatttttttggggggcatttggaccgattgttcctggtaggcaatatattgctaggtatgttatttgaacaaccaagtaatgggaaacttctgcttaggaattgtcttatatgatgatctggttcatctctgtccgtacataagatgaacccgcctgttcctagaatctctgcacatttgttgtgatcattattgttgcttccgacgggaacagttggttcaattttggtggagctgctagatatgttgaagttgtagaccttgggttgtcttatgtatggatgagccttgtacagtatttcttccaaacattcagtacttgtcactaagttctggttctggataatctatcatgcacgtgcattctctattcgtacttgttgaattgttcgacctgtttgttgaattggctggcatctgttctgttacattacatctggggttgggaaaggcaagtatgccaccatggcaacttgatactgcattagcgccgtgtcgcatataggcaatgtgtttatccatagaaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacatccacacaacacgtccacgtataagaagcaaacatagcacagcaactcagcaagaagcatcggtcacggcagaaagttaccgcccagctcggcgataaacaattacagacaagccaggtcgtcgtcactcgtcacacacattggcggcttggcgcgaacaaatcggcaaatctgtcgtgcgcggccaagacgctaaaccaagatgataaaagccgcggacacccagccgctacggacgaggagtacacgtggccgtgctcccctccaaaaaaagaaaaatataccgttcacactaggtcaccactcaccacaagtgcaggttcagctcaatacaggttcactgaacacgactagcagcagtacatgttggcaggaagaaatgaacaatgcgatcaagcagaaagatatactactccctccgtcccataatataagtgattttaagtttttgtttataacgtttgaccactcgttttatttaatttttttttcaaaaataaaaaacgaaaagttgtgcttaaaacactgtagataataaagtaagtcacaaataaaataaataataatttaaattttttttgaataagacgagtggtcaaatgttgcaagaaaaaactcaaaatcacttatattatgggacggagggagtagtactttggtgtctgccctgggtattatactgctcaactggattcggttcgcatcagatgggtatatacaaaactcgcaactgcatcagtttttataatttttttatgtacggcgtgacagcggtggtactgtttgtgtgaaggccaagttgagaattttgtttgcagcataatgttccctcgagtcgtctccgtgcagtgtacacgtgaagaaagtagggaggcagcaggatgtacaagaatgccgtcatgcaagttgtggtgtcaactcgcgcctaagacggaaaagaaaattggttttgtctgcccataggcgtttgacggagcaaacaggggagaaccgattgatccatttggattagtgtcaatcaagtgtcaacgtctctgggaagcctagatgaccctgctttggtcaatgttgatagcgacggatgtggagagattacagtgttgagttgttgacgaggcgaaattacatttggaattcgcaaagagtacgactggctaaaggaagaagatgtgaaactcgtagctgggccaagtccgggtgagccacaggcccatagtcttagatgctgtggcccgcttaggactatgaagcccaaatgaaggcccacttaggaccatctgattagtcacaaacgaagattagtcaccgttgcgctgcattcacttcagatgaaaatttcctccttcaagaagtagatggcaatgcgacatgtgcgcttaaatgtccagttcttctttcgcaagctgggtcggctcaatttggcgttagctgttatgtagctatctccgtgtgtatcggaaaattgtacagcccaatcttctttgtcagcaaagacatacgagcacctttcagttatgctgtccatctacctagaatcctccttgcctccttcgctatgtatatttctcaatagcgactagaatccgcataattgtcacgtctacctagaaatcgctagattcagaccgaaggtacatttgacatgggcatcgattgtgacatgtttatgagactagtttttgttgatttttctgctgtttcaggtcatattgggtgatcactgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataagattataccccaagaatggtcctccgctggagtttgaggcagtattgcctccgtaggtctcttggtccatgtacatgtgtgaacctgtaatgcagagttaccatttatcttggaaatcatccatatcttcaatcaattctctcctagtagtttcaaggcggttcaaaaaaaaaaacaagtgaaatccacatatttatctagtttggaacaaagtgcacaaccatgaaattgagaggttccatccacctgtactattttatttattccctcacctcagattagactcatgctgtaactaaggtatttgacatctacaaatggagcctttcaaagttaatttctactacctgtaaagactgttgtcaggaaaaaaattcaggtttaaaaaaataggaaaaagattcagagaaatacagattaaatgtaaccatgttctgatgttctgtttcctgcgtctaaagaaacaacaattcccagagcaatgaactatgttcaaaaccaattcgcgcccgcatttggttgatattgtgttcagctgtgtatcaatgttatcgcctcatctcacctagtagtaaaaaggcaattaatccagagagggaaaaggtttagttacgatgtgcgtctcgcagtcgcaggcgtataagagatagctgagcggcgaagcacggcgaccgtcatcgtcatacggcgtcttctctggagacttgattcgtgaactcgaagaactacaggagcaattttctggatttttccctccgtaatcatgtgtaacatccaaatctggatagggtgaattggtgaaatccattagatgaaaaattggtggccaagcagacattttttttggataccgttagatctaaactgcacggtccacgtcgctcactaggactggatggtgtattttcttcaaaaaccccctttagtttccgagtattatatcgctcttacatcgatctctctgcacctcgtccccttcctcgccagcgccgagcacaaccaacctctgacagtgtggtcattgcgcaaagtgtaagctattcacttcgcgtgaaggataaagcttacctcctccttcaaggcgaaaatgacgtgttatgttggatgccagattctccagttttgcaagcagcgccatcgcaattttggactagctaatgtgcagctttcccagcctctgttccaaaactgtgtggtagctggagtctctgctttgtcagcaaggccagatgaacacacctaacccgtctctctgcgttgtgctgctgaactgcggctatctgtacagaatcagatataatagcccatctaccttaacagtcactagttttagaactataaagcttgttatatggatttccaggttattagtactatttgatagtaccttttcttctagttggagtacttgattagtttttgtgccatgatccgtgcaccggacttgttttggttggtcttgttgctgtctcaggatctgtgagctgatccatgtacctgtctgtaatagtatttttaattgccccttttattcttatgtaaatacagcatcacctttctttaggagttaaaaccatcgtttactctttaacttatcagctgtagccaaactttaaattttacaactcaatttttgagttgatttttccatcatagtttatttgttttattgacttctctgagaatacatatataaaaactttacgaccaaatcattttttattggtaataagtgttacgcttataaataattaactgtaggtgaaatgatggaagtaatatattttctcttgattttagatagtttgaattcaagttgtgggaaacaaatccacagatttgtttaattgggaaagaaaatggatactcatgaaagaaaaatataggcaaaaaggacaacgtacaaggagtgttctggaacagtttcatgcaattaatgcccatttttttattcaaagaagcatcaaaacagtgtcattgtatagttgtacacaaataaaagaaaaaagaacaaaataatgtcacaaaagttagctaagaacgggctaacacactaaaatctccttcaggagaaagcaatcgcaaattggcgaacaaatgaaatgaggaaagaagaatcaacggcatctgtggtaaggtcccgactagcatttgggcagatcggacggcggaggaagcagcttctggttcggatggctcccatccaacactagccatgccatcctcaggccccacgtcgtgtgcgcctccaaatgacagtgcatgaaccatacacctgcacgcacataattgcacaacaaaaattattagcagggtagtactatatctaagacgaatttcacgtacactaattgcagagataactaactaactaactcacctgggttgtcagcgaggaaacggatggccacccatccgccggccggcacgccgacggtgttgcgctcgacggggtcgacgaggttgaacttggccgggtcgttcacggcgtcgtagttgccgaacccttggccgatcacgaagaagttgaagccgtgcaggtgcagcgggtggctctcgatgcccaggatgctggtgtcctgcatcaccagctccaccgacgtgttgtaccgcagcaccagcagcttggtcccggtcttcacgttggtgttgttcggcggcgtccccgtgtagttgaacggcgacagcggcgcgacggggaagtccggcgcgtacacgccgctggagagtccggtgaagtgggactgcagcagcgccctcgccgggagcacgaaggagacgttgttcatggacgccgccatctgcgtgttgttggggccctggcaggtcatgttcgccgggcacggcagcgtgcccagcccgaccgtgaagaagaatcgcttgtcaaccgactgcggcacggccgccgggtactccggcgtcgcgaggctacggagcttgtcggtgaagttggtgacgaagtcggtgtcgttgagctgcggcagcgtcggcttgaacagcggcaagcccttgacgaagctcgccgcggagggcgacatggcggggttctcgtactcgaggatgccggcgacggtcgtgttgccgaaggtcccaggcctggcggtggagtagggcgcggcggacatgtagaagttggcgccggggtagtacggcttggcggtgaggagcacgttggggtctgccccggcgagatcaccagggtgtcgacggtgaacggcttgacgtagacggcgtcgacctcgacgacggtgagcgtgtggttggcgacggcgaagaagagctcctcgttgagcgcggcgttgatgaggcgcagcatgtacgttttcccgggtttcaccttcagcttgaacgtgtctgcatccacgcgcacgcacgcatgccaacggtaaccagagtcagcacgtttcaatattcactaatcaccagctaaattcttcgacggcgacgtgcatgaatggaaagcgcacctagctcccctagctatgtcgcaactaagattttgtttacgtgacaccagccggacccaataacagagtttgcttttccaatggaccaaaaatgttaggtcgagtaccacgctcagatcccacgacagtgacacaccgcattaattcggagcaacaaatgcacaatcccatgcatctccgttacgagaaaggaacacggaatcttctccgtccacctttggtgatttgatctgttaccaacctccggagccgaattctctcacgcgccaaaaaagatgcaggaggaagcacagtactcgtgcacggtaacgtttgtctctgttttttttcttggaaacaaaaaaaaaaggttattaatttgtggttaaccgggcgaaatgcacgtaccttgggcagagcagttgtagagagggccggggaggccgttgatggtgaaggcgtcggagacgttcgggcctccgccggtctggaccgcctggttgaccacctcctccgtgtccgcgttccaccactcgcctacgcgacaaacgcaacaatcaaattaaaaggtagcgagcccctgatcatgcaatgatcagtaagtatgcatatatgtcgcgacgttgcgtgcaaaccgacgcgatgcgcgacgtcgtacgacgacgtaatgcgtgcagcgtgcgtacgtacgtaccgaagatgacggggacctccttgtgcggggcggggaaggggtaggggacgccgagcttggggaggatgacgagggcgccgtagacggtggcgcggagccaggagatgtgggcgtgccaccacagggtgccgcgctgcccggccaccgtgaagttgtacacgtagctctgccccgtctggatcgggcactgcgtgatgtacgccggcccgtccgcccacccggtccgcacctgccggacgccgtgcctgcacgtacgcacgaatgcaccatcgatcggatcaaaaaactaaagcgtgaggaatcgtatcgatcggtacggtggcttaccagtgcaacgagatgttgtgcgcgacgttgtgggtgacgcggatgacgacgcggtcgccttccctcgccaccagctccggcccggggcactgcccgttcaccgtcaccatgctcttggtgttgcacagcctcgtcgcgttcgccatttgcacctgcatgcagatcgatcgatcgatcaatcaatcaatcaatcaattaagtttttcatcaaggcgagatcactttgcattggctatgcgtgtgcaggcatacattgaattcgtagtgcctagtgatgccctgagcttggacgatgagaagcagtagggaagccgccaagagtagagggctaggaagagcagaggagatagccatggtcatcttaatttgtgtagcctaagctttgagccacaatctgtaatggctcttgatcagctagctctgtgagactttgagtgggagatggcctggcaaggatggaatgaatgttgggaaaaagcactcgagtcgtctacatatatataggacatgccaagtgtgtcgcaaccaccaccgccatttctttgagggttttttttttctacacgcgcggccgtaggcgaggagatacgcagcttaggcgacacctcttgtttggtgattcggtagatgaacgatcaagggaggagcttgagcttgagctagctagctagtgctctgtttttggagtgtagccaaagccagcggcaaccatgcatctgtttttcagtcttttgaccatgcatgcgtgttttgttgtatgtaccatccatgcaatggatcgatcgcctgaactgtgttgattaatttgcatgcatagtggcacgtactgtttctgatatgatgcaaaagcttgctgaaactgaaagttaaaactatgcaaactaataaaataaagaagttggtttactgcgaattggttacaatgcaagaatcgaccttttgagattcaaaacatagcactgatatcgggatgtagattttaaaggatgtactcttgttttagcgccatatcgtctagaaaatcatcaaaaacatttagagagaatgacaaaatatataaatatgtggtatattatgtattccactaacatatgtaagtttaaatatgacttgcataaatataatacaaacacatcgttaattttttttacatgtacaagttaaatttaaatttggatgtttctgaagtgatatatcttcattgatctatactgttaatttgtactacctccatcccaaaatagctaaaaatacgtatattttgagatagatggagtatattgttaaaaggactttttaatgactttttcgatgacatgtaaaaaacgaggggacgttctcgagtgccaaatagactttccacttgtccaagtaatgaaccagtgaattaagtcttgcactaaacatgttggaaatgaaatatctttgggggcatacattgtcagttgtcaaaactgttgaatcaatgtgatggttactttattcagaaactaaaacgaacggttccacatgaatgtactctttgtactttctagctgatttggttccacataaatccattcgatcaagtgccaataagtcaaacatgatctaatatgcaaataacttcgagcatgtattaggtgtactccatacatataaaatcatgacaacttaaaccaaaattcatataggagctgacatgtcagaagttattggccctatattttgataaggtacttcgttctctattcttctagataccatactatcttatgggtacattcaaggttaggttgtgcagcttaatcgaattaaacatcacacgacacacgtaccatacacgcagtgcagggagtacttcccctgttacatcgagattagctccttttgaaaagcacttcgatcgacggacaattattttgtcaatcaccatcagcaacctacatatatagtggtagtagtatagcaagctaggcatgcagtttaatttcgtcaatgtccattctgatataccttcaaagttcaccataatcatatcgctaagcggtaacatcacttcctgatatgctcgtcccttgttttcacctacagtacaatgaacctaggctttttattttttatgtatatataatatatgctcaacaatggctaagttgcatgatcacttgacatggatcccaagatatatatctatccagtaggtgcaacctgcatggttggtgtagtctagggtggcttctttccttgtactattcccaacggggagaaggatgcttgacccaaccagaccgagcgctgcaacatttttcttcgtattatattgactcgaacagaagcatgatcaacagtaagatggcatcgccaaatgcatctcgcagttcgtaccttttcagacacttcttccctgttgtttgtttatttggaatgctcaaagcatataccttaaaggcttttataaaattgcaaacttagtatatacttcatccgtcccacaatataagagattttgagtatatgtaacatatcctgaagtactacgaatctggacaacctaaagtcttttacattttagatggaggaagtaatatagtatataggaagtggattttgatccctcgagaggatatcctctcgttgtttgcaatgccattcaaatggttatgaaaaatttgaaaaaatttgagatgatgtattaacatgtgatatatcactccacaaacatgcaagtaaaaattcaacttctatatcttgcaacgaaattaacaaatttaactctaaatatacgttaactagctacggtttaatttgatttttttcgttacttataaaattaaatactactagtaaaacaaattgaacaaaaaccagtcattggttggtaggttccttatggtataacccattcaactaatttcaagccctagttacggctctaatgtttatcacatgacaacgctatattgttgtatctatcgtatattattaagataggaagaaaagtaaccaccacacttttactctaggtccagaaattaacgcttagtagaaggaaaagaagaaaaatatgcactatttgataatgatagatctagattataacggctaatcaatatagttggatactactactgtatttgtgaaaatataagcaatatttgcatgtcaaatccagttgtattttgaatataaaatctatagctacataaaaaattgcccgggaaattctactagttaatatatgtagaataaaaataagttatatagttcttaaccaaagaatacgaatatataatagctcatctgaaacgacatgctttattcagaagcaaaatgtgatatattatttgttattttgttagtagcatcgtggaaatccatacccattacttttgaatatgaattgcataaaagtagtgagatatagggaaaaaggcaatcaagattttccattcgagtatcatctttcttcaacatgtgtgtcagagttatggataccatatacctaatagtagttgactaaatctcggcaggacccaccacataccatgtcttctacggaaacaaccttcggatataggaggagttccgcataaggaaggatgaatagagttctacatggaaacgacaaggactactcggattgtatccatatggtttccttagttctactagcttggacaaggggacacctatgggtataaatacaagaccctctaggaggagaggggagacggaatgtagcgcccgttccatcgtggcgcctagcgggaaaactatctcttaaaaaaaaccctaattgcgaaatctgtttctttgcttgttgtctagtgtctgtgccatctcagatctcaaatccccgatctatcgtcaagttcaatcccgaatccaaatccttcccaaatcaaatccctccgcaaaagtctatttcgcctccctcaggttcgatgggccgaattcctctcggcccatctacccctggggcggcgtctctgtctctcgcggtgggtctcgctctgggtcggccccggtctgggggtgcgctccagacgctgggtcggggatccggccgagccgagcgccctccgccctcgctgccgctttccgccgacgccgcccaaatcgccgcgccgcccgttgcttcccgcgcgcgcgcgcgccgtggtggccgaccgcctggtcgccgccgccgtcagcctctgccgtgcctgtccgcgcctgccgtccgtgtcgccgctccgctccacaccgcccccgccgtcatcgctgtcgtcacaacccggccccgccactccgcgcgctagcttccaagggacgaaggcagagcttcccccctctgccgcgtcgccctctctccctcctccttttccccaaagtggcaagggggcaagccccctttcccctcctccttttccccttttctctcccgccggtgtcattccccccgcccccccgtcgccgctttggccgcgaccgccgagcgctagctccctcccttgaccgccctaggtcggttcccaaatcgacgttgccaccctataaagcccaggcgccctctctcccttctcctcttgttttgtcccatcgcctctactccattatcgccgcctcccgtgctccgttcatcgtcgcgcgtgtcggaggagccggcacgagcgaggacgcggaaggggactccgggcgcgccctcttcttcctcttccctggcccgaggccggagagatcactcccgtgccgtcggcctctcgtctcagcgccccgcctcgtcccggtagtgcctccctccgttctccctcctcgttccatctcctccccttagactcgggtagtagcacgagtagcctccccgtagctagctggcgccgccccgaccgttgccgccgctcgctgtatgctcgccgccgtcgccgcccgtgctccgtagcgcctgctcgtcgccggcctcgcttggcatagctccgcccaatccgacgctagcaatgggttcccgtagccgtgtagatgctctcaccgctgggaatcggcccctcgtgacctcgtcgccgtttcccccttttctctccgccggttgccgccgccgcaatccgccgccgacggactccctccggcgaatccaagccgttggctcgctccctctcgttctccctcatcatcccggtgtacgtcccgtcgcccctcgtcgtcgcacgacgtcccggagaaaccgccgccgcccgccgtccattcgcggccggcgccttcgtcttcctccagccggcccgcgtcgcagccacgtaggcgccacgtcggagccacctcggcacgaccggatcggctgacccggccagccgctccctccgttccccccccccgtgcgcatggtccgcggtgagccatgaggctgcgcgtgggcccgccgcaccgcgtcctccgcgaaccgcgcgcatgcgtcgcggctccctccctaaaccctagcacgccccgcgtgcacctcgctcacggtgagccgagtcgccgacaagcgggtcccacccgagaccacgcgggatggacccggcccaccggctctctctctctcccctccccgcccccgcgcgcgctttgggccgccttcttgggccggccggcccattaagctcggtcgagccgcccctttctctcgggccgcgccctagccgcccgaggaaagtctaatttccctccctccttcctttcctttcttttctttttcaaaaaggatttaaataaatccttttcctttagactaaaaatccaataatcttagaaattcaatatcttcccaaccgtaagtccgtttgactccgttcaacttccaaaatttctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgtattgataggattgcacttaatctgcttgtcccgtctgcaaggcagattggcggacgtacctaacttgttgcatctgatccttccattgttaattgttataccatgtcccccttaaccccttagttgcgcctcggtaatcgtgcactctgtacgagtatcgacggtcgccttcaaacttaaaatctgagaaacatcctgggtaaaacttgggttttacaaaagactcggaaaaacccgacacctgggtcggtgcttgcgaactaaatgaatttccaaaattgcggaccggggaatgtaccgggtgtacagtttcccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacaatatggtatgggacctgatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatgtgaggtgattcctagcgtagttttgttttactactgctttgtgaaatttgctgatgtggtttgggattgatgtttggaaaatctgcggctgatgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccatactcacccttgctctacataaataatccccccagttgctgaagaagatgaaacggatcccgctgacgaggagttcttccaggagcaagccggctacgatgagttttagggtttcggcctagttcccaagtcgcgcctgtgatgtttggtcgaagtcttggcttccgcttcccttttgtaatgcagttgtgagctcgggatctgtccgcagcccaacatgactgtactcctactctataataaagagacctctgttgctgtgatattctgccttcctgtgataccagcactgtttcttgggactggtatcgactaacaggttaatttggagcgtcacgggctagttccgctcgggactagttcggggcgtgacacagaacaatagatcaagacaaaagatcaacatacaagccaacatatgccaagacaagctgccggatatcgacatcagagatatgcctggatcaaccctatccggtacctatagagaccggctgtagggatttaacgttgtctctgatctcgccgggcacgaactcgaggaggaaggctaccctgttgtcgactacgagtcagaccttcagaccgccatgtcgataacagttagataggttaccccaaatattgtactggtgcgattatggtgaatatataagagcaataccggcttcggccaacaggatgtagggttattatctgacaattcaggggcccgaacctgtataaaaatccttgtatctatcttttttaccttagtctgagatctatcctagtaccaacgatccccatactatgcaaataccggaatcgcgacatcaaacatcgacaatgtgagttatgtatccacatgtcaataagatcaaacagaggtgcagattgatgtcaaagtgtgaagagcagctagattgtcattaatttattattcccaaatttcatgacagtacaatttattctataatcaagcagtaattaacctcaatgattaactctaaacgggttatgttcaaggcttggaaccagtgtactttaattttaacagtatatggatgtgcatgtttagtgggttgagtaaagattctgccacactccaggagatatttgatgactgaaaaattcctagcatacggtggaagccgcacacacgtgtgtttggtggtttgcgttggtgactgcataggagtctcgttgtaatctcttcaaaaaaaaaatgtgagaaagaagtcgcctcctaatttttcaagtctctgtcccaaatcaaatattttttttcttggaaaaaggtgataacgataccgcccgttattttcattgatatgaaatgttttgtaacctaagcattgtgtgggtcaggttactacctaaatattttgattggctgctttttattgggtcctgcataacagttaacgagtgttattattttttcttagaaaatttaacaaggtagactttggggacttggatacactttgtaggccttttattatttaaacctttgatttgatttcactcctgtgttgctggagctgccaaaaacagacttgccacacaaccacaatatattccttatcagtaaagtgaattggcaattttattgcggtattttttttaaaaaaaagtgaaactttgattaaaaaaaacattctcaagcaaccacaatctattcctgtcatagcaagctaatcccctagtcaatactagttacaccaaaatcaccgaggtaaatgagttactccaaaacaatataacaaacattgattaatatgaaatagtacataaaaaaatcctttgccgtacatcaaatgatggtacaaattattgggatgaacgtggatttatgatccagctccctcatatgttacaaaaggtgacaaataataatgagaagcccaaaattaaaggccttgcgtctgatcaagaaacttgcccatgatcattcgtacatcagctaaccagatgacgacacaacttcggaaaggcacaccactacaagaaaagcattccatagcaccaaccgcgagcaatcaacagaagcaagctagcaaaagcagaggagtatccgagtatcctacagggaagctgatgagcaagacgcaatctctgtctctggtcggccggtgtcgatcggttagcatttggggagatcggacggcggagggaggatcttctggttgggtaggctcccgtcctgcaccacccatgccatcttcaggccccagctgacgtgcacctccaagtggcaatgcatgaaccatacccctgcacacgtccaagcaaaagtagcgaattagttgcaaatttcaactcatgtgtgcgcagccaaatctgttttctcgcttattgatcagaaatgcaatgtaagaataaaaaaaatcaataaaatgttgcaataatgcaatgattctcacctggattgtccacgaggaagcgaatggcaacccagccggccgccggcacgccgacggtgttgcgctcgacggggtcgacgaggttgtacttggccgggtcgttcacggggtcgaagttgccgaacccttggccgacgacgaagaagttgaagccgtgcaggtggaacgggtggctctcggcgccaaggacgctggtgccctgcatcaccagctcgaccgacgcgccgtacgggagcacgaccagcctcgtcccgttggacacgttggtgttgttcggcggcgtcccggtgtagttgaacggcgacagcggcatggccgggaagttggaggcgtacaccccgttggacctgccggtgtagtgcgactgcagcagcgccgtggaggggagcacgaaggagacgttgttcacggccgccgcgaaccggctcccgttgggaccctggcacgtcccgttcacggcgcaggggtgcgtgcccaggccgacggtgaagaagaaccgcgtgtccacctgctgcggcacgttcgccgggtactccgccgtggcgaagctgcggagctttgcggtgtagttggagacgaagctggtgtcgttgatctgcggcagggtgggcctgagcaccgggaggttcttgttgaacgccgcggtggagtgggagctggggtcctcgtactcgaggattcccgcgacggtggtgttgtcgaacgtgccggacatcgccgtggagtatggcgccgccagcatgtagaacgtcgcaccggggtacgacggcttggtggtgaggagcacgttggtggtctggcccggggtgatgaggagggtgtccacggtgaatggcttgacgtagaccgcgtcgacgtcgaccacggtgagcgtgtgcccggcgatggagaagaagagctcgtcattgagcgcagcgttgatgagccgcagcatgtacgtcttcccggcctccaccttcagcttgaacgtatctgcatgccacacaatgcgtatgcgtataatcaaaatgtactagctagctagcttatagctgcaagtgtacagcacagtgcaccacctttggcagagcagttgtagagcggcccagggaggccattgatggtgaacgcgtcggagacgttcgggcctccgccggtctgcgtcgcctggcttatcaccgcctccgtgtccgccttccaccactcgcctaccacccaaacaaaacaaacgcaatttaacccctgatcactgatcagtcgccatgtttgttacgcttacgtacagacccacgccacgcgacagtacgtctgtcgtcgatcattacataccgaagacgacggggacctccttgtccggcgccgggaacgggtaggggacgccggccttggggaggatgatgatggggccgtacacggtggcgcggagccaggagatgtgcgcgtgccaccacagcgtgccgcgctgcccggtgatggtgtacttgtacacgtagctgccgcccggctggatcgggcactgcgtgatgtacgccggcccgtccgcccacccgctccgcagctgccggatgccgtgcctgcatcatcgatcgatcgatcgatcgtcacaatgcgcagtgatgagctcgatcggtaaaattttgcaccggaaaactgatcgatcaaacggtgaagcgtgcgtgcgcgcgggtgtgtgcgtaccagtggatgctcatgttgtagggggagtggttgatgacccggatgacgacgaggtcgccttccctcgcgaacacagtcggccccgggaactgcccgttcaccgtcacgatgctcttgctgctgcacagccgtgtcacgttcgtcgttttcacctgcacacgtacacaccatacgcacaaacacatcgcaattaacgtaccattacactattgccacgcatgcatgcaagttggttctctcgatcatgcatgcatcgaacgtaaagaaaacaaagaagaaacagaggacagcgactcacatcgaattggtattccctaatgtcgcccttggccaggttgacggagaagagcagtagcgcggcgacggcgaggatggaggaacggagaaggtaggagatagccatggatgcctcctcgagctctcgacttacgtacactgagagctctcgtcggctaatgggctatgaatgtgtttgagatcgatgctagatgagtgtctaaggtgtctatatataatagtactagaggacaggaggatgagatcgagaaaatgattaattaatctgtacgcttctggtgattctgaacagaagtttttttttttgagtttttttcaactcggccagcttagtaagctttatttggtgcgttgttggttaatgaactgggcacgaggtcgatcttcccaactcgcaaggcacaaacactgagagcggggcccatgcatgcatatagctgtgtatagcttcggagtgtggctaaagtcaactactcttctgtttgcatgtcaccttgaccaccttttatctttttctcatgtcttaattaacacgcagaatgccgaatatacaatataataattagatcatgctgcaatgcgaatatgcacttgttaatttgtgtgttttggttatctttgtcacgttttcttgttgacttgggtgcacgaatcaatttagctcagctctactttgaaaataggggattttatagccagctgaagtgcgatttactcagaaataaagaacttgtgtggatggtaagaactttcacatttaatttctagtacttgtgtacttatgttgaacttctttccataatctaaagaaccgctgtcaaggttgtcattatttttaaggcgtgaagattggtggttcggctgagattaatttttggcggcacccgaaatgatataatacattagcgcatgtatcaagcgttaactattactccctccgtttctaaacatttcatgtcgtcgacttttttaaatatgtttgactgtttattttattaaaaaaatttaagtaattattaatttttttcctatcatttgattcattgttaaatatacttatatgtatacatatagttttacatatttcacaaaagtttttgaataagacgaacggtcaaatatgtgctaaaaaatcaacggtgtcaaacatttagaaacagagggagtataaatttaaaaatagctttatttgatttcttaaaaaaaacttttacatacaaaatttttacacaaaacacttggagaataaggaagtagccattcggaacagttaattgttacaatacatagtaatagtctgctaatatattgttctatgagtgattttccaggtgttgattaggtaccagaagttaaccatatttcttgtacaatataataatgtcttacttccttaatgaccgtaaaatttcttttgtcatgtactttagccttttttttatgatacataaaagttttgcgcatctttatattgagcattgggagaataccaattcaaaatataagagcaatattgatatggtctccgaattatcctttttaatagagggagtatggtctccctattccgtttgcttgtaatgtaaactcaagaattcctttaaccggtcgatcgggagagatcatcgaggttagttcgagttttctgcacctactattagaaatgtgttaaatcaggggtagttgaattttcgctttaaaactaaaggtcagaggcggcaccaagtggatcagttgcaaatcacatacttttttcgtcaaggcccctaccatattatccttacatgccaagggatgagatcacgagagccagtgaagacaacgaccttggcctggacgagagggttgttccaagcccgttcttcgattggcaacacattcgcgtcggccagaaatggccaggcatggagtacattactaatatatgtcaatttaaaaatgggggattcttgatttgtaagctgtttatctggtaggtcgtcgcccgcggatggtttggtaacggagctgtgcttcgaacagttctcttctttttgcccccccaagtctccaaaggaagagaaggatgcctgacccaaccttacctgttgctatccatggacacagcacacaatgacacaacgcatgctttgcaaggcagacttgatacgtaaggcaagtgggggttgctcaagctcaaaccttctgcaggtatgattcgagtttcggccttgatggcagtttctcattttaagttggggaagtacttcctttgtcttgttctagttttgcagactatttcgttgcagttccccaaagaacgaaaatgcaagataactttctggtacatttcaggaaaaaaaaaaagggacaggagaactagattgcaagatgttatcaaaacgttaacaagtactacaggtaaactctcagggagagggcgagaggctcaggctttccaagctatgagcacgggagactactactcatcatacgctagtgatgggttacaggaacagagaacaaatcgtcaagcagatttcagaaaaaccacgaacacctttatacaacttctcatgccctagtgctaggttacagccttacaggaacagagatcaaatcgtcaagtaaatttctgaaaattcatgaactgaaccactagttatcggcagattcaacagattgaacgcctgcgcgaagtggaaatcgcaatctagcaaaatagccataacttggcatatgaacacctttatacagcttctcatgcctcagaaatattaataatctgttcagcaaacatgcgatatacacctacaattctgtccaagttatgatgccacagcctctccaagggatgatgctccatctgcatttgacaattcagcattcctattgctgtcttcatcttgaaaaccttgtttgaatcgatcataattagttggctcgagtgtcttgaatgggcgttcccctagaacctggacaagatcatcctggtggagaacctctttctcaagcagcagctcggcgatttgtgcaacttgatctttatgttgttttataagctcaacagttttttcataggccttagcgacccattccctcacctcagtgtcaatgatggatgccgtctggctgctatatggtttgctcatctcaaaaccatcctccctttgagggaaagaaagaaggccaaccttttcgctgaagccatatactgcaacctgggcataagtcatcttagtaactttctccagatcattctgtgcaccagtcgagatctttccaatcaagacctgaaaaaaaatcacataattaagtcatttgcttaagaataaactctactgataagttagaaaatgttgtgtacctcctcagcagctcggccacctagtgtcatgcaggtcatgtcaaaaagctgctctttagtcatcaaaagattgtcatttggcacatactgagcaaaacctaaagcagctgttccacgaggaacaattgtgaccttcagtagtggctcggcatgctccaaaaaccatccagcaacagcatgaccagattcatggtaagcaacagttcgccgctccaacttgctaatcacctgtggtggacagattgataagtacataaccgctacacatgaatgtccaattgttcatgccccatataatactttacatccaatgcaacagcacttaattatgcaatgatttctgctgtaacaagtaacaaagagaacactgaaatcacttttaaaattgtacaaaccaacctaggctctcaaagcaaatgtgaaggtttcaaagtgcgcctcagtcacatcaagaataaaatatagcaattatttgcaatttaagaaaaaacagttataagcagttctcatatagaattgacaacattgaccaagccgatattgtttaacatatatataataaaatttgctacctcctgaattgataaaacaaaaagtatggcagcccaacaacaaagtatttgcaacaattttgtttatttatgtactcgtagcctagcagcattgtggatactggatagtttggcagccaggttgcaaaattcttatgtaaaatttgataaatcaactagtagaggcaaatgaaaattggcaccgtaaaaaataccttgtttttcttttccaagcctccgataaccctatcaattgcagattcaaaatgttgcattgtaatgagtgtgccctcacttcttgcagcaattaaagctgcctcattacaaacattggcaatgtcagctccagcaaatccaggtgtcaaagcagctaatctttgtgaataaaatgatggttccttgtccagtttcagctttttaaggtagatgcgaaatatttgatcacgaccctttatgtctggtttatcaatacttatctgacgatcaaatcttcctggtcttagcaaagccttatccaggatgtcaggcctattggtaccagcaagaacaacaacaccagatgtagttccaaacccatccatctctacaagtaactggttcaatgtgctttcacgctcatcatgtccaccagaaaaacctccacggcctctagcacggccgattgcatcaatttcatcaatgaatacaatactaggtgaacactgccgagcttcttgaaataagttccgcaccctggatggtccaacaccaacaaacatttccatgaagtctgaaccagaaatagacaagaagggcacaccagactctcctgcagtagctttagcaaggagagtctttcctgtgcctgggggaccaacaagaagagcaccctttggtatttttgctcccagttcttcatatttcttgggatttttcaggaaatgaacaaattccataatttcttgtttggcttcatcacagccagctacatccttaaagaacacctgtagcacacaagaaacaaggttacttcagtagaattatatgaatatgttattgtatgttctttgtcaatggtgaataaagctacagaacaaacatttacaaaaaaggatatgaatttcatgttttgttcaaaatagcaagagatggaaatagcaaataaaaactaaccttatttttggagtttttatccaattttgtcacttgaacttttccaatactgaaaatgctacggcctcctttcccaggaccacccccaacagtaaatccattttgtatccttttcccaagcaaatatattaatccaataattagaacggttgggacatacttcattacttcctcaaaccattttgcttcagtagtgtaagtgattgggacataatagtgtggatctatctccaatgctttctgggcctcttgtaacttctcttcaaaggagtcaacacttccaatattgaagtaatacttgtagctgctaggagactctatcccaggaagatgacttgtagttatatggatatcactatcctgaattcgatcaattgaaggtgaactcctgacgtaaaccttagcaattgacttgtttgaaacaacaatgtggtcaactaaaccaggttccaacaacttattcttgaattcttggaagcttatctgaaaagaattacaattaagtgggtatcacaagttataatggactaggaaatgaatgtatgtgtcgcacagaaaaagaaactggtagggaactgaagtgtggatatatgatatagttatacaggattagatgattaataggatgtagaataccaaccatattgcatttcataccaacatggcactaacaacatacgaagctcatgctaaaatgccctatatcaaactcttaggataggatatgatatgccatcagtaatgaagtactgtagctagggtcacatgctgcaccaaataatcacattaatgctctcgagcaaaagcataccatctccatcagtacaactatgtgatttaaatcttttcagtcaaccataacttcagtcatactccctctgtttacatttgcttgtcaccattaaccggtgctgttacaactttgaccacaacttttttaaaaatatatatatatatcatgttttgatgaatgaaaacagtatgatcatatttagcatgtaatataatttcataatatagtactccctctgtctctaaatttaaggaattctggctataaatatatggatctggacatgcacgtgtccagattcatagctagaatcccttacatctagggatggagggagtatacttttaaatatttacaagtttcttgataaaatatgagaagtcaaacttaggatatgaatagtatagtgaaaattatttaggaatggaggggggcagctaattaattatcatcaattgtgttatgtacaaataaaacataaactaaggactacatgtgaaagcataatttttttttccttaccactttgctaggccagcgaaaccaccaaatatttttttcaagataaaaaaagtaaccttatatataacctcatatcacctctctaattggactgcagcaaaatgaacactgacaaaatttatataccacacagaattggaatgattcttttctgaaatttataaggctgaccaaaggcgaggaccttcagtaaagtaaatggggattttgataacagctatcttctatccacaagtgtgaacaggtaaaatgacaatgaaacacacaagccactactgttgctcatgtttaacagtcggtttttcagtaggaacagacctcctgctctgatgaagatgctgatgcagataacaataataggccaaaaaggaataaaggagcaatcatgtccttgaattgtttaatgctctcctcgaaattccattgatcacctgaactggattgctctgcacaccagaaatgaccacattaagtatgtggtttgcagtataatgctatatacggatgcatcaaactttacaaattgtacgcaaccaacttgctttgggctaaaggctcatgttgtcgtattccacaatactcatgctagtacctctcccttaaaggtgagcgggcagtttatgaggcactaaaactcaaatattagcattttcagctatacatgatacttacatactgttaggggtatttgtgcaataaaataaaacatcaactagccccactctgtttaacatgtattgccacttacaaaagctctgcatatcatcttcttaacattgttttctattatcagtatactaaaactagaaatcacaagttatgatatagcatgattttagggcagcactcggaaggttaagtcgccactggtatgtaaaagtctactctctttcaaaatattttgcaaagctcaacaccttaataaaccatatccaacacaagagcgaggaatgcaggttaaaataagcacttactctttgagtcggacttgtcactctcatcccctttacctttattctcctcctccgaatgcttcccgtggtctgaataaaaaaggcaacgttaaatattaacagagtcaccagatatccccaaaaaccacctaaccagccagaaagcttacttttcttcgacttgtcggagaatagccgccggaactgccggctagcaagcaggaacctccagtccccacccttccctgccccggaggccaccgctgcccgattcccgataactgacgtcacatagctgcgcagaaaacccaactcgccgcagggcagcggcggcgacgaagcacggagcccgccatgccccccgagcagagaaccctacggcaacgacatccgcacacgccgcccgagccattagggcgaggacgcgcaggaagaagccacaccaatcggagaggggaaggggagggggtgcggctcgggcactcacctggcgctgccgggaggagcgcgcggaccgggcgagggcgcgggagagggaggagaggctcatggcggcggcggcggcgagcgcattggacggagatcgaggcgggggcgggccgtattagggttttgatcccgcccgcgctccgcgtgcgtgatcgatcgaaactagccggtaaagtgtactgtgcccccgttttctcgcggagagagcgacgaaccgacgagacgaggtcacgagggacgcggttgatggtggcggcggagagggctcaagggaaatttgttggtgtcgatgaaagggcaggtggacacgcggcaagggattgccaccaatctggagacagttcggagcttccgctgccagtatgggtccatgggccaccctgttggataggccacgatattggaccgctaccaaactggtccatcacgatatataaatgaggaataggttcattttaggtaccttaacttaacagtgagtttgattttcgtcctttcaaaccacaatatttttctacaaatttcatcgaatttttaaaaaattgactataaaaagaatcaaatgatttataatatgaaacagagggagtagtagctagcaacaaccaaattagtttgattggtaatgaaaaatatcaaaccaaatatgcgtttgataccagcaatgtacacatttagcctccaaattaagtggcaaactagtatatttctaatattcatcaggtattagcaattaagttcgttagttgtgcaacctgtttatagctagctcggtggtctttccagcgtcgggcgaaccccacaagttgtattcttttttcgtagctacgttcagatcctttgacctgtccactacttatacgtatccatcagtaactaattacaccttgcaagtagatatccagtactgtactatcgagtcatcttcccaagtcaactccccactcacttcagctacagaaacagtgtttcctgggaccacggccagtccaggcacgaccatatggtcggcggcgagtcagaggacagcgccgtagcggcgtcagcgcgcgccacggacgacgaggccgaggtcgagccgccgccgccgccatcgtcgcacgagcgatccgtcgcgacacgacgcggcgcggcgtgctccgcgtcgccacgtcgtcgtaactcggcgacgtcacacgacgtcccatcgtcttgtggccactctggccgtagccggccggcgccgtcgccgtcgtcctcggacgtcgtcggcgagaaggccgccctgacatagttcttcctcttccttgccgccgccgcgggcgacgacggcggcgggccagcgccggaggcggcggagaagcccactaccgacgtcggcggcggtggctgggcgatgtgcggcgggaagagcggctgcgggccgtgatggtgcgacccctcgtacgtgacgatgagcatctccgggtcatcggtggacttctcgacgtgcttcttggcgctgcatcgggagctggtgcacttgtagtaactcctgcattttcaccggagatgatgttaccattgccgtgatcctgcaaatttcggcttctctgaaaaagactgctcatctgaaaacatcgctgttgtgttcattagccgccgttttaatgcgatgcagatggatgttaattcttgcagttcggcgttcgtgtaattaattacgttttcggtgatgacgtgcacttggagattattcaacagcacagtgattcagactatatatggcatgtgcatgtatatgaaagcatgcgtgtcttcgcaccatcctgtatttctctgaacatgatctggaattaatgtctccggccgcttgcttccgctggtgtgccactacgccagtgaacaacctacctgcggcgcgcgctttcaaccccgcgtgcacagtgacactgattgactctagaactccacgtggtgctactagttgggccctgtttatttctcacccaaaaattttatatcgtatcgcatcgaacattttaacacctacgtaaaatattaaatatacataaaaaaaataactaattacacatattgcgactaatttacgagacgaatcttttgagactaattgctctatgatttgacaatgtgatgttacaagaaacatttgctaataacagattaattaggcaacaaatttgtctcgcgatttactgacggattctgaaattagttttttattagtgtccaaacaccccatccaacccatatataatacccgatgtaatacgctaaaactttacacccatggatttaaacacccccttactgatataatatatatatagctttaatttctctggaatctgaacacacgatctatcaatctatcatggttgttgtgaattaaaggctcctcacttctcaactgaaatgctagatcattcacatccacagagacagggcaatcaggaccgtgtccccccactcccccttaagacaataaggatatttaactctattttttaatatatgacatagttaacttttaataaatatttaatcaatagttttatttaaaaattttgtacaaatataaaaaaaatcattcttaaaaagtatttaacgataaatcaagtcacaataaaataaataataattgtataaacttttttgaatacgataaatagtcaaacgtatctaaaaagttaacgacatcatatattagaaaacgtagatagtaatttctttcgttagaaaaggtaagaaaattgaatggtcgaagcgaatgaactgctaagaccacaacatgctactcatcacatttgtgttagttacatgcaggatctcgtagtgtgcagtaggtacctaattaaagagtctcctaaacaaactccatcagttttaaaatacagaaactttcaacgtttgaatctggtttcaaaatataagaatatctagcacactattctagggagtacatactacttgtcctataaattattatttcccgttcaaatttcttcacatctctcactcccacctacccatacaccctacctatccatcatttatttattgtgggatttctatcttttcttgtctaccttaatatctgtccaataacctagaaatatttatatttacaaataaaggtagtagtaattattgagtactccctctgttttcgaataacatactgtagaaattttcaccaaaacacgtagatcatggtaacaaaatttataaccaaattgtcattggtagttatttggagatgattttaaagaatggataaagtggaggtggagggcaagaaatggatccaaaatagaagcacctagaagtttgctctatggtgaagattgatttatgttcacaagtatagctacggagagtagggtcaaaattaaaattctgctaataaaagtgtggtggtgataaaaatattttgaaacaaacgaattggaggaaaatgtcgttatttaaaaatggataaagtataaataaaaatagtatatcatccttttgttttgagaatgtttatatgctatttgacggaaaaacaccttacaaatcatgcaaatcctaaaccattggatcatattaagaatcgtgcaccatatttctaaccctaacccctcatttcttctattgtcattcccagcgcaaccgctgccactcgcaagcttgcatgcatgcgatgcctctgcctcagccccatgtgccgcagcccggccttgccggttggccgaatgaagtcaactgtgccggcaactcccccttcatcccgggccttctccccctcccacctctcttcccaagtcggcggcgcaagtgtccctgtctcgttgtcttccccgtcttcggcagctcctcgccgttggatccgtcaccactaatcatcgtctcctaaccataagctctggtttgcccccgtcatcaaggccaacccatcatcctcctccatctccgtggcttcgatgtggccgccgatgcctcacctccaactcgtgtctacctcccactgtcgggccgttgcctccgacatctctttaagcatggcgatgtccctcttctttgccctcccctaccaacctccaaccctaccacaatcaaaaactctaaaccctaacttcactaccttcatagaggttgctagagttggtaaagaaggtatcgtcggagctagaggagaaaaactccggtcttctgagcacgaatcacgaattaaatttcaaaatgggtaatatacgtgattataaaaagaatatcgccagccatttaaccatctttttttaatgtaagagtgttgcacggctaagcgttgacttccccgtctagggaattcgtcaatcccttgttctgcaccgtatgacactaatcgatctgtactgtacgattggcacacgtgtatacgtatacccgcgagtccttccaagtcccactcgcggaaacacgacacgtacacacgcgcgccgccgtgggcgatagcaggcggcggcgagccgcgcagctagccatattgttcatgcacggattgcacgcacaggcttgaccgcgcgcgctcctggcggcgtttttctctcgatttcgccatggtacggtgcagctgcaagcggctgcccccagcgctagcgccgtatccggtgtaaatgaacgacgtcgacacgcgcatattgcgccattcttatcaggactaagaatacatcttcgttgtcgtcgtcaactcgtcacaactgtatgtacggctacagtacatctttaccacgtcgtcccgttccgctcccttaattggttaaattttctttttcacaacctaactaagaacgatttttgaacgcttttgagcatgggcgtaagtttaatcagtgcactatggtcaacttgtcactaaaaccgtgccatccatatcgcaaaatctaaaccgagagcgctctcgatttagtgttaaaagagcgacgcactcattcgtgagagaatgtccagtgctactagtacgtga

SEQ ID NO: 41605 - DNA, 10763 bp, Oryza sativa
cagtacagctacgtgagaaaaggtccaggtgttactagtgcacataatgcatgtctattttttttctttttatagaattttctctcaaattacttatccgatctacaatctgattacaccattacgttcgttgcaattaaatctttacaacaagatcttacatgattatattgcgatgaaaaatatttatatttataaattacttttattatatacgtaagttacttttatcacgtatataagttacttttaaatttgactaaattacttctatacattcataatgctctaagttgattatttttattattgtttttagttaattctatattttgtggactttataaatcttctctacactttacttgtgaatttactctacataatttcttatttcagctcactcacaatataataatttctactacagagagttactcctcccgttttataatgtaagtcattttagcattacccacattcatatagatgttaatgaatctagatatagttctaaattaaagttactttaattctttttgttgtaattcaattttcttaaccgaatatagcaagaatccgacaattgacgacttgacaaatctcatcgactaatctcaggacttcgaagccgatgctaactctaagccgatgactactccgggcttaccaaatttcactgttaacagtaagttacttctataatatatgtaaattacttttaagctttactgaatttacttttatatgtctaagaagtaacttagtgaaatctagaagtaatttagacatatcataaaagtaatttgttatttttcatcaaaatataatcatgtgagatcttgttgtaaagcttctctaaatcggattaaatcggattttattgttacgaacacaacggtgtaatcggattataaatcggatgagtaatttaagagaaacttctctaagaataaaaaaaatacatagatattgagtatactagtagctttttttttaaaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccggccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggataagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaattaaggctgtgttcggcagcccctcctaccaacccatctccctcgtttttcgcgtgcacgctttttaaactgctaaacggtgtgttttttgcaaaaagtttctatacgaaagttgcttaaaaaatcaaattaatatatttttgaaaaaaatagcaaatacttaattaatcacctgctaatcgctactctgttttccgtgcgagcacttagtgctgggaaccaggggttccgaacataccctaagtattaactctattagctactactacaaatatcaaaaattgtgtaaactagatttttaagtacttctatatgaaacttattttataaaatacgaaccgtttaatgattcggaaaacgttcacacgaaaatcgatgaagtagctcattctataagccttgccaaaaggtgcataataagtaatataagtaaaagaatgtattttcaagaaaacatattcttataaatatatagagcaaatcatccatgttgataatctctaatgaagtactacctttgtgctaaaatgtaagtatttttttggcacgtatattaaaaaaatatgtgtgaatgtttttgaggaagtgtgtgattggttaagaagaaaaagtatatgaaagagaatggttgtgattggttgagaagatgagataggtggagaaataattttattttggaacaaggtattatgctacaaatagctagtacattttaagatggatgtagcggctgataagacaatccaaatcaatacacgtgatgcacaagttcgtaagtaaagtatttacctgctactgtgtacctcacgaaaaacagcgtacagtttcttttgggaaaaaaatagagcatagttgcctccccccctctctttctctctccttcagagagtacatcctttttcaaacgtcgatgaaaagaaaatttttcggtgtcacatcatatgtttgatcggatgtcggaaaatttttttggacacgaataaaaaaactaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttcatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccaatcgatcttgctcgctgccactgccacttgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaatttttttttcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgaaaatcccttccgacatccggtcaaacgttcgttgtgacacctaaaaattttcttttccccaactaaacacatcctcatttactctgctacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaaataaaataaatgataattatataaattttttgaataagataaatggtcaaacgttatttaaaaagtcaacagcgtcatacattaaaataaagagggagtattaagcgagaaactaaaaaactgttatgttcttcattaatgcgaagagaaaaaagagaagagattacaattggtaaaatagtaaaaagaaaacaaaaggaagtattaaagtagtctaggggatcagtaaaactatatttatttggggataaatttttaatctaaaacatatttatttagggctaactagagggagtatatttgaagcggaaggagtgatgttgatcgcatatgcgaatttataccagaggggctgatatctttgtatgtgtttagttccttccaaagttggaaggttaggttgaaattggtacgatgtgactgaaaagttgtgtgtgtatgataggttgatgtgatggaaaaagttggaacacagcctttggaaccatggcgttacggactcttaattcttgaacggctcggaagatccagagttgcagagacaatttgcagtctttcagctgtttatccccttcatggacaggttttaaccctgcaggcagacaacaacctcggagcagtttgtgaatgtcttcagttcttgacagtgctcacagtaatctactcctatttgctactgcccctgttccaaaaatcttgacgctttaaggtttctaagccaatttagcttcatattaaaacgatcaaatttctcttaattatcgattcaattgtcacgctttaaggtttctaagccaatttagcttcatattaaaacgatcaaatttctcttaattatcgattcaattgtcatttcattgagtacctgcactcagtatgttactacggagtagtacaaagaatcccttaatgcaattaaataataaattctcttaaagctcattgttagatgatttgatggaatagacaaatggtcccacttttcaatcaaatttactactccaatgacacttttctgggacattgacagaagcttaaaaacgacaccttttttgacggaggaagtaaacatctactctatttgtttcataaaaaactactatctccgtttcaggttataagactttctaacattgtccacattcatatagatgttaatgaatctagacacacgtatatgtctatattcattagtatatatataaatatgagcagtgctagaaagtcttataatataaaatagaggaagtaatctagtactctgtactagatgcattctagtattagatgtgagcatatatatatatatatatatatatatatagagagagagagagagaatttttatggtactatatattgatagtatatattgccattataaatgatctaatggcgtatattgatttgaccttccacttaactagcttgcagtataaaatctgaaagggtagacttgtctttctgtgtggtggtccggatccgatgccgccaagggctctcaccgcgccattagagcaggtacaatagcaggctattagccagttataaacatattttaatgagataaacgatgagagagaagagcagcaggctacagatttataaccagctagctgcaacacggactccaagacataatatatgtatgacaggtgggatcgtatattaatagtatagtaagcaactattgtatgaattggctattagattagctatagatgaattagagatagcagtgggctatactattgaactttgctcttatagcgctatcgggcgcattgcacgcacacggcgtggatgcgcgacgttccgcggcagcgtcgaagacaacttgaatggcacctgaccggctggtgtgcgggtcagcgggtgaactaaaatgtgcttgcatgcacaacaagccatagcaccaccatatgagaatgattaattttggtattgggttgtgttagtagtccaaactataaggtctatttcttatctgggctgcaaaagtgaaatgaaactggatttgtgtttgctactgtctctcacgagcgtaagttaaggggctgtttggatgcccacctcaatttaccatagttttttattaaaggtgtgtcaagatgcaaattgtgtggctcaaatttaatggccacacttgtgacaaactttggctaagaaaagggtctatgactagtaggaccaaaagaatagaaagtgtggcatgctaaagttatagaaacaaaccaaacattagctacatttggacaaactaacatacctcaagtgtggtaaaatgtggcaccaaccaaacaggcccgcactagagcagccgagcggcgacgagtcacaccgccgttgcgcgccgctgtcggggcttgtctctccaagtcgcacgccgctgtcggggctcgtctctccaagtcgttcgcgaggtagtgactcacgacatgacatcacaaacatctagggattaaacctaaataaccaattacatttttttttggcaaattcctattgtacccttgtaaatactggcagcatatactaccagtacaatgtgcggtaaaagttctcttacctcacatttgtgaggaagagaataaatcacaacacacatatagatgaggggatttgatcctacgacctccactagtcaacttcatgaaaatagtatgttattgtgagactttaaaagttacatttaaattttattatagttatatatacgttataatataacactacgatcatactatatttatatttatatttatatgaaataaatttttagaaccctgtaccaaccggtcagtggcgaaagcccgccgggggggctaacctgcagcttggctcgcgtctcctccgcctcgaagcacgtcttctcccaatcatttcaccagctgccatcaactaattggtactgctacttccatctcaaaatatagtaatttttagctatgaatttaaatatataggtgactatattaataactaaaaataattacattttaggatgaagagagtactatttagtttggtgttttaatctgtattacgggagccgcaacttgacttgcagcttcagaaatagtagatacatgtgttcaaagtgataacagcaagacccgtttcagatcctaacagaaaagtacgtacaatattcctgagaactgtatagtctgtattctagatatgcaattttctccgcacatcgacgacagcttttatgagtcgaggtcgcgctcgagcttcacgacagtcacggtgattcactatttcactacgtacaagccgcccatgctcaagatcactgttgactgttgagtacttgagtgcttaccatacgaacatagcgaattggaaaacccaaatcagtatgaacgggctataaaacgtcgggcgcgctaactggcgctctgatttgcactgattttctactctaggattggctccaaccgttttatagcccgtgcatactggttaagaccacttaagcatataaaccagcagaagaaccagggttagtcagaccggataggatgttttttttcttctgaaaaataggctgagaggacacattacacatctatctatctattctattattaaaacagctttgaaaggaggcaccacgttcgcttttgggggctaataattcccacattaatcagagaaaaaaaaagaaaatgagagtccaagtagaaatacaatctaaaaatagttattaaaacagctttgaaaggaggcaccacgttcgctgtgggggcaaaaaattcccacatcaatcggagaaaaagaaaaaaaaagaaaaggagagtccaagtagaaatacaatctaaaaatagctgaaattcggaattaaaactaagcaatattgaaagaagtttccatataacaacctaatacgagattaatcaaaatttgaaataaaaataaaataaaatccaaaattataaaaggaaaggagagtccaagtaggaatacagtttaaaaatagttgaaattcggaattaaaaataagcaatattgaaagaagagtccatataagaacccaatacgagattaatcaaaatttggaataaaaataaaataaatccaaaattagcaaaagaaaataaatagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataattttgaaacaactgaaatttaaaataaaaaataaaaacattaaaagaacatattggtattaactatttttttaaaaaaaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaaacaatgataatcatgttcgattttaaaatctcaatgacaataaagaaggtaggcagcgggcgagccgtagaggagtacaatggcaaagctactgacggtttggcaggacttctagaaagtaaaaatgaacccaaacgataattatgttcgatttttaaaatctcaataacaataaagagaagagacagtggacggcccgtagaggagtataatggcaacgtttgacgggacatctagaaattataaaaataaaacacaacgtgacaataaactctaaaaactataaaatccaatttttaaaggttccaagaagaatgaataaaaatagtggtagatcgagcaagcaaataaagaagatgacataaggggtagcaactggtgtgaattttaaaaactatataattagaaacatgaggatgataaggtttggtctctcaaagtcttaagacaatgagatagctatttaataaattttaagtaaaatcatacttaaaaaaatatatgattttgtttgggtgctagccgcgcaattgggtgggccacccagct

SEQ ID NO: 41606 - DNA, 1833 bp, Oryza sativa
ttatttggaacctcagaatcagtaatccacagttgtttggaaacacagtaaagtttcaaactatggatctatcaaatacacatgccattttgccaaagcacatgaaatttgttggatgaaataaaaaggataaaagaaactagctggtcagtttgcttcatcaggatactagtttaccatgacaaaaccatccggctagaaaatcagatagcaacattaaacatgaaacaactaaatgttatttgaaacatcggaactagcaatctagctgcaatggtttgaaactggagtggattttgatccctggagtggatatcccctcgttgtttgcatatcactcaaatagttatgaaatttttttaaaaaataaaaaagatgtattaacatgttatatataactctacaaacatgcaagttcaaattcaacttctacatctcgtaacgaagaaaaacaaatttgattgtgaatatacgttaactagctatagtttaatttgtttttttcgttacgagatatagaagttgaatttgaatttgcatgttgttgagtgatatatcacatgttaatacatcttctctaatttttttttaaatttttttcgtaaccatttgagtgacatgcaaataacgaggggacatctcctcgagatatcaaaattgtttcataacaatgtagtaaaactaaacatgcttacatggatattgaatttgaggtatttatctaacaaacaaattaactaatacattctgtaacaacctaaatggcgccaaaagaacttccacccacctacaaatcatgtcatgctacaagcataatgaaaattaggttgcattgctatatggcgtagcttcttgatgaatcatttgtaagatcaatgtgtgttttgattcttattttgtgatgaacaattggcatatgtgattattggttttgatatttggagattatcgtcgaagtggttttggagataatcaattttcagaaaatgaacaggatttactagtttgtcgggaccggtcagaccgggctgggtgtgccggtcagaccggcgtgtattgcgcagtcagaccggcgcagcccgcggtctgaccggtcgacgctgtgtcagtttcggtttcgggttgtttctttggatatccgtgattgtttcatggttatggcttctagatggatattatacgtatgtaatactgttgtttgctactaatgagtcaagttggagatagcttagtctcggaatatggtttctttgtttgtttcatgtgtaggtgactcgatgcctcgggagagtatttgcggtgatggaccgggagtcggcttggtggtaagacgatgtccgtggtggtcaaatatcatgcgggatactaaggctagagttgatgcacgtggttgatggagattccatatggcatatgatggaggtattgtatgcgtatgggatgcggagtcgaatttggaaggagtcaaatttggtacgattggttatgtaaaggttctttcttgtactagagggtttcctaaggtgtttaggactcttagtatgagtttgattcgtggctttaggctgcctacctcatgtataaatagagggggagcgtgagtcttccctgcatcgctttgtatcgcttttgtattgcttttgagagctagtttagttagggttttgagtttagtcgagatttttgtaaggagtgttgttggtgcactttgtaaacacagagagaaacaataaagttgtcatctactttgagagttcttcgatttgtgtttcaccgggtttcggcagtctaaccggcatctcagtggcggtcagaccggcgccatcgcggcgg

SEQ ID NO: 41607 - DNA, 4071 bp, Oryza sativa
ttagttcttgtgattcaatcctacaagtggtatcaaagctttgtttgcttctttggattttaaccgatctagagtttttgccatggctgcttctaataagtttttaactaagcctcatgttttcgatggaacggatttttctcattggtgtagtaggatgcaatcttacattatggctgagaattatgatatttggagaaaagtttctcttccttgtgtgattcctgaagctattaatactgctgctgaaaaaactgcttttgaactaaattgcaaagctcgcaatattcttttgagtgggatttctcgttcggattatgatcgtgttgctcatcttcaaactgctcatgagatttgggttgctttgaataatttttatcaaggtacaaataacattaaagaacttcgtcgtgatcttttcaaaaagaagtacattaaatttgagatgaaacctggagaagctttggatgactatctttctaggtttaataaaatttagagtgatcttagatcttttgattcttcttatgatgctaattatccacaatctgagatttctcgtcactttttgattggtcttgacatgtctatttgggagatgaaagttacacctattcaggagtttgtgaacatgtctactttgactttggattcgctttacacaaaactgaaaactcatgagatgaatattcgttctcgtaaaggtgattctaagtctagtgctttggtttcgtcttcaacttctttgaatgttggtacttcttcatcgaagtcttttgttcttgctttatttaatgccatgtccgatgatcaactcgaacagttcgaggaggacgacttggttttgctatctaacaaattttctcgagctatggaaaatgttaggaacaggaaaagaggagaaccgaatcgttgttttgtgtgtggtgcacttgatcatcttcgctcgtattgtcctaagcttgggagaggcaagaaggaagatgatggtagagttaaagaggatgacgtgaacaagaagaagaacatgaaggagaaggagaagaagaagcattgcatgcagtggttaattcaagaactcataaaagttttttatggatctaaagatgaagatgagggcaaatgtaagcaatttgttgatctagcttttattgctcgtaatgaaagttctcatgttgatgaatctgatgatgataatgaagaaaagcatagttatgatcaattagaacttgctgcttacaaatttgctaaaaaaactttaaacatgttctattgtgcttgatgagaaggatcacactattgagattttaaatgctgaaattgatagattaaaatcttcgattcctgatgatgataattgtcagtcttgtgaagttttattttctgaaattaatgctttgcgagatgtcaattctgttaattgcaaaaaattagaatttgagattgaaaaatctaaaaaattggaatcttcttttgctcttgggtttgctttacatgcttgtgttgttgatgagttgattttgacaaagaatgttttgaaaaaatacaaagttgctttttgtgcaagttctttggcgaatgcttcatgtgcaaataaggcaaaacaaaacaatggtgttttgatttctgaagattgttcaaagtgtgttttgaatgagatgaagttgaaagatgctttagggcgtgttaaacacatggaggaaattgttaaacaagatgaggtgttttcttgctcaacttgtagaaaacaaaaaggtcttttggatgcttgcaaaaattgtgctattcttactcaggaggtttcttatttgaaaagttctttgcaaagattttctgatggtaaaaagaacctcaacatgattcttgatcaatctaaggttagcacacacaatcatggtttaggttttgatccttatgctcataattctagacatcctcctactgttttgggtgttgctaggagaggtgaaattttgattgaatcagagcctaagaacactgtgtttaaatctgttggcatcatgtcttctttgaatacatcttcttcgaaatcaaatgttgtgaatgcaaaaccttctgttgttgcaaaaccatctacttcacaaacttgtcgtgagaagtacacttgttctttttgtggaaaagatggacatttggttggtttttgttttagacttgcccataaacagaaaaaggaaagagaaattgcttttgcaaaacgacattggcaaaaatcgggttttaattcgaggaccacggttagaccgacactgaccagtcggtcagaccggccagcggtcagaccgcaggtaaaccggcggtcagaccggttgctaggctcggtcagaccacaggcacagtggcggtcagaccggcctcggggcaattttgtgcgaaattcaactcagacttttgtgaagcaaaaaggtaagttttttggtaagtctgattctgattttgtaagtgtgtatgtacctactggttctagtggtcgtgtgactcagtgttggattccaaaatttcttatttctaaccccaacacggaggtctcgacatcttctcgttcgtaggtattttggcggcatactccccatgtgcatttaactttgagatgacgattgtatagcaaggtaacatcactttacttttggattgacataattttggtctattctcttgtttattagctttttcatgtgctaatgtttgaggtagtagtttttgttaatactattggatgtatgtcaattcttgagaattttggtgatatcgttggcaattggatgtctttttcaaaatctttgattttttcttgatttttgttcgggaagaattggaggttattttgagggggagttagtgctttttatgactttcttttggcatgttttgagggggagtttgtacctcatggttttatcaagcaaaaatatgacaatgaaaaaattgataaaagagagctttgtttatacatatggtattttcttgtgtatgctagtaatattttgaaggtttatttgtctctagcataacttgtatgtattctagtcttttcatgagatttagtttttgcttttaagggagatgatgcatgacacttaaattctatacttgaattaagaaaatatgtaatgttgaagctagcatctggtttgatttataaatgctctatttatatgctttattgaattgttattccttaaatagctttaattgctcattgtgaaaaagagaataaaaaatatgaaaaaaatgaataccgaattcttggaaacagtcttgacgacaaggacgtattcgatgtgagcaaaataatgggtgccgaatccctggaaacagtcttgacgacagggacgtacccggaataaaaaagaaaaatatgagcaaaaaggcttaagaaaagagaaagttcaaaaaaaaattctcttggttgttttgtgctaaaggttatttgagaaagagtgataaatgcaataggtatatgtgtttagtgtttatttttcaacctatgtgcttattaagatgttgcattataaatcgtatgaaatcatgaattttgattgttgattcaagcttaattgtaaaatctttggttcatggttgtactttaatgcatgcttgttctgttatagatgggtttatcttctttttattgcaacacatgacttgatatgctatatgtatgctaagctcttatactttcaaaaacataattcctatgcttgatgaaatcattgtcaaaagggggagaagagataagttttttgggaagaagagatgagtttttatgagaagagaagagtttttgagaagagcatgttttttcaattgggaatttctttcttttaaaaagggggagaagttttcttttggatttttgagcacgatgtgtacgtttgtacaaagtgtgtttttttaccgtttttgtttttaatttttcaaactccaaaacatttttaatgggtttgccaatttgttcattaagggggagattgtaatatcaacgtgtgttttgattcttattctgtgatgaacaattggcatatgtgattatcggttttgatatttgga

SEQ ID NO: 41608 - DNA, 4383 bp, Oryza sativa
actgttgtttgctactaatgagtcaagttggagatagcttggtttcgaaatatggtttctttgtttgtttcatgtgtaagtgactcgatgcctcgagaagtatttgcggtgatggactgggagttggcttggtggtaagacgatgtccgtggtggtcaaacatcatgtaggatactaaggctagagttgatgcacgtggttgatggagatttcatatggcatacgatggaggtattgtgtgcgtatgggatgcggagtcgaatttggaaggagtccaaattttgtaaggagtgatgttggtgcactttgtaaacacagagagaagcaataaagttgtcatctactttgagagttcttcgatttgtgtttcaccgggtttcggcagtctaaccggcatctcagcggcggtcagaccggcggcggcgacagcaagcgacagctgatcaggcggtcagaccagagtttcaatctcggtcaaaccggtggctttcagacggtcagaccggcatgactacctcggtcagaccgcgatccatcgatttcgagggtaacttttatttccgctaaaagtttttggtttttgggtatctcaaccattcacccccctttggttggcttagttattatgattcgatcttacatcattttataaacaaaatgtttatgctagaagcaatcgcatatctgttgtttaccttgagagcatcatctgattgcattgggcatgcacagagagctcgtagccaagcaatccagctatggacagcatcatgcaccataaaaacgtagccccaatggtttcgccagcaaagccaacgccagtcagcagcagaagaagaaagaagctaatcaccagatatgggacaatatagcacaacatgatgtggccaatctggtcaacggacaggagggcatcatgaagcacaaacctagcaacgaaagcagcccaggacaagatggcagccccctccacaaccgaaagaaaggccacgaacataggcagcagatcaggatcaggatcagcaaacggcctcaatagcagagctatgggcgtaaccatcagcagagatattataccaaacccggcagctctaacaccacgatctgtcttgaaggacgtctcctcctcctcggtcaagaaggttgggggatccacgcgcatggccgccgtctccgtgccaatgcgctgcaggtgatcggcgtaggcgtacccgagcaggccggccgtccagcctgtggcgaggtgcatgacggcgaacccgacgctggggccagcaaccgttccggctgcgtcggccagaaggacgccataggagatgtggaggaacacggtggagggacggattgtgcgcgagagggtggagatcaagaagaagaggtaggcggagatgaggaaggcgatcgtccacaggagggccagcggctcgcaggagttgcggagcagcagcggcggggagaatacgaggaacatgcatgagatcaagataacgcgaggtataatgtgatctggaccgccttcaccggaggagagaccggtgatggtggtcgacggagccttggcgtcgacaaggtggccggccaccacagcctcggcgccatctgcttcgcaagccgcggcgatggccattccagtcgtagggttgtgggggttgtgaagtcgaagcgagagcagggccggcgaaagaccaccacgacagccgcggcggcgatggaggagaaattgacttgactgctggtgtgtatcgctccagtcaattaggactgatcgatttgttgccaaaattagtgggatctctaattgtaaatagcacatttactattcttaacgttactaaggctgagttctttccaactcaaccacctctttttttttgtgtgcatgcatttcaaactacttaacgatttgttttgcaaaaaaatgtttatacgaaagttgatttaaaaaattatattaatttatttttatttttaaaaaataattaatacttgattaattatatgttaatgagtctctctgttttacgtgcgttagagatgagttcaaccccaagaaacaaactcagcctaaaacttgtccttgtcgatctttgcctttacaggtttttttttagcaatctaaatgtgcgtctagtctaagcatctccaagagtttcttcaaatctcaaatcttgctctttatttgttcatttggcaatgaagcaaaataatttcttttcaaattttatatacattctaacagcttcttcatatcccacactctctaaattattttggttgtttagattgatgttattttaaaccataccatttttttaaataaaaagttgttaaatatgtctatatatttatatatttagttcttttaccaaaacttaataaatacataaggaatcctaccaaaacttggtaatattgtcaacttactgtaattttatcattgtcaaaatttggtaagatgtattttggctatggtctaaacaacccctttgaggaggtatcagtatttttctctttgagcgagtatgagtatctttctctttgagcgagttgcaacttgcaagcgagagagatgggaggaagagagaataggagactcacgtttggcaagtggtcatcgtttggaaccatgccactccgtcactcttttcgtcctccccgtcaatctttccgtcattcccatcctctctccggcatgttcaccacgttgacccgctcctccatcttgccggcagccatgagctcgaggagggagtcgaggaagtcgctgccgcggccgtccgggtgcacggcgtaggcagtgacgaacatggggtcgcggccggcggcgaacggcggcggcgatggcgaggggatgctctcccatgaccaccgctccacctggtgcccgacagggccgggctggggctgcagggcaagggccagctcgtcgccgtggaggccatgttcctcatgtcgctcgcgctcgccgccgcgcacatcgccatggcttaccgcgccagctgccgcgagcgacgccgcctgctcgtctacagaatcgacatcgaagctgtaagtgattgattcccttctttgctcgtatcgtatcaaaacaaaggattttgcctagtggtagcttgtagtgtggattggaaacatattaaacccaaaatatgcaagctttctagattccaatccgtgttttcgagagattctggagaacaatcgaggcatacgcttgccgaccttttactggacatgacaacggccagaagaacacgacgtcccctcacgcgaggaaagcaatggtggagcggtggccggcggatgagggcgggacaaggcactgccggttcttgccgccgctggctgcggcgcagggcgcgaagaaggcgaccgcggagtctgtgcgctcgatgcggagctcggcgacgaggcgcaggtcacggccgtatccgcggtcggcgaggtgggtgagcacggcgtcggcggcggcgtcatccggggcagtggagaggaggagaacggggagaggatggggaagacgaaaagattgatgggaggatggaaagagtgacggaagtggcatggttctaattttaaaattttacaagtgacatctagcagataacgtgaatagtaatggtatattttttatttaccacatttacagtgatatggatccaattaacccaaggctaaaaggcaaatatagtcacgggccaaaatgcagctaaagcatgaattccatatactttgatcaaggatggctaccacaaacagtactacatagtagctcagatgtctcaattcaaatatgtgccgatcgataagggttaagaattacacattcatagattcgtattatagcataatgcgctcgaggataacccctaatctttacacatgcatgtaggagtattcgttaaggactagtggactactaattcagggggaaaaaaattctctggggcggagccccaatcctcagcgcgtgaggcaccattctagataggtgccacctgtattctcaccaatattgaagcaccggaaaaaagtaaagcaatttggattttttttttcttagcgtatacgctccgtattccagtggtgccctacgaacttgtatcgtattctctgccctaatcacgtcgttagcgttcctcgttcgtcggagccgtaatccagctattcgcccttccgttccggccatcgccgcgcgtgtagttcgccgcccttccatcgtcaccgtggccgtggccgtggccatggccgtcgtagtcaatgtagatgaatccccgcggcggcgccttcaccggtgccgcatcctgctcatccaccgccgatgacgatcctccgaggcccctgatcaaccatggaccaatcaacaatgcatggcagcccgtt

SEQ ID NO: 41609 - DNA, 32282 bp, Oryza sativa
ggcctcggaggatcgtcaccaccggcggatgggcaggcaacagcaccgacgaaggcgccgccacggggattcatctacattgacagcaacggtgatgacgacggcgacggccacggcgacggcgacggcggaagggcggcgaactacacgcgcggtgatggccggaacggaagggcgaatagctggattacggctctgaggaacgaggaacactaatgacgtgattagggtagagaatacgatacaagttcgtagggcactactggaatacggagggtatacgctaagaaaaaaaaatccaaattgctttacttttttccggtgctttaaaattggtgagaatacaggtggcatccatctaggatggtgcctcacgcgctgaggattggggctccgcacgagagaatttttttccaattcaggggtagttggatgttgagtgttgagatcaataagctgccgcagtactatttatctagacgctggcagtcagagtcaagaccagacctgttgtaggccatcttcatctctgctctgctccaccggcagcctgaggagagtccaataaacatgtcacaaattcagatagcaacattttaaacatgcacaacaattaaacgttatttggaacctcagaatcagtaatcctgcaatcgtttggaaacgcattaaagtatcaaactaaacagaattggtatgtggcagcactacggatctatcagacaaactacaacctgttagcaacccacaatgtgccaaacaactccccgtcgcatacagatcatgccaatgctcatcaaaagtttaatgaagattaatttgcatagttatgcagcttctcaagtaaccattttacaaacatatcgcttaattatgctagaagcaaagacctgcatttagtttgttgatttaccttggcagcaccatcttgttgtattgaacacgcacagagagcatgtagccaagcaatccagcaatggccatcattacaaaccagaaaaacatagccccgatggcatcgccagccaagacaaggcagctcagcggcacacataggatggagctcagcagcagatacgggccaatatagcacaacatgtagccaagctgatgaaccgagacgaaggcttcaaacagtaagaacttagcagtgaaaatcgcccagcagtagatggcaatcccttccagaatcgagagaatggtgacgagcagggacagtgcaggaggaggcatcttcaccagaagagctccggccgttgccacggctaaagagagcaaggtaaagaaggcagcaacactacggcggtgcaccttgaaggagctctcctcctcctcggtcaagaaggttgggggagccatgttcttggccgtcgtctccttgccaatgtgctgcaggtgctcggcgtaggcgtacccgagcaagccggccgtccagcctgtggcgaggtgcatgacggcgaacccggcgtcggggccagcgaacgtgtcggcggcgacggccacaaggacgccgtaggagacgcggaagaagactgtggagggacgcattgtgcgtgagaggctggagatcaagaagaagaggtgggtgcacatgaggagggcgatcgtccacaggagggccagcgggtcaccggagtggcggcgcagcagcggcggagagcatacgaggaaaaggaacgggactgagatcaagattatgcgagctcgaatacgattggagccttcattgtagacagtggtgactctgcggcctcggcccgatcgactcgccggggagatcgtcgccgagcccgagtggtcgccgtccgagtcgcgcgacggcggccgaatgtcggagggattgtcgtcgggggaggatgagtcactcgccacatgggtggtgtcgtcgatggcgtctccccgcaagaagtcctctgtcttggcgccggtgacgatcgacggggtcttttcaccggtgatggtcgacggggtcttggcgtcgacctcggcgtctgcttcgccatccgcggcgatggccatctcagtggtagggtactagggttgtggacttatggggttgtaaccgcgagcggggtggcgggttttataatggaggaggagctgcccgtagcgggtagcggggcggaaggagaggattcggattacccaaaaaggaaaaaggaaaggcgtgcaaaggaacaggaaagaggaaaaaggaaagtaaaggaaaaaaaatacggtaacgctaattcgctgcgcgttaggattaatcgagtgtggattctaatccctcgaggggatatccccttgtatatctttttcttccaaatttgatgcaaatagttgtgaaaaattctgaaaaaaattgataatgtagagtataatgatacctactagtccaccaaaattcatgttcaaattcgatctacacatcgagaaataaaaaagacaaatttagatataaacagtacgctactattcatacgctgaatttgtattttttatatctcgacgtgtgagttgagtttggacttaagattttgtggagttgtatatatgtgttgtatgaatgttgtcaaatttgttcagaattttttataaccgtttagatggtttttaagcaaacgagggaacatcccctcaaggggtaagaatagtttcccgaattaatccccttttcccttttttccgtttcctcccttgcaggcccgctcctctctccgttccgttttttcccttcttctcagccgttcccagtacttctaaaaaaatactactatcgttcccagcccacctctcgtattgcttctcttgtaacaaaattactagtcgaataattcctattgcaaccagtttctccttcctcgtagagaggcctttcgatcttagtcttacccagcgacgtcttgcgcggccatccgatttattcgagaagcgtccttttataaacagattgtttgcaaacacatgcaattagttttgctgtttaccttgacaggaccatctggttgtactgagcacgcacggagagcatgtagccaatcaatccagccatggccatcatcaggaaccagaaaaacatagccccgacaatggcatcgccagccaaaacaagatagctcatgaggcatacaaggaagctcaccaacagatacgcgccaatgtagaacatcatgtagccaagctgatcgaccgtgacgagggcttcgaacagcgcaaactttgcaacgaaaaccgcccagcagtagatggctgtgccttccagaaccgagagattgatcacgagcagggacagatcacgaggaggcaccttcactagcagagccatggccgtagccacaagcatagagaagacggcgaagaaggtcacaacgccactacgatgtatctcgaaggaactcttctcctcctcggtcgagaaggtggggggagccatgcgcatggccgttttctccttgccaatgtgctgcaggtgctcggcgaaggcgtacccgagcaggccggccgtccagcctgtcgcgaggtgcatgacggcgaatccggcgatggggccggcgaatgtgccagcagagatggccagcaggacgccgtaggagatgtggacgaagacggtggtgggacgcattgtgcgcgagaggatggagatcaagaagaagaggtaggcggacatgaggagggcgatcgtccacaggtgggccagcggctcgccggagtggcggcgccgcagcagcggcggcgagcacgcgaggaacaggatggagataaagcacacgcgagctccaatcagatcactgccttcgtcggagagactggtggctctggggcctccggaccggatcatcgccaagcccgagcggtcgtcgtcgaccgagtcgcgctcgcgcgccggcggcgggcgaacgccggaggggctctcggggaaggatgagtcgctggccacatcggaggtgtcgtagatggcttctccccgaaccaagtcctccgtctccgcgccggtgacggtgatcttgtcgccggcgacggtcgtcgacggggtcttgtcgtcactggtgatggtcggcggggtcttggcgtcggcaaggtggacgtcgacagcctcggcatctgcttcgccatctgcggcgatggccatctcagtcgttgtagtgttgtggggttgtaaggccggagtgagcgcagggccggcgacagacctcggcggcggcggtggaggaggaggaattcgaggttttggctttggggaacaaggcattttgctctgtgtgcaacacatgatgtctgcgagcctgcggctgtgggtcttcccggtcactatgttttgactgtttgatttgttgccaaaactagcgaattttaatatgatgataattaagataggattttatcatcatgcatttataaatatacaataataatttggtagttacatatatgtcaagttatagtagattaaaattttaaataacatacaaaatatgaacaaaatgatttattaagatattaacaacataatcacggatccaaagttagaaaacaaccttgctctgtaaaatcttagatccaagagcaaatctactgtacctaaggaggtaccataaggtactaaaaatttagtgtaaaatttggtacctcataataactagataccaagagataccaaatttataatagaaaaagtggtacctcatggtacctcctcaagaaccgtaaaattgctctagatccaaagttgtgctaaagaggaccataaccttccacttacaaatcgtactataaaatttgctaagaacttaaaccaaacaataccatcgtattagtgactcctttgatatctcgagaatatcccctattttcttgaatgtcattatgaatttttttacatgcttcgtaagtgtcatgtaggatcctaaggcactgtgacgttttagaattgggtgccacattttagcaagttcgggaaattgaaatatatgttaagagttcagggatctagatgatacaaccaaacaagtttagagatgaataatacaattttgttagatatacacccctcacatagagttcactcaaccaacacttgtatttctcgtatatcccaatgagacaggagttagaactttctaacacaacatttgtacaggtacgtacgtttggcgaaggcatgttcccaagttatactcacttgtttttcacacgcgcatattttttaaattgttaaatgatatttttttaaaaaaatagaaaacttgttttaaaaatatattaatttactcttaaattttatgaaatatattaatttattcttaaattttatgaaatgtatttatttaattatttgttaatgagttgtttcattttacatgcgtagggagagtctccaactcttacattctatatttgtatatatatatatatagctatacgttcaacttcttgtatattattgctttgtgtctaactcttttggaaaaaaaaatattgtatattcttggtttgtgtctataactctctttggaacaaagaacttacgcgcgaaaaaaaaactttttcgtgtatcctaatctatatacagctccactttaaaaatttgcagatatgtaggaatatactctctccatcctaaaatgtttgacgccgttgacttttttaaatatgtttgaccgttcgtcttattcaaaaattttaagtaattattaatttctttcctatcatttgatttattattaaatatacttttatgtatacatatagttttacatatttcacaaaagtttttgaataagacaaatgatcaaacatgtttaaaaaaaatcaacggtgtcaaatatttagggaaggaggtgtcaaatatttagggaaggaggtagtataaatttggagatgatgaagccgtaataaaccgagcgacttactactctttttcttctcctccaagacgaggggagcatctcaatctgcaataagagcgaagccccggtccaaagcagattaagatatcaactcatcgcgcccaaaaacccacacccccgtagccaaaacccgccgaggaagagggagaggagcacacgcatggcgctcgcggcggcgcccgcgaatctggcgggcaagcagagcttgcgagtcgtcgtcatcggcgaccctggcaccggcaagtccagcctcgtcgtgtccgccgccaccgaggcgacgtcccccgcgtactgccccccacccgcctccccgtcgactacttcgccgaccgcatccccatcaccatcgtcgacacctcctccaggtcctccactgcccctcacgctagatttgcgggtgtatttttttttgttgggggatttgtggattttgattcgttgacaattctgaattgctgattcagcccagagcagaggtcgaagctgatcgccgagtgccagtcggcggatgtggtggtgctcacctacgcctgtgaccaacctgcgacgctggagcggctcagctcattctggttccccgaactccggcgcctccaggtgaggctctgcactcactgccggaattgattggtaattttgtggattaattttgtccgctgtggctcatgttttgttctgcttggctcagttggaggcaccggtgattgtcgtgggatgtaagctggacctgaggggtgaggagcagggaactcttgatgccgtgatggcacccatcatggttgcattccgagagatcgagacctgcattgagtgctctgcgcttcgccagatcctggttaatatgtctgcagtcataattttgtgttgataggttgctctgagatagggatgcttggcacattgctgcacataattaagttaatagctacaacactagctagatcataattttattgtattctaggcatgaacttgttgtacttttactgggcaatacttttattatgtactgtgtttattagctaaccagtagcaccaagttggacagactagagtaatattaccaataataattagagcagttttaaaaattatgaaatatacaagaaagtattacacgatattctgaatacacagggacattctctctgaatttgggtttctttctcagaaaaacccaggcaactctattattctttgtttatataaataaaagtcgtattatgttttgggccataatttattttacaatataatattgacatctagggaattaacattcatgtgaaagtactttgcaatagaaatgcaatggtatcatcttgtatggcagtaaacatagtaacatactatatttgttaagtcaatagttataaattttgaattttccaaattcatgtgtgacttgtagttatcaatggagggagtacatgataattctgtctgatgctgttaggcttgagtccatggcctttctcatccatgactggctgttgtagcgagtccagcacgctgcgcgcgctatggcgtgtttccctcacctgcctagtctcccgatacttgtttccacaaatcggttgatgaaatttggcaggtgttggactgtttgtatcagttgtacaatgaattagttaattatcgcatgaattatttgaaccatcagatgcattaaaagtccagacattgtgctagtctctagctaactataattgcgtatgtttgcaggtttatgaggtcttctattatgcacagaaagcagtgctttacccaacagctcctctatttgatcaggaggcacagatgctaaagttacgctgtatgagggctttgaagcgtatatttattctatgtgaccatgacagggatggagcttttagtgatgtggagctcaatgattttcaggtttgtagccactaaagctgccttggtttctttgattagtgtaaggcaaactaatgcttgcactatcattctattaatacttctggtgatgttaagaatctccttttggctgctttacaggtcatatgcttcaatgctcctctccaacctaatgaaatcataggcgtgaagagaaccatccaagagaaattgactgaaggtgtaaatgaaaatggccttaccttgactgggtttcttttccttcatacccttattattgggaacggaaagctggaaactacttggaccgtgttgaggaagtttggctatgataatgaactcaagcttagagatgacctcattccagcaattaaacgagctcctgatcaagtaatgttgcccttttgttgcttccagctatcctgtgtactatctgtataaactagagtaattgtacatgtgcatgatcttaacactgatagttaattgttttagattctataaattgagttgctctgaattcagattttagaggtgaatttatgagaatttagggtaattgatcgtttgttatgctttttatttacagtttatatatacaccctttggtattttcatcactaacattactactgtggtaaaatatccgcactcttaagaactcctaaactgctctagaaaatgtgcttgtaatttgttagtcattcaatttgatgcgaatctatggtgttagcttcactaagcatcttcatgtttgatatttatcatacttctggtttattatatattttgctgataattaatttaaagtcaaatcattttttttgttccaaaccttggaattgaaaagtcaagtcattgatttcttgagagggatcttcaacatgtttgacacagacaatgtaagttctatgcactgatgtgattgttattctcctgaatcgtattcaactctttgttgtactgagcattttttgtaataaaaactgtcattttacattgataatttgaaaatgccttttggtataatatccaggatggagctttgcaacctgctgaaatcaatgatcttttttcaaccgcacctgaaaagtaagaagctgatagaacgccctttcatgtttaataacttgatactttcattgtaacaaaaagttaggttaccaaaattgttaaatatttcttgtattaatttctctattggacttgatgtaatgaagattctttgcattagaagggtgtgaagaattactatttaataatctgtctgttgatatttcctgtatcaatactcttctattggaatttcagtccgtggtcttctcatctgtacgagaactgtgctgaaaataatgtcttgggtggtttgtcgtttgaagggttcatctccaaggtattttctcaaactttgcatgataagagttgacacaacaattgacaaccctgtatttttttgttgatggattgaccttttagcaaattattatttgttgattggtttcaaaacaagaaagagaagccctttctctattcagaactcacacgcattgtatttattggtgtggctgtcctgtagcactgtgcaagattctttcatgactctaggaaaccccatattgttgttcttttaatctctatattcattgatctgtgcattctgagcatcaaaactaggtatggaatagattgcttacagtgcatgtaaagtattaagcaaattaatctgggagcaatcatatcttgtataaggagcacgcagtgtttaatatgaactatataatttgtcttgacaaacctgtgggggtgttgttaggcagaaaattgatctttgatttctagaattttattgttgctttaatcttgcgtttggaaaatactgaatttccttattggtctgttttcttttattgactaattattctgtaattgcagtggactcttatgacacttatacacccgtcaaatagttttgccaaccttatatatgttggctatcccggcgattttgattcggcatttaccaccacgaggaaaaggcgagtagaccgtaaaaagaagcagactcagagaaatgtgttccagtgttatgtttttggtcccagacatgccggaaagactgcattgctacaatcattccttaaaagatatcactccatagtattttatatcatgaactttgtttgccatggttatttcttctgatattctcactttcactcttggtccttgcaataggcaaccttccgatgctcctcctgtcaatggtgaacaatttgcagcaaatactgttgaactgcctgatgtaagtattcgaaattcttgatttattttgctcacaccatatgcaaccattttgatagttttattttgaacagtgcaacatttactcatgtattcgtaagtattctacagtctgagatgacagatactctttaaacaatccatattcttgtttattaaaaaataagtaactagcaacatatttatatgaaaccataattgatctgcatcttaacacttgataatgtgtgtcacaaacaagttagtttctaactgtttggtctgattcaataattttcttccactgaaggggactagaaagacacttgtgatgcgagaaatttctgaaggtgatgttggaccattactatcagataaggaatctttggcaccctgtgatgtagcagtaattgtttatgataggtatgctatccactgaattatccccctctttattcatggccataagttttgtcagttgcatttttctttcatggtcactgaattcttcctttttattcatgacaaaaatcctcaatacacagttttcagtagcagcactcctttcccattagctatagcagtatgatttgtttataaacctggcatactatgagagaactttatttttgctttagatgaaatcaattttgttgttgtgatgcatttgtattaaccccagtgacaaaaacagaaaccaactgccaacaaaaagagaaatttcagtcccccaaaaaataaaaaacagaaatttctcttgttttagagacacgtcaacatcttgtggtagctatcaagggatctaaacaaactagcagtaactggaggtccacagtttggtaggactggcaaataacatatgctgatggtaatctaaatatagacttgaaaccaacagctaactgcctgggtactggtatgggatgttcatctccacaaggaatatgaattagcagtacaccacttaaatagaataaccgactacacgatactgtcaattggctcgttgaagtgactgactttaatcctttatcctgtcaattggtttaaatattcgttgttctatgcgagccctcctgctgacagttcacagattcaggattgaaccaatgtagtaattcagaagttcgacacataaatattgtttattcagatgtacctctctctatattatctattcagttgtacctaattttctgcacacaaaatgtgatgctgttgaaatggcagtggtgatgaagtttcttggcaaagagcaagagaattgcttgtacaagtggccacacggggaaaaaacactggctatgaagttccttgtctgatagttgctgctaaggatgacctcgaccaatctccgttggctctgcaggactcaactagagtaagcttcaatacaatattgattcatttttaaactgttatattttatttacctctgagaatcatttgtcctttttggcacagttggttggttgaactggaattagatatttgaatgaatcagtccccccacccttttttttttcttttgcttttgctaattggagaccaccatgccagtggttgtttctgctgcctcatggaaaaactcttgatcaaactgtgtcgttccaagtcaacattcatacaaatggactgatttgtcaatattgtctactattgccaccagttttctttatgtctgatctctacagctatggattattttcagttgttttaattcaataaaatcatgtacttgtaggtgagccatgacatgggaatcgaaacaccaattcctattagtgtaaggttgagggatttgaacaatattttctgccggatagtccatgcggcgcagcagcctcatttgagcatcccagagactgaagctgggaaaacacacaggcaataccgtcaacttctgaaccgttccctcacggttgtctcaggtaagttagtgtcaagcttctgcctctaaagtgtgtttctgtatttgcctttatgctctggcacaaatcgatcatgccaattactacagaatagtaagagcacaggtttagtaagacaataaaatctaaaagtaatagttatttatgattttgagttgaaactgaatagtggttttatcttaagttggttgagttctaacacaactgatggtgtgccaataatttgcagtaggagcggctgttgcagttgtgggcgtagctgcttaccgggtttacgcagctaggaagaacgcgtcatcttgaagctctcctggacagtgatgaaatgctactctcctggacactgatgaaatgctgctattcccctcactgcccaacaacaggatagattagattatttttattgcttgttgagcttcgtaacatgctgttttctcttgcaacatcgtttatgtaaagatatatactcagttaaaatcacactggctgggaaaagggaatgtatatactcgatatgtccatgttgcgtcgcctattgaatttcagtacgtcccatgagccatttttgaactgactctaaaagatatattatagacagttctataaaagaaaaccctccaaaaagttatttaaaaaatcttccgtattgggatatcattacagaaagttcaactacacaactgtctgtggcagtctaacagatagaggaggagtgcttggtctcttggtaatttcgacgcgaatcgcaagtttgcaaccccaccagttacaaaaaatagggttgtgtttagttattgtgccaattttttttcagtatacggacacatataaagtactccctctatcctttaatataagggattttgatattttgcttacaatatttgaccgctcgtcttattcaaaaaattttggaattattatttattttatttgtgacttactttattatccaaaatactttaagctcaactttttgtttttgatatttgcacatatttttttaataagatgagtgatcaaacagtgcaagtaaaatgtcaaaatccattatattaggggacggagggagtattaaatatagactaataacaaaataaattttagattccgtccgtaaactaggagacgaatttattaagcctaattgatccgtcattagtaaacgtttaatgtagcatcacattgtcatgtcatggtgtaattaggctcaaaagatttatctcgcgatttacatgcaaactgtgcaattgatttttttccgttcacatttaatgctccatgcatatgtctaaacgtttgatgtgacggaaaagttggaagtttgaaaaaaaaatttaaatctaaacacagcctaggtaagatacacgattttgatatcattcatgtcacctcaaagtagaaaaaagaaaaacaagaaggagatatcattaatgtcatctcaaagtcaaaaaaggaaaagaaaaagaagaagaagaagaagaacgaaacaaaggctggtttagttcctaactttttcttcaaactttcaactttttcatcacatcaaaacttttttacacatacaaacttctaacttttccgttacatcattccaatttcaatcaaatttttcaattttagcgtgacctgcacacacccaaagaaggcgctcgaaacggcccgacgaggcgaaggcgccttttattccgtggaaaaagtacaccgaaggtccctcaatttgttatcgagttacaaaatcgtctctcaaccacaaaatcagatacccgatgtccctcaactaacaaaaccattcacttatcctccggtggttttgacgctggttttatctgacgtgacggctgagtcagcgtgggacccacgtgggcctcacatgtcagagtgccaggtcatctctctcctcccctcttctctcccttcctcatctctctctgacttctctccaatttgttgcgacgcgagcgacacggctgcggtgatggtggcgacgagcgacgcggcagcggtggggggaggagctgcgggcgggcagtgggggaggggcggcgggggtaggagcgccgcgcgggctcccccgccggccgccacccacgaccacgaggcggcgtgggcagcgtcaagttcggcggctccaccgcgacggccggctcgttcccggccgacgggctagtcgggctcggcggcggcgcggtctccctcgtgatgcagctcggtggcgcggcgtcgctcggccgaagattctcctactgcctcgtcccgcactccgtcaacacttcatcggcgctcaacttcggcgccctcgccaatgtcaccgagcccggcgcggcgagcacgccgctcgtcgccggggacgtggacacgtactacaccgtggtcctcgactccgtcaaggtcggcaacaagaccgtggcatcggcggcgagtttgcgcatcatcgtggactccggtacgacgctgacattcctcgacacagctctgatgggaccactcgtcgacgagctctcccgccggtgcagtcgccggatgggctgctgcatctgtgctacgaggtggccgggcgggaggtggaagccagagagagaatcacaaatcacatcgataaacatctctagaagtccatcttgttcagataatcacagtacttatgtagaaaggatagtaagatacagaaatgcaaaaataagctgtgttactcctgcaaattgcaagtgaacagaacaatctcaagctaagctgttctttaatcagaagaacaggatatgaacaagcagaatttcaagatattttgtggcgccggtttcgctttcttacctcgctatagattctgtgagagatcaaattacatgacccataaattgtagagcaatgcaggagtaacactcccagctgagaaattgattgatgtataacactccgatcttcgatcttcgttaggcgatgcaatgagagaattcagaattctcaccaacagccagcttgctagaatagagtatgagttactgatcttgaatgacctcgtgtgtacagccaacaggaagcaaaccgaacaggcgagtccggacttgacgctggagttcggcggtggcgctgaagcaggagaacgcgttcgtgacggtgcagcagcggacgctgtgcctggcgatcgtggcgacaacggagcagcagccggtgtccatcctcgggaacctttgtcgccgccgactgcgcggggagcggccggccggcggaggagacgagcggcgggcaggcgcgctgcgggagcgggacggggagagcgaggacgccgccgccgtcgtcgtccatggccgcagatctcgcgcccgcgctgtcagcggcgtcgccggcgggagtatgtgattgcggggcagcggcgggcggagcaagcgatggcgggcggagcgggcactacgaccaagacagcttcttcccgcgtcggcgccgccggccggctctcccttctcaagcgtcgcagccgccgccggctcccttatcccgtatcgtcgtcgacggcgcctcccgggcttctccgatggtccgacctccgaggtcgcacgcgccgccgctggacctcctcgccaacgccagtccgcctgcagagaggacagaagtgagagacatcatgcagggacacaggaggggaggagagagaaaacctgtggctgtgcactgtggggctcacgtagatcccaagctgactcggcatcacgtcagacaaaaccaacgttaaaaccaacgttaaaactaccagaggatctaaagttcgagggacgcccggtatctggttttcgcttgagggacgattttgtaactcgataacgaattgagggaccttcagtgtactttttccttattccgttgtcatgggctcattgtaactggttggcccacttgagaactggagaggcctatgttatgggccttggcttacgatagggcccacccgacggcgagccgtccgcgtacggggtcaacgcaccgagcaacggattcacaccggaccacgcgagctccttccgatgcggggcccacgtgcccaggaatccgaggcggaagggatcattccaacagctgggagatctccggcgccccgcacccggttcaggtggacccacgactccgcaactctagctcggccccgcgtcccgcggggcgcaccaacacccggaccacgcgacgaagcggagtcgtggatatgggtggcgcccgggcccaccgtattcgctgaacccatcacttcccgtacacctggcacccctacactcccgcacaccgcaaacgtaaacgcagtggaatccaaggcgacattgtcctcctttatccaaaaacaaccctgtataagacccttaacttacaaatagccccttacatcgttgtcagggaggacttatatctaaatatggataatgtttgtccttagttgaaagagtttcaaacccaaacagtggccggtggcttcccgcctctccccgcgcgttttcccgcttgaattcgttccgcaatccgagggcgggtagggctccacgtcaccgatccagctcctccttgcggtgtaaggagccgtccaattccgtcctttgcaagccaaattcctcccgccgccgccgccgtcttcgcctcctttataatctcccttctccgccgtctcctcccaagttccctcccaaatcccccatttcaaaaaagggaaaccaaatttctcggcgaggaggaaaagaatcctgcaatggagagcaaagcagaggcgttggctgcggcggctgcggcggcggccgcggcagcatcggcggcttctaccggaggaggacacgcgtgcggcggatgggagacgccgaagcgggaggagtgccgcatcccggcgacgctgccctgccccgcggcgccgaggaaggccgtgccggacttcgggaagaggcgcggcccgcccaagaacggctacttccagccccccgacctcgaggccctcttcgcgctcgcgccgcgccgccaggcctcctcgtgcgcttgattttgaagcttcggctgcggcggcggcggcggggagctctggtctagattaattttgggatctgtagatacttcgctatgtttctcttctgttgtactctaggtattagtagtggattagggatgggcaagaggagggtttagggagtaggaggtaggtatgtaggtgatggcggggcttgagatgaaatgagattatcagagctcataatcatactgtttttgtattccttcagatgataaaatcttttcctggcacctgcttagttgggcatttttgcactctctctctctctgctgatgttattggttcttgaggtgattgatatgaaatcatgtactcatgcagcagtagactttgattaagacctttaatggcgtcgacatcggcggcggcagcagattgttgcttgaagattgtggcctccgggacgtcgtggtttgctcttttctgaatatctgttacagcccacaggggaatagctgtataccggcagttcttttttttttgcttcactttcatccgcggcatctgactaggtaggaataggatagtgatcaccgatcatgttgtagtagcttgaaggtttgaaaaggtccctggttgattcattgattcataagcagtagtactgcagttcagtcttgtcttgtgtttactgcttgtaccagcaatggactcgcaaaaaccgtagttttactgctgagatagtccaggtttcgttttgccaaggaattaatacgggcgggaggaaagcagagcagtgtgtgcgttcgttcttgaatctggatgcagttaatgcggctgtgggagagagccctgcctctgcagcatggtgtgtctttgcctcctccctagctggagctaggtacggtgtaccactagtaggagaaattgcaaatgcatgtggccaatgcgtgtgactagtgtcagggcttcatgagaacaatccgtggtcctgaatcaagcaaagctatagacagaaaggagagaagggaagatcctggtgacacggacagcttcgagattctgtgaccgacgagtcgacaaggacacaacgtatgctcgccatctcgccgcggtgccgcctgttgggcgaacggcgggggcgcatgtgtggtgttgggtggacgaggacgacacgccccgtgaggccgtgacttcgtgagggcagcgagaggaggccggggagcgtacgccatacgtgcagcgtgcggggacaccgggcagaatgagccgggtgtgcaattgcaagcagcacggacatggccatgtgatgcccccacgacaagtgttgcaagtgagatcgatcgatgccagcaatttttgtttcttctctagaaaaagttttttttttgcccgtgcttgcagaatgatatccatacacctatgctcgcgataggtcgagagtagttttctcaacgactaacacttgcgacttgcgaaacgtcgatcagtcggggccttggctacaacaaggacagcaactcggcaccggccagcctcgattagtgcaggtaatttcgcccgcaatctatggctcttgacagaggcagagagttcgttgcagcaaccagtagtattatatagttaatttatacagaaagattgcacattagcacgaggaaagtgcagcaaaggaggccccctcaacaactccatgacggctgtggaaactttcgtcaggaactgttactttaccttgaagccaggcacaaattctgtcgtagaaccacatctaactggtgacacaaaagtattttgtcccatcgcaactaacacgatgagttgtgctaatctagtactcacaggaccataacgcacagtagctcgaaaaaactctttttgtcagccataaagaacacctggttcatattaaaaactagcaatgtgcagagttccatatcagggaatgcaaaggtttaggcgttgtggctaataatggcggttgcttgtgttctaatcaaacaccaacagatctccatgcaaaatgtcccctcttacctccagcctccaattacaggatgattcttctcctcgtgccctgaactcctcttgcttatgccaaacgtacttataccaaagctgacaacattcccaatatgagacaaaaataagcaattttttttcgcactgcctcatctaggtttccatattattgtccagataacccagctgaatgtttgtcacctggaagaagatgaagaaggtgccaaatttatttaatcctagttcattgagaaagcaggcctatataagcctacaccagcaaaaattaagtactgtaatacctggatagctgcttatggttggtttggtttgttaccatgccaaaatattgacactatcaaaacctgtcaagttttggctttgtcaagattttggcaacacatgtgtaattggcatatttgttgccatgacaaacaattcgtttatgctaattatatttgactgggccccaatttaacaaggcgacacaagcatgtcaagttaaatccatatcggaaaagccgcttggccaacagccttctgttcacttgatttggatgactggatgaaatgaatcatatatagaaaaaaacataaaaaaagaatgttctggctccacttcaacaacttgcacacaagctccaagcaacgtaacggcactatttagttcctttctttttccttttttctttttgttccgacaacaatctcccaaaaaacaaattcttgagaaacaaagaactagaggaaaaggttgatgaagttttatagaattgacctggagggccatgcatggttagcttcaaaggctcacaaataaaaaggcgcatgcaaggtaatgcagcggaagttgatctaagataagaaaggtgacaaataatgttgttttttacaagcaggaagcatgacctcctaaagcaagcctttcatgatccaattaggaattgatatttcaccttctatgccttctgtgaaaattaactggctctcaaagtcatatattattatgcttttttcatcaaaaagttatataggtatgcttcatagggaggacaacacactatactactagataacagcaccaatcttaacattgcagcttattacacacgcctcttggtttctttttccaaaaaaaaaacaccagaatatgttttagttaattaatatagtagtccattgtaaatcactaaattagtgtggtcatcgcatactcgcatggatgtagcaatacatctgaaaattagctgccttgccgaaaactgcaattcgatatactcaatagacagcaagcaggccctctgcactccctagccaggtgcacaaagcaggagcaaagagtggcccaatagcagtttttttctatggactcctaccaactcggccaaccactaccacgctgtgacctcccaccatgcagggcacgaacccatgatgatcccctatatagagagcccgtactcatttctcgccaagtgcaccacttcactcttgcttccaagtgcaaccacaaaaccagttcaaaagctgcgccccggcagccgcacggcttgggctgggcatccgaaatgggcactccccgtggcctacgaaatgccggctcctcctcctccgcatgccgcttcctcgccgcctttgccgtcctcctcgccttgccgacgctcaccgccggccttacccgtcactacacgttcaatgtacatctctaacgagcatgatcgatatacgtacatggccggccgtgtcgatccattcttgatgtgtggctgcattgatgtttctggccgtgttctgcaggtgcaaatgacgaacgtgacgcggctgtgcgtgaccaagagcatcccgacggtgaacgggcagttcccggggccgaagctggtggtcagggaaggcgatcgcctcgtggtcaaggtgcacaaccacatgaactacaacgtctcgttccactggtaatgccaaacaccatcgcacacattcttgcgcaatcccgcaacgtattcatgcaattcgatcgtgtgtgatcgatctcatgacgatggcaatgatatgtgcgtgcaggcacgggatcctgcagctgcggaacgggtgggcggacgggccgtcgtacatcacgcagtgcccgatccagggcgggggcagctacgtgtacgacttcaccgtcaccgggcagcgcggcacgctgtggtggcacgcccacttctcctggcttcgcgtgcacctctacggccctctcgtcatcctccccaagcgcggcgagggcttcccgttccctcgcccctacaaggagctgcctcccatcatgttcggtacgtgacgcctctcccctgtgtgatggcacttgaacttgaaattgtgacggtgtttcgtaatgcgtacacttgtgtaggtgagtggttcaatgcggatacggaggctgtcatcaaccaggccctgcagacgggagcaggccctaatatctccgacgcctacactttcaatgggcttcctggcccgacttataactgctcgtccaaaggtgagatgctctgtcctctcctgattggcccatgaattaatcacggatttgtctgtttatgtctctatgatgctcgtggcagacacgtacaaggtgaaggtgcagccagggaggacgtacctgctccggctgatcaactcggcgctcaacgacgagctcttcttcggcatcgccaaccacacgctcaccgtcgtcgaggcggacgccaactacgtcaagccgttcaccgccaagacgctcgtcatctcgccggggcagaccatgaacttgctcctcaccacggcgcccaacccgggttccccggtctacgccatggccatcgcgccatacaccaacacgcagggcacgttcgacaacaccaccgccgtggccgtcctcgagtacgccccgactcgagcgagcgccaccggaaacaacaacctccccttgccgcccctgccgcggtacaacgacaccaacgcggtggccaacttctcgagcaagttccgcagcctcgcgaccgcgcggtacccggcgcgcgtgccgcgggccgtcgaccgccacgtgctcttcaccgtcggcctcggcacggacccgtgcccgtccaaccagacgtgccagggcccgaacggcaccaagttcgccgcgtccatcaacaacaactccttcgtccgccccagggtggcgctcctggaggcgcactgccagcgccggtacgccggcgtgctgatggccaacttccccaccgcgccgccgcacccgttcaactaaaccggcacgccgcccaacaacacgttcgtgacgcacggcacgagggtggtgccgctcgcgttcaacacgtcggtggagctggtgctgcagggcacgagcatccagggcgccgagagccaccccttgcacatgcacggcttcaacttcttcgtcgtcggccaagggttcggcaactacgaccccgtgaacgacccggccaactacaacctcgtcgaccccgtcgagcgcaacaccgtcagcgtgcccaccggcggatgggtcgccgttcggttcctcgccgacaatcccggtaagaatctcggcatcacatttggcaaaatcttggtttgcatcgacttccgttgactccgaatgcagtgacgacagctagctgacatgtggtgcatgtgtgtggcaggggtgtggctcatgcactgtcacttcgacgtgcacttgagctggggcctgtccatggcgtggctggtcaacgacggccctctgccgagtcagaagatgttgccgccgccgtcggatcttcccaagtgctgatggctgatccaatggccgggccgggacagattgtttgcgaacgttttgctgtgtgcgccttcgcgttccgttgtgtttgacgtacaaaactctttgatttggaccgacttaattttaactggtgtgtgccgattttgtggcaagtgtttgggggttttgcccccgtgcttaattcctctttcaaaacagaataagatgtaagcaactcggttctgttggtattttttttcgtgggcatttgttattggtgtgtacacagtcgaatccataatgtaccagataacttctatatttaattgttttggtttttgatcatttcaatataaaaaatggcttaagctcgagagtaagaaaagcgatcacattatcttactatctgttataaaaccagccccgaaatcgacgtcggtagctaaacgcggaagaaaacgccataggagatccaaaacgacaacgtcaccgagatacgatatttggtaacggagttcagccgtagcctacatctccagggcactgattacgggcgctcctctccgatctagcatattacagcgtatcagagttacaacgactcacggtcggttgacgcaggcaaccgctccctctcgctatgctaagtcaccatgcggttacaacaagcacgcccctctatttatgagagatcttaggatagagtccgactcatactctagtcctaatacctattacaactccaagtcctaaattgtaaccaactacgtacacatattcgacacaaactctaacactatctacaattggaggaaaaaaaacgttgctatctactatacacgtaatcggagatgctataaacattactcaacatgctttttgggacaaaatcacaattatttctagcattgtgatctgttacgtgattcatgcttcagacgagctattaggtggttaggtttcaaggtaaggagggtgagggatgaggaagttcagaaatgctaccccccctctcccccttcctccacctggtttccttttttgacaccgcattactttcctattttagtaaatttatacacctaaagtttatacacctcaagtttatacatctaaagtttagataccaaaagtttatatatccgattcaaatttgaatttgaattcaaatattttttttatatatagtatttctatacatctaaagtttatagacctaaagtttatatatccgattcaaatttgaatttgaattatatccgattcaaatttgaatttgaattcaaatatttttcatatatagtatttcgatacatctaaaatttatagacccgattcaaatttgaatttgaattatatccaatttaaatttgaatttgaattcaaatattttctatatatagtatttctatacatataaagtttatagacccaaagtttataattcaaaagtttacatatccaattcaattttgaatttgaattcaaattttttatacataaatttttctaactttttattttttttaaatttttttgtggtgtactgtaataagaaaagaaggggagaagggagccgcggccgcgcgatgaagttggaaagtgtccccgacttagtgcaatggacggagcgatagtggaatcatctcagccacgagagaaggggcatgagtggtgggccaatgttggtactggggaaaactcattgttggagtcattacgaggtggtgagaggtgatatacggtgtatctaatggatggtggcgtgagggcattgagttgaagaagaaagagaagtgatgaaattgagttgtgagtagcaaatgctaaaggcaatactggcaaggcagagggcggcaaaagaattgtgacatgcggtaacggctaggagtgtaagtgggtcagccacgaacccacttatagatcaaaataagtgggtgtggtttattagactataagtggatttcgtgggttagctacttacatccctagtcacgacatatatgtcaaatgatacataaggatctattgtttcgcctattcgtagaataagccaaacgatatatttgtaaacgaaaagtaatttgtgaagaaaaaattatatgtgtgttcttagcgatctaaaagcaaagactgaaaaataaacttcaataaaatacctcaaaatcaacaccaaatttaaggtttaaaatttaaagtttagctgataagtataagcataagcgaaaagatgaggctctacgattttatttgtgatagaccataatgtaataatcttctttgattgcctaaatgaatatttaaaagcttgtagcatctagaaattatgtcccagttatgttagacatggaaattccaaattgtacttcatcagctacttccttcgtccatgaaagattgtacggacggaggaaatatgcatttactttggggcttaaacgatttgtttaacaactctaaccataggacgacaagctgttgttgggaccataaactaacaatttgtcttgttttggagctagtggctattaaaggtgatatgtgtaggctttaaacttgtactgatctatctgacaaaactgattaataactgaggcgttcagcaaatatataaagcatgcgttggcataggctaaatctttatatttcgaaaagaaaggatgtagcccaaatctaaggttacttaattaggtggacaaaagctagttaattactatgctaaaaatttgaagtcgtgcgcatacgtgcttataaattagaggactcaaatgtggagatgaacttggcattgtgagacgagtaaatcttctgatgaatttgatggcaaaagagtttcttggagatggcgcatcagtattttttttggtgttatctttttcttttgtgtttttgtgtgtgttttgtgtgggtggggcgctttgccacggccaacttcatggtatagagaatttcttggagatgcatactgactatgatgttatgccaaggcacatatacttaaaaactagctgggtggcccgcgcaattgcgcggctagcacctaaacaaaatcatatattttttaagaatgattttacttaaaatttattaaatagctatctcattgtcttaataagactttaaaagaccaaaccttatcatcctcgtgtttctaattatatagtttttaaaagtcacaccagttgctaccccttatgtcatctccttctttatttgcttgctcgatctaccactatttctattcattcttcttgtaatctttaaaaattggattttatagtttttagtgtttattgtcacattgggtttcatttttataatttctagatgtcctatcaaacgttgccattatacttctctacggcctatccactgtttcttctctttattgtcattgagattttaaaaattaaacatatttatcgtttgggttcatttttactttctagaagtcccgccaaaccgtcagcggctttgccattgtactcctctacggctcacccactgcctcccttctttattgtcattgagattttaaaatcgaacatgattatcattgctttttttttactttttggaagttccgaacctttaaaacttgaacttgtagtttcattttttataatttttagaagtcccatcaaacgatgccactatgcccctctatagcccgtccgccgccaactatttatcgtcattgtgattctaaaaatcgaacataactatcgttggaattcattttctattttctagaagtcccgtcaaccgttggcggctctgcaactatactcttaacaccgcgcccgctgcttctcctttttattgtcattgagattttaaaaatcgaataaaattatcaatggggattattttttttactttctagaagtcctggcaaccgccttacttatttgtttgcttcttggcctgcctgacgtccctccttttaatcgtcattaggattccatttggtgttttattaataattttatatgtcgtatcaaccgccaccactctactcctttataggcttgttacttaatttatctcgtcatgtgttttagatggtcttttctttcaatagtcttcatttttctcacaaattttagttatttataaattgtattcctaattgaaatcttatttttctttttctaatttcagaatttatttttaaaaaaaatttagttaataccttattgtgttcatttaatgattttattttttattttcaatttcagttgtttcaaaattgtattcctacttgaactctcttttaatttttctaattttggatattattttattttttattcgaaattttaattaatctcgtattgggttcttatatagattcttctttcaatattgcttattttaattccgaatttcagctaattttaaattgtattcctacttgaactcttattttattttcttttgctaatttcggatttatttatatttttattccgtattttaattaatctcgtattgggttcatatatggaaacttctttcaatattgcttatttttaattccgaatttcagctatttttaaattgtattcctacttggactttcctttccttttctatttttggattttattttttttatttcgaattttgattaatctcatattgggttcttatatggaaacttctttcaatattcattatttttaattccgaattccagctatttttaaattgtattcctacttggattctcctttccttttctatttttggatttaattttatttttatttcgaattttgattaatctcgtattggattcttatttggaaacttctttctatattgcttatttttaattccgaatttcagctatttttaaatattatttctacttggactattcttttcttctttttcttcgattaatgtgggaatttctagcctccacagcgaacgtggtgcctcctttcaaggctgttttaataatataatagatagattattgacgatatgttatagtgggttttgttcagacttaaaaaaaatgttagaccaactataccggttatctaatccatatacagtttctcctaattcgattcatatacagtttagagctgaggggttgtttaaattgtagccaaaataaatcttgttactaaaactttaaagaaaatgatgtggtttgaaatgccatcaatatgaacaacacataagagtctaaggtaagaagagtctacaaaagttgttttagtaacaactaaaaagaaagatcaatcgaataaagctacgctcagattgaatggttttacctacgaggaagcactttcgatcaagacctaaaagcacacacccactactgtttcccgacgcctactattttttctactccctccatttcaggttataatacgttttgactttaatcaaagtcaaactgttttaagtttggctaattttacagataaatatagtaatatttataatactaaattgatttcatcaaataaataattaaatatatattttcataataaatttgtctttggttgaaaatgttctttttcctacaaacttggtcaaatttaaaatagtttgactttgaccaaagtcaaaacatcttatatcctgaaacagagggagtagacaacataataaaatttcatctttacttaatgagttacaaccaattattacacaaattcacacaataacgagcacacaccaacaaatctaaaaaagctcgcccaaataacatgaagcaagcataaactaatatgcaccaatacaaggtaaagaccccacaagatggtgaaaagttgcataccatttgactcgagtttacgacatgcagtatttattagcttaatgtcatcatcacacctttatagttgagcctaaaaccggatccagcacgttgcccaaaaaaaacctacatataatatttgagcggtgatttgtcaaaaaaaaaacaaatcatttctcctaaaccatagaatccaacatatagcatatgctcctaaaataataagtttcatgttttctttatcaatacccacaagccaatccccaaagatatgagatgaactatgtggaggatataaaccataagaaacctgtaatgctctccagagcaaaatggcactccatgaataaatgatggatcccctcatttttattgaaaaaacaacatctcacactaatatttcaatttctcctaaccaaattgtcctttgttaacactatccctttaagcaaataccacataaaaatcttaatcttaagaggcatcttaagtatccagttaattttgttcctcccaatataagtattattaattaaagctaagtatatagaacgaaccgagtaactattttgatgaaaatttcatttaaatatttcactttcttctgtcaaatggatatgcacaattgaagccattgttatcaagtcgcccgactagtcgtgattagtcgtaaagtcggtcaagctagtcgactaaagagccatgacttgaccaaatagcaagtcgtgcgattagtcgtggttactcgtggttagtcgtagattagtcgtaaattcagccgtaaattagttgtgattagtcatagcaaatcaccaattcaccatgctaattggcttattgtgtttagtactttagttttatttcttgtcgacttattgttttgctttgcaactctatagtccatagtttatattatatacattccttagcacagtataatactagtaaagattatatattgcatccactgtttttgcatgaccaagtcgtgggctagtcgtggactagtcgaccaagtcgacaagttggttcaggggtacctcgactcgactttacgacttgacaaccatgatcgaagcacacaagttatgccaattgaccaggttatagcctactaaagctctttaaaaaacattcagcggaacagaactcataacatttgcaatcgaagagtatctccttcaaactatagaatacaaaggcaggtacctatctttaaaggaggtatttcctatccacttattcttgcagaatctgacttgttcactattattaattatctaggaacccatatttaagaatgtactcttaactttcataagtcccgacaaaaaataggaaaccccttctttcctctcaacttgatttgttgatagattatcgaagtatatttttttcaataaatcttgccaaacacattgctaatttattagcttaaacaaccatttgttcaataaacattggttttgaattttcaattataaactccaagtccaccctgattttttgtcagacatataatatcccatcatgcaagactatatttctttttatgttcatctccttgccaaaagaaacgtgatatgatatgtaataatcatttaactactaagtttttctcaattattttccagcctttgttgctaagatttccatgatatttttctcaggtatgaaagtttgagttgggctaattactttttgaacaacctcagtaattctatttgtagcaatttcgataaaaaaattaaaactaatattaagtaagcaaatagatttatattgttgaatctttgtaatctttttacacttagatagtaatataatattatcaaaataaacaactctatcaactgctgattcttgaactgcgtcgtacgcgatcgtatgtgcatatgcgtacgtgtcatcgggctgacctgacacatcgaaggcaatatggcagacagatatttgctgccccttgcccgtcacctactttcctttccctgtattctacgttaccgtggcttgatcacatacacgcaattattttgttcagaatttacggaagcaaattgctccacatgcatcattgcatcacccatttaagagtgtgtttagttcacgttaaaattaaaaatttggttaaaattgaaacgatgtggcgaaaaaattagaagtttacgtgtgtagaaaagttttgatgtgatgaaaaagttaaaagtttaaagaaatatttcggaactaaacacggtgtaatagtggggagagtacataatgctactataaacgagctgtagactatctactcgtattgttatactgtggactgcttcaacagtatcatatctgactcaagccacctgtatggctgtatagactatctgtccatgctgaacattttgcccgaagctctgtcgcacgtacgtacggcgtgcgtccgaactttcagcgaacgtgtacgtacgtaggcgaacgttgtgtttttgccacatcggagatctatctgatcgactcgtcgacgtgaggaagaaaaataaaaattaccgtaagagatctgggcgaagcaaagaagcggatcacgcatcctaggcactgtgcgttcatagtgcgtccgtacaccagcagttgatcagactccacagaggttcagagccagcacgacgagtgccgctacgccttggtcggagacaagcgccacagatgcaccaacgcaatgccaacatggctgtaatcagttccgctcttcccttcccttccctcggttcctcgcagtgagaattgtttgcagtactgttaatatagtagtagacattgacgtgtgagtctagacccatatgtcagccacgacaactgtatcagcgctactggatttgcatccggctcctcggcgaacaaaaaaaatctcgaggagaggaggcctgttccatctttgaccggccgggctccacggtcgccgaatcggatagccatgagcccgtttgatttggcccaacctggttttaatcattggccatggcgacgcagcccggcggcgagcgagctagcagtagctgatactgacatgtcagaaagcggactgtgacacacacaggagcgcccagcgagctctctcgttgttcggtcgctggagtacttggacagttggaccaaaagttgatgagcacgcatcgtggaactgcagttggggaagccgggacaaacacaaaaggcgagcgggcagcggagacaggaggccgatcgatcggcctatggacacgggactcgtcacgggtcacaccgggaagagattcgccgagatttcttttttgagcgcgagcgaatgaatgatcgatcgatccggagaagcagagcaggcagtacgctgttctttttttttttttttttttgaccgtcactacaccagatcctcacatctctgatgggatacctgtgacgggcaatcgaaatggtcactaatgaccgtcacctctgacgggttatacgggatgccgtcatcggtgaggcatccggctgcgacccgtgacaggtaactagttacctgtgacgggttaaaaatagaacccgtgtgaggttacctcacctcaaacgggtttaagtcctaacccgtcataggtgactagttacctatgacgggtcacagccggacagcccgtcagaggtgaggtttactcacctcaaacggcttttaagtcccagcccgtttgagatgacttctgccactgtatatatatgtctcctctcccagcgggacccacataaggagataagg

SEQ ID NO: 41610 - DNA, 5165 bp, Oryza sativa
  unsure (1)..(5165): unsure at all n locations
taaatttgtccaaggatggtaccgaagtatttaagtgcagagtggtcatttgctcagttcagagcgatgctcaaaacaccgtaatattgattggcttcgatggcgttgaaatcgttgaattgatctgacttcttgtcgtggttcagggcttcaggctcgctagttatatgtctccttcttgggcctggcgtggaacgcatactgatctctagcatttgagccgctgggcaaggagtagcctcccgaggctgatcccccgccgtaatcccgcaacgatctcatggaagcacgccgccgatctgctcatcgcatctgctccgccacactcaccctaaacctagcacggcccaacgatgctcaagtgtttctaattgatatgcaaaattacgaattcaaccatccccgtccatattttttggacgattataccctctgacgtttctactattgctatttaagataggagtataaataaatctaacccattagatataaaacgatcaacggtttagattaatttatactccgagtggaaagcactggagtgggactcctccaacaatggaagtacgtagcagtaggagtagtttagatttcctgtggtactagttgcatctattgttgtggcttcgctggtcaaatttgctgttctacacttcataacagtagtttacgtaggagtactttactcgctctctctatatagtgcaacgaccgtcaagatatctatagttcgtagtagtactgggtttgccattcgtcaaacgatttgccttctcaaaaatggcagaaggcgaggaaaattagccccctcacacacctgacaaacccttgttgctgcaccagagcaaagaacaaaataaaacgcagagctttcatttcacggcagaggccagaagagcaacagatagtcgtaggaaattaaaaaatggggcgtcagccttgttccaacagcgaaaaccctgcataaacataggaaaacaccaagtgggtccttttttgggacgtcatggccctacgtgcacacatccagctccattatatagccatttttatgcctcttccacaggagcttctgacctcggtcactctcactctcatcagcttagctacactctctcacacagtctcactccccgtgattctgcccctctgctttagctatcttctccttcccatcgtctcggcgactgactgggtaacccttcttcacccctcgccacagtgcccatggagctctacgccgtggtgaagccgtgcaggctgtacaagaagaggagcagcagcggcggcggcggcaaggtggcgatgtgcgtgcgcagcggcggcgacggcggcgccggcaagagcaggccgtccttcacctgccggtgcgtgcggctcgtcaaggagcagcgcgcgaggttctacatcatgcgccgctgcgtcacgatgctcgtctgctggcacgagtaccaatgagagggtactcgatcgatcgatcgattcatggagggggcgagcaaatgcgatgaagctctctctctaggacttaaggaactttgtgtaaagagaatagtatcttttttccatttcttttcctcattttcctttccttttttttttcctctctgaggagtagagcgaatgagtggtgcagtaggccggccagtagcccagcatgcgtggtcgctgcactgcgcatttttatttctaattttttgatgtcatgtgagcgcatgagcatctaaatatagacggacgtactcgatcaaaatgggtgggtagttcttggattctgctggtgcagtggcgcttactctattccttctacttccgcttccggtgtttgactccctcgacgtgcgcgcgtgcgtgttggttcatcggagtgcgaagagatactcctctgaatctagatttggacggctcgccacctgccattttcctcaccctggcagaggattccattgcgtttcttgttctcctaccccaaaaaaaaaacacaccaagaaagctaccactaaaaccaccgtcactttccggtaaatccgttctcggcatcatgcaagttgcaactagtaaagcacaatccttgacagtttacgctggtgatttttaccatcgcgtagaggcagtaactcgcggtaaatctcgctgcatgcgactgaagggaggggggccaaattccgaaaggtaaaagaggggagccgttaccactagtagcattctgatgagccccctgacccggaatgaagctgtggagtgtggacactcccgaggaggagaggccccaagtgtgctgacgcatcgaattatttactcccaaaacgacgcctccgtatctgagcgcccctgtgagctgcgcgccatcaccagtaatcaaaaccctctctctctctctctctcacacacacacgcaaacacacagcttggaccttggaccaaatgggctcgcagtgtacttggctactttggtgaagtctcgcatgctccgatgctcctggcttggctacgagtatctaggagactaggactaccaacgggtggttcaacgatcgagtactctacctacttcacgggcatgcatccgcccagatttcggcctcactactatagtaggagtgtagtgtcgatcctgtttgagacagtcatgaggttatggctcatcctcatcatcatcatcatcacgaagagcggcagaagcttttttttttccttaggcagaagacagaggcagaggtcgtcagtcagtgtagattaggtatacttcgtactgaccaccagcttcgtgcgcatgcatgaatggcgaagtggtggtgtaactgacgatcgatttcgggaggtcgtcttctcttttactgttcccgggaagcacgttttctttcctacgtaggacgcggtaggagaggtgagtgagagtaggtagctgctgcaatggcgcatgcattgcagcagcgatatatgcgtgcgtacccagcatcttcggctgaagatgccagggacccatgcgtgctgcgatgctacgaacgttgcagaatcagcatgatcagtggccagtagcaagtttttttttctttttttctttctttcttttatttttggcgagcagtgtccagcgtgcagtagtaaagtggtcctatgatcctactgagatgagtgatgagtactcactacctaggtcctttgctctttgcaggtaaccggcgagtaagctaggagaggatgcacagccgcaggacccccccaccatccatgcacagtggccttcacaagctcgcagagctcagctccggctgcctgcactgcactggctgcaacatacggtttctgctcctgtcccccctctcccctccctctcttccaggacggctgctgcattcatgcccctatccagtatccggccttttgtgcttggatacttgcatgatcgatgaagcgtgtgtcacggagaggtagcaagggcagatcctttagagcaagtctaatagtatagcccactactagctataattcatctataaccgatttaatagccaattcatacaatagttgcttactacactattaatatatggtctcacctgtcatacacacagtatgtcttggagtccgtgctgcagctggctacaaatctgtagcccgctgctcttctctctcatcgtttatctcattaaaatatatttatagctggctaatagtctgctattgtacctgctcttatgtgtgtggttgcaatgattccgaccacagtgtgggtgactgttcctcttgatatcttgcatctggtaacagtggtgacaagtggacgctgatcagctacatgcatagttcagggctaatggtcctatgtagtagtatatttgtaaggcacgcagatgagaatagtaacaaaaagcataagaattgatgctagatagatttcattcggtgtttcagcgcataaaagtgtagctgaagttcgaaaagaaaacatgggcagaagatgtagttaagcttcagaatcttcagataagcaacaccatgtactatctcgttatctttacacctatgcgttatcaacacagacgtgggctgatctgatacgaactctgcacacgacttcttgactttggccaatataatccgtcactgcactgaatgcctttgcaggtgtaggtcgcccagatagtagcaaatattctctctactcgagtctcgtcatctcttatcttcagagttcgcactcttcaagaatacaccgggcaactcgccgaagaagaagcttcagcggcagaagaagaatcacccatcgagagttttcccctcccaaggaagatcagggtaattccgtatctccttcctcatggaaacgcactagttcatctttaggcccaaatcgaaaaagtttatatatggctagttcttgtgcatttttggtggtgtcactcatttcagtacttgatggagcatattattcaggaagaatattcagggaacatgattgtccatttttcatgttttgctcgtttgctgggataatctcttaggcattcaattttaaggaatcagatatcagcgtaccatgttttttcattagatcctaatagttttgtttttttgagaaaatgcattcttggatcaaatagaagaaataaaattttaaaaaaatgcataaaagtaggaagaaattggttgtggtttgcttcaactatatgctagtgggttctatgctgattttcaggatctcttcttgagataaaaacagtcatgtctgagaccatagatttaaccggagatagatgcattcttaagacagtgatcaggagagcaaaggatgatgctactgcaccttcagatagtcttcccattgttgatggtattgcagctatctacacatcttggtcttgcttcagtacacctattcttcagatttacaaaagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41611 - DNA, 12054 bp, Oryza sativa
attaacagaggaacttatgccagtacctgtctataagttcgaaaaccttgtcaaacgtagactcttttttatccattgagtcatatacgttgacggtgcaagccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgtgccttcaggagatggacgagattgtcctctgtttcttgtggatattggtcgagcattgcgacgtttactctccgagggtcgatgaattcagtatcgaaaaccctccgccgtcgggccctttgaatctccattctacaacgataaaagggagtattttattttatatagtttacttatatacaaggacctaattaaataaaggagacgtagtaattaagaaatataactgaacgatatacttacaaaatccagcaactcataatagagacgtcgagggcgtccagctggtatacttgatagattcccttgaaattgatccagagaatatcatctccttgcaagaagtccgggtccctgatcctcgctccgatcatctctctaccggtggcgctcatctccatgtacaactgatggaacttgtacatttgtgtgggtagggactgcaccagctcgggcttgacaagcggtttaccgagtttgtacatgtctttcaattccgccttttctaatggttcaactcctagcaattgatccgtagttagactggtgtcaataataaattcttctatcgtcatgtcttccccggtcaccaacggcttgatctcctggtttggttgctctccaagctgagggactggtttggactttccagaagatgctttcttcagcgttcgctcatagtctgatagcttgatggcctccttgacaggtgcagacatacccctgaagaagttcctgacactggggtctacaggaatcttcttttctggacttcgaggcttgaattgtctcttgacttctgatgcaacgtaagcgtcaagctcctcttgcgtgcaatcgtaccccgggtccttgttcttggcggcgtcaacttttgccttcttcgttgcccttgtgtgggcaggcggtggagctggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtacacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgctgtggtaagtacctgaagggtccgttgggatggccatgcctgacaccaccttcatgttgtgagagattatttattagtaatcaacatatataagcagcaactagcggaatggctaaatctaaaatatataaactacgagcttacctttattgataagttcttgtaaggaatatgcagctcacatggtgtccgctgagtgatgtcatcaacgagacaggtcgattcgtcctgtgtttgcatggcgtccatgctctgtgatcttacctgccccgttgaggcgcagctgctacggtttcctgacgggctcaccattgcaggaggaatggtcggctggggatcatgggaccgatgtgcggccatgcgttcatcaaccttccttgccacctcctcttgcatgctgaggtcgtagctcgatacccggaactctagatctgcaatcttcgcctcggtatctctcttgctcctcatccgactcctgtgcgtgtggatgtcttccttgaaaccaatcttccaaggaatcacccctttccctcgtgttcgtcctggatgctctggagtctgcagggcgagtgtcagctcgtccctatctctgtccggtcggaacgtgccctgagaggaggcttccactgcatctgttagtcatcgcgcagcctctcgtatctgatcgccgaagaccagtgagccatcagctgggttgagcgttccaccgtgagcatagtaccagaacttcgatcgttccggccaattggcggttgccggttcgatacccctctcaatcaagctagcctccatctcctcccacttcagcatcgcgacgctatagcctcctgaccccaagtggtgatggtacatcttcttggcggcattttctttgtttctttccatcatcgcctgcccttgttcacctgtcttatatgcaacaaactcgtcccagtgatcccttagctttgggaatgtgtcgaagttcggtgtctgccccttcaggatatatttcttgtacaactctcccttgaagctctgaaactgttctgccattttcttcagagtccaccttttcactttgtcctctatacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctacttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactatacaatcttatatgctaagtctaattacaagtctaatattatttgagtgcattacaaatataacaatcatttatattattacgtcacttgcctgcacgaattccttctagggctagctcttccactccggcttgagggatcactccgacaacacgtcttttctgcaagatacaaaaaatatgtattaggataaatgcgaagtaacatatatatattgcatttcacattcacgttcgttcacgttcgttcgctcgttcacgttccctagctcgttcacgttcgttcgctcgttctcattcacgttcgttctcgttcacgttcgttgtcgttctcgttcacgttaattcgttcgatcgttcttgtcacgtcctgataaattcatcccgaaataaaaatcattctctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattattaagaaataaacaaagttaaaatgattttataaaaagaaaaaccctaaaaagtcttttccccccttttttcccctcttgggccggctcggcccatccctttctctctctctcctcttccccgcggcccatccggcctcctccccgcgcgcgtgccgctgacgggtgggcccgcccgccaccctcgttgacgggtggggcccacctgtcatccctgtcctcccgccgctcccgccgcctcgcccatgccctagcgccgccgccgccgcgaatcccgccgcctcccgccgtccacgcgcgcaataaagagggggaaatcactccccgtgattccctctctctttccccccatttttctctccctctctccctcggattcggttggaaaccgctcccctaatctcgccggcgccattgatggcggccgacctcccgcgccggtttcctcccttccccggccaccctccctcgccccggctctatttaaaccctccccgtgcctccctcctccgtttccgccactcgccgctctttctccccgtcggaatcgagctcgcgccgtcgctctctctctccgccgtcaccgccgagctccggtccgccgccgtcgtcgcctcggacctcctcccgcttcggtatcgcctgcttcggcatcgccgcgtcctcgccgatctcgtctaccccttcgtttcgcccgccgaccgccggaacgccgccgtcctcgtcgacccgagccgcgccgccgcctctctccgcttcggtcgccattcccgtcgtcgccgtcgacccggggtgagccgttggccgccgtttcgcttcccccttccctcccctctctcgggcgccactccgccgcgccggtggccgccggcggcgaccatcggggcgcgggcgcgctgcctcccgccggccgcgctggttcgccgccctcgggcgcgccgagtggctgccgcgtggggcccggccgtcagccgcccgcgccctcgggtgcggctgacgcgtgggacccccggcgccggccggtgtgagccgggtgcacccggtccaccgtggaccgtggggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttagccatttgaactcggaattggaccgttcaagtctctaatttttccttaagaagtcaagaacccatttttgtgctttgtttctgcttgttatatggagtttagtcgagtaaaagccttttcttttccgttggtcgtgtagacgcagcagcttcggaagatccgctcttcgtggaagttgaagccgacgtttgggaaagcgagcaaggcaagtcacatcatcctcgaacagattgaaccccagtttataaaattattttgatttaaattattgcattgtcgctttatttaaattcccgcgttatcactgttttatttagccatacctatttacctttgttatgaccttattattattgttattgttattattaccttgttcaccctagattaaacaaaaccccaactagtggatactctactcatggtaccactagtatgattttaggtagatgcttcgctgtttaattaggtaacattaggtggttttacaactctagactttgggatattctcatcacctggacactatggaatggtttggttattgtggaatcggcttcacaccgccccctctattcaaaatccccaaaatggttttaggctgggctcggggtgcatggttttgatagtagcacctcagccatataaggaccggtcttcgggcctctgttgcaaagtactaccgtacttccacatgtctagtgggtaaggcttagtttgtggctcagtctggttataaacaaaagtacacggattagagatggacgaagtagggggtcgatggacatctctaggacaaatgaaggctacacgagctgcggcccggtagtcgagatgtcatggcacagggctggtgtcctgctgctaggggctctatcctgcctacctgtcccggaggttccggccgtaggtggggttgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgcccttggttatgggcaagccgagcaatgtacccaagttagtgttttaattcttaaaatttggcttaacaactaaaatgtggaatggttggcctgggttggcttgggacgagctgggacccagggtcgggttgccagttcggtctgaatcatcgtaggccttgggttaaggcaggttcgtgtgggttcacggccttgattaatactactgtgtagctctaggatcgtctttataaaatggctttgggcaactaagtgacttttaaatgctgttttctgcaaagcttaacccctatattattaccccttgtacccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgcgaagttggagccgtaggcccgctagtccgctgctgtttatttttgattgccaggcctgaagcgcctttgtaataatgtaaatattatcgatataataaagatgtgtcttttatatcacgtttgtgtggtgtaccccggcttttcctgggacggggattaatacactagcgttcgggaaaaggcaattttcccggtcgcgacagttctcgttctcgctctcgttcgttcgatcgttctcgttctcgttcacgttctcgcggcaacgtacgttgacgtgttcgttctcgctctcgttcgttcgatcgttctcgttctcgttcacgttctcgcggcaacatacgttgacgtgttcgttctcgttcacgtgttcgttaacggcggtgtggcggcatcgggccggctcttggcgcggcggcgtgcggtggcggcggtggcgtggcgacggcggtggcggcgtggcgttgcatgcggcggcggcgttgcgtggcggcgaaggcggcggcgtggcgtgcctgcggcggcgtggctcggcgtcggcgtggcgcggcgtctcgtggcgggcggcgcaacggagagagagatcgagatcggagatcgatgaagggagaggcggcggcggctctcaccccagagatgcggcggcggaggaggaggcggaggcggcggcgaggacgacgagctcgagacgatggcgtcggcgcggggatttgccctaggcagtggcggcgaaggagagaggccgagagagatcgatcggccgaaaacgttgagtgttggtggagaagacgagggcgcaccgggaaaatatatacccccggatctttactcccggttgttcttaacaccgggactaaagatatctttagtcccggttgttctcatcaactaggagtaaagatcttttcccgctatttccaaattctttttaaacccggttagggttaagaaccgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataacaattataatcatcatatatacttagcgtaggaattatattaaattaaaagttaaaaactctaattaacatatgtaaatgccacatgcatgatttaaccttttaaaaattggaatagtcatatataagtagcatatgaaagatagtaaattaaattgtgaaaaactctaattaacatctgtaaatgccacatgaatgatttaatacttttaaaaattctctagtcaattataattagcatatgaatgatagtcaattaaatgtagcatatgaatgatagtgaattatgccatacatcaattgatttatatggataatcaatacatccaaaatagtttacatcgtgtacacaataattacggcattacatcggcggtgacggttgtccgcacgtactttctcctcactattgttccctccttgtgatcgctgcgtgagtaaggggtgtcttcatttgatagaaggatgctagggtcaatcgtcaccgtgaaaggggttgctcatccaactgatcgtaatcctcgtcagtcttattctcaactccgacgatttttattttgcctgtgagaaccacttgacacttaggctcgtcaggccctctgcccttctttcctttgctagatatgtccttcacgaaaaagacttgcgttacatcattggcaaggacaaaaggttcgtccgagtatccaaccttgttaaggtcaacagttgtcataccactatcatcaatcattacgcctccactagtcaacctaacccattggcaccggaacagaggaaccataaggaccatagtcaagttcccatatatcctcgatggcaccgtaatacgtggcagttgttctatcgtgtcccatggcatcgacacgaacagcgctgttttggttcgtgctcttcatgtcttgggctctcgtgtagaatgtgtacccattgatctcatatccctggaatgtcgtgatcgacccagacggtcccctcgccaggaaggcaagttgttggttgatcgactcgttacccatgagatgttgtcgtagccacgtgggaaaagtatcaatgtgatgccgtgtaatccatgcatcggacttaccgatgttcttggcgtgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgatttaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacacaggcccgagaatacggatctctttcacaaggtgacaaagcagatgcgtcattatattgaaaaatgaaggtggaaatatcaactcaaaactgagagacattgcaccacttcattctgaagggcttctaatctatccggatcgatgaccttctgcgaaattgcattcatgaatgcacatagctttgttattgttgcccggacattgtctggaaggataccccttattacaactggtagcagttgtgtcatcaacacgtgacaatcatgagactttaggtttgtgaacttcttctccttcgtgcttattattcgcttgatattcgtggagtatccagatggtacctttatgctctccaagcattcaaacatactttccttctctgccttgctaagagtgtagctagctggactcaagtaatggcttcctttctcctttggttccaggtgaaggtcgccgcattgttccatatgcttcagatcattacgtgcttccagtgtatctttcgactttctgtatacacctaggaagctaagaaggtttatgcaaaggttcttagtgaggtgtatcacgtcgattgcgtggcgtacgtccaagaattcccaatatggtaactcccaaaatatagagttctttttccacatcgccgcgtgaccatcttcgctctatataggctggcttccaggcccctttccgaacactactttaagatctttaaccatagcaaacactgttttcccgctgcgatgtttaggcttcgtacggtggtcggccttatgttcgaagtgcttgcctctctttcgtaccgggtggtttgctgcaaggaatcgacgatgacccatgtatacaaccttcctacagtgcttaagatacgtactttctgtttcatccatacagtgagtgcaagccttgtaccccttgttggactgtccggataggttactaagtgcaggccaatcgttgatggttacgaacagcagcgctcgtaggttaaactcctcatgtttgtcctcgtcccacacggggacacctaccttcttccacaactgtttaagatcttcgaccagtggtcttaggtacacatcgatgtcgttaccaggttgcttggggccttgaataataatcggcatcattatgtacttcctcttcatgcatagccaggggggaggttgtagatgcacatcgtaacgggccaagtgctatggccgctgctcatctctccgaaaggattcatgccatccgtactcaaaccaaaccgtatgtttcgtacgtcctttccaaattctttaaattttctgtcgatgtttcgccactgcgaaccatcggcggggtgtctcagcatcccttcctgttgacgctcttcagcgtgccatcgcaacattctagcattccccttattcctgaacaaacgccttagccatggtattatagggaaataccacatcaccttagcaggaattctcttctttgttagctgcccgtcaacttctcctggatcgtctcgtctaatcttgtatcgtagtgctttgcaaacagggcatgcttctaggttctcatactcctcaccgcgatataggatataatcgttcggacatgcatgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaagaactccagagtggtatccaactttttgtgcccctactcgcaacctgggtacaacgaagttctgtggtcctccaacatcttgtccatttataggcctccttttcactttcgcaatcctccctggcatcctgcaacatctgaccaagatcatccgcaacgtcgtaccatcagcagctgtttcctcctcgcccgtttgattttcttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattctcacaattattgcatggacaacaaataaaacccctttgcctgttagcttcggccactctcaaaaaatagtgcacgccgtcaataaactcttttggaccgccggtcagcgtacatccattgccgatccatctacatgagtcaaaaaaaaccgtacacaaataattattcttacaataatgacagtcatacaataattataagatatctttattcatacaaaaataataaaatattacaccaaataattcttaaaaactatgtgtaaagttttaaactaattttaatgtgttttacttcttttaattttcattttagtttgttttctattatttaagattaactttcactagagttttccttctcaactattttataaaacc

SEQ ID NO: 41612 - DNA, 834 bp, Oryza sativa
atagatctccatgtttctgctctgatagcctctctgatctcgatcttcagttagccaagccccctgccctgcatcatgatttatcgactactgagatatactatactatactatactatacatgtgtatgagagattcaaacatgcatgacagacacaatctatcgatgtatgcagtacacacaaatcaaacaagcagatgatcgatatatttttagataatgaaaatgatttacatctacggcctcggcacacaaccaacgagttttagcacctaaagaaatcaagccataaggtgatgagacaaattaaacccccaactcggtctagacaagttcaactcaaaaaaaggttataaaatcacatcacttttgttcgcacagcactggatgcatggatgaattgaaatgaacatggcagatgattaactttggttgatttggagtatgtatggatcgccccctcgcactggagcacacacgcgccggacgaaacgaacgaacggaaaatctatcgatcgagtagttggtggcctggcctcaactaggatcagctagcaatgcaagccggagaacgcgtatgcaggatcatctacgatcgagtgcggaggaaattaatttaccttagtcactcactgtaagtatgtgtagtggttgaagagcgcagcgccggccggtcgccgtcaagggtttcgagcggccgccggcttcttcttcgttctctgctgttcaaatctgctgttcaaatctgcggcgacgggaatgagattagctaactcaattccagcgcgcgtgcgaggacggcgagctcgccgaggaaacttacctgaatctca

SEQ ID NO: 41613 - DNA, 9122 bp, Oryza sativa
cggcggtggcggcggcggccgtggaaggaggcgaagggggaagagagcgaaaaataccaaaggaggaagagatcgccatggtcatcccgtcccgtggcgcacgcactgcaagtgttcgtctctatgcgctacccaagctgctcgcttcgcctcgcctcgcctgctttcaatctggtcgggtcgggtcgggtcggagacaagtctgtccgttttctttcttccggaaaaggaaaaccccatcctttaatatttaataggtgcgtgggccggcccatgcttattatttttattcagattttcttttcgttctaaaaaaaattataagcgtgttgagaattaaacatgggaccttatggttaaaaccacacatcttttatcactgcactatcaagtgcatgagccacattttcattttgtttcagacatatataagagcttctttgtccatttagatttttgatagagccagatttcatagacaagtttttgttctttcaccttaacttctatactgtcataactatataaaaatattgaaatgtacccatcatcacccatctgaagtagattctctcattctcatcactgtgtgcatttccagaaatgtggtcttatgatgactactagactccattctataccaccgagtctttcaagttaaacgatttgctatcgacattatctctttctataatataccggtggctttatcaattcttctacaatacgtcgttgggctagatcttcttttcaaaaatatcaaaaatacacctaagagacatacaagattaacaattaatttatctcatcagaagtttcaaaaaaatatgaaaatttttatgtggcctccttacacaacatgtaagtttgtatacaagtttcaagttttttctggtaaatttagatttttttaaaaaaatatttttatgtgctatatgagagagaatttgcttatacaagacataatagcacaaaaatattttatgtagtgtatgaaagatgatttatattaaaaacaacaataaaaaatattttatatagcatatagcagataaattatatttttttaaaaaatagaaatgtaaaaaacttaaaacttctatacaaacgtccatgttgtgtaaggaggccacataaaagtttttatttttttaaaacttcaaattagataatcaattgttaaccttgtatgtccataaggatatttttgaaaataaggcctagcccaatggcgcatagaaagacaatgtcaaggcaaatcgttgaattcaaacaaactcggcggtataaaatagattctttcctaatataactatcttgctatctgtcaacgagtgatactcgcggaccgaaagaatagggtattagggtacgttggaacagggatctacgtagtacgacatcaaaacagacaaaagacaaggattatactggttcaggccccttatcaggtaatagccctagtccagtttatatgggattgatgatgatgagaacagattacaaagagagtaaccgaattggcgatgccaatgagaccgtagtcgaggaattcgacgagatctcccagcgagttggctccggggactccggcttcgtaaactttggtgggtgtgttggcgatgagatacgatatcctttgcctttccctaggggtcccttttatatcgtgggataccttgaccctcaagtaagacttgaagatatgtaaaccgacacgatatactggagattttaccctttccgagtaggacttctgcaattccttaacttcgtggagatattttccataatttgaggcgaattcctaatgacgtatatggaaaccaaccgtatacatgaaggtataccttattggtgtattccataagtcgtaggatagagggtatgccttatccgtaaccctgacagtagcccccgactttaacttaaatgaattcatgttctcgcacgcgacttctcctgatatagcgttgtcatactcgttagatcaacctcggttatataaccgtagagatgtagagttgtcgataacgctttcagggagcctatctgtgcaggttttgaatttaaattgaagtctgaacaacggtccccagaaattttcggcggcaatctctcccctttcctcgaaatacgaaccgtcaggtagtgcgcctatataataggattttgagattcatttcgggtccgtttgccaaaaaactctcactgttcctcaacttcttcggactcttcgttccccaatcttcaacaccctccaccggcaatcttcttccgatggcggacctcgagcagtcttcctccgatgccgccacgctgaagaagctgtacaacgaaggagccatccctccgaagcaaaccatggtgagggaggcaggaggtactgttccttctcccattttaggtcgcatgatagcggtagaggatttcatcaaatgtggctttctacctcctccttccgaatttctcttgctgatcttaaacttctacggtctttctcctgcacctaaaccccaactccattgccttcctgagcatttttgctcatctctgcgagccctacattggggtagtgcctttccttgatctttttcgctttttctacgaactccggtggatggaacccaattgggtttcaggatgttgcggattccgccttcgtgatggcatgaaggcaagatacatcccactccaatgccactcatctcggagccagtggaggacgagatggttatacctggggataaaataactcgacccggttcttatcgttcccgaggttcaaccagatcgttccgaggactggaactccaaacccccgatgacgccctccctccaggcttttgtcgacatcgtgagtggtcttcgcgagcgaggactgactggctatgaaattgttgaggatttcgttagtcgtcggatccaaccgctgcaagctcacgctcaccccgcattcgactacgccggaaccgaggacataactcagatttcttcgcggggtattcgtccttgcgttgcactttcttttcgctcctgatgttgaaaccgtggacgagatctaaccatgcttccttccatctttgtttgtttcagatcttcctgacgatacggtggcgcagcgagtcgaggaggtcctgatcagcgcgccctccacggcggaaggggtgccggccccgctttgcgacaagtcggcagccgagaaggctaccgccatcaatgtaagcgagaaccaggacaccttatatcttttattcctttgaagggccaaagtgacttcaactcttgcagattctgccgttgacggatgtaatcggtcctcttgtcgatcaccgggctccgcttcgctaaaggagaaggtcgacgacgaagtcgccaagatctcctccgctcccaccatcgctgggggcagcgggacaaagcgtaagccgtgggcgagatcgagtgcccccaatggttctcggtagaagtctgctggttccgaggtaggcgtgctgccttcgccctttaacttcttttacgaggatgtcaaaaatggggtcatgatttactgtcttacgtgggacacgggcagtctggctcctcccccgaagaggaggacattgaagctgcccgccgggaggtaagcgaaattcttgatcgaccttgttgtcgcattcccgatcttcaatgacgtctgttagccttcgtaggaaagcgtcggtggtctcctcgcagagtgggagtgaggcggcgatgagtgggtcccctgtcgctgtcgctcctcatgtagaggttgctcccatcgtcgcggagtccgtgggatgtgccgctgctcctgtggccgcgccaccacctaagatgaccacttggtctgacatggtggccgagtgccaccgccttctcgagaggggttctcgggtggtggtggcccaaatggaccgtgtggaggctcgcgcgacggcggcggacggaagggtggcacagctggaggcgcaactcgtggttgcccacgaggaccttcagaagatgaaggaaatcgtggccagcaacgagatgcagcgccaaggtttggagaagaggatgaatgatacgtaggacatcctcttttccctccacgattccctccagttagcgttgttgtgcggggcgaagtcctctattccaacgcaccccaatgagacgtcactgacgtcggcattgtcggaactcgcggatgagatggagaccatcccgtcacggcacgccgctcacgttgccgaggagatctctaacgggatccacacgggggcgtgtcacgtcctcgcgtgcgtgaagctggctctccctaacgtcgacctcaaggagatcttggcgaagggggcagctaacactacgcgggagagcgtgatggcgagcgtatcggatctcggggagagtgtcctccccctttttgaggagtaaatttctctgtcttgtattatggtctttgtataaacacttccattgttctatggatgcagcagcttcctttcatgaattatgtgttgatttgtcgcgttcctttgccttccgtagctgtgtagatcccgaggacgtccagcaaggcggacatcctcatgtcgagatggttggactgccttcctcggacgacgccgtcaaggatgggggattggacgcgacttgctgcctgcttgaggccggtgaagtcgggttcccacgtgcgagctcaggtgtgatgttttatagaagtctctctcctaaacttgtgattttgtttaggaggtagcatccgtcacatcttctgccctctgtagacctcgatagtgtcgtcgctgagcgagataggcgtatcgactactggaagacaaagtttgaagtcgccaagcttgagcgatcactcatggttgtgaaaaaagaccaagccgtggaggtgcttcgtggtcgcgaggtctgggtgaactcatacctcaagagctgctgtagtgccatggctgatgtctgtcgtcagttgaaggtcaaccgcccgaagcccgaggagagtacggcaggctacttgtcttagatgacgggggcgtgtgcccaactcgaggacataggacagcgcatcgacatcagcctcaaggaggagtgtcgtcgtgcgaggcgctgcgctaggggccacgtccttgcttgcgtccaagatcatcgtccgcaaatggatctcgggttcctgcgtgggggttttcgacgttctcggttgtcggcgcatgaggtcgaccggtcggcgcgatcgcttgcgcccctagccgaggaggtgtttgcttccatgaactggcaatggccgtcgtggtagatttttagtccttgtaaaaaacatctgacagaaattttgtaatatattattgttaggggttttgtaatcataaagaacctatctactgaaggtgtaaataggtcgtgtcatatgcgagtactactctttttacaggctgtctttagcccgttgtcgagtaaggtaccctccctagcccccagccttgtcctcggagaagtctgttctcataggggaaggctcgatggcccgtaacttgcctatctgaaattgcaatttacctagccccccagccgtgaagttggaaaaaccaatttccgattacacggcttagttaatacaccttttgagcactcttacatgaccaggtcttacatggttcgttcggctcttcgaatccgacaagcccttatctgctctgggcgtccccagccgaaattcccgtaggtttctcggaggtcttgtcgaaatggcgtaaagggtcaataggttcgttttcaagagtaggtgttatcgtggtaagggatctctggaaaaaggacactggtgtataaggagatcaaaatacctttggatatttgatttgtacatgtctgggatacattgactttatacataaaatttacgtaatttatcaatgttccatgagttggataactcgctgccatcgccatctacaattttgaacttgcccgatcgcagtactcgaaccaccgtgtatggtccttcctacttaggcgagagtttgttacgccctgcctagttttgaactcgtcggaggacgtagtcgccgatggagagtgtgcgagctctgatgcgcttctcatgatatcggcgaagagcctgttggaatgcggctgctcggacggcaactcgttcgcgatgttcctcgagaagattcacatcgtcgcttcgcctttcgtcctgttcctcatcggtatacttctgtacgcgtgtgctttgatgttgtaactccatagggagcatggcttcagatccgtatacgagaaagaagggtgtttccttgttggatgtagtcggcgtggttcgtacggcccatagtactaagggaagttcttcgacccactttttatcataggccatgagcctattgtggacgcgagttttaatcccttgtagtactattccgttggcccgctcgacttgtccattgctctgagaatgtgacactgaggcgaagcagattttgaccccgagttcaatgctgtaatcttggaaatcactgctggtgaactgggatccattgtttgtaaggatgtggtgaggcaacccatatctgcagaatatccccttgatgaatttaatggcgttgtcggctttaatttctcttgtcggctctacttcaatccacttggtgaatttgtcgattgccacgaacaaaaatttgtagcccccttgtcctcgtgggaacggctcgagtatgtcgagcccccagcacgagaatggccatgtcaaagggatagtctagagcgcttgtgctggcaacttggtgtgtttgctgaagaattggcaagcttcacatcattgcactatttcacatgcgtctttaagagcggttggccagaaaaaaccttgcctgaaagcttttccgaccagagtacgtgcaccgacgtgagatccgcaaatgccttcatggatgtcgaggagaagagcttgtccgtcgtcggatgatatgcacttgaggagaactctgttcagggcctttttgtatagatcgttgccgatcatacaatatatcttagcctgacgggacagtttctcagcctccgtgtcgtcatccggcagctcgtctgactccaagaatttgattagcggagtacaccagtcgtctgtcgtctctatgattgcagcgacatcaggtacctctgcagcccctgcgagttgctggtatcagccgtggtactatcgtcgtgcgtgtccttgacggatggcttcgtcaggacatccaagaacgttctgggctcgagaggttctcgtctggaagcacgtcgtgcaaggtcgtctggttcgacattgtcttttcgataaacgtgtcgaacttcgattccgtcgaacttgcgttccagttttctgacttcggtgagatatttggctaattcggggctagagcatttatagtctttgtgtaattggttcgcgaccaactcggagtctcccttcacgactagtcgcttgacaccaagtactactgctgctcttatctctacgagtagtccttcgtactcggccgtgttgtttgttgcctggaagtttagatggattgcatgcttgaactgatctcctgtgggcgatgtcaagatgaatccagcgcctgctccttggctgttcagtgctccgttgaatgccatggtccaggtctcgttgatcgtttgggcggctggtctgtcctctgggatagtccagacggctacgaagtcagcgaagacctgtgacttgatggctgttcttggcacaaagtggacgtcaaattggcttagctcgactacccatttagcgattcggccgaccacatctttattcctgacaacttcacccaaagggaaggaggagatgacggtgaccttatgagcctggaagtagtggcgtagctttctcgatgtcatgacaacggtgtagagcagtttttggatctgtgggtatctagtttttgcgtcgtggagggcctcgcttacgtagtacgcgggatgttgtactttttccctttctacgatgataactgtacccacagaataaggcgtggcagcaatatacaggaataattcttcattgatttgaggagcaacgagtacgggaggatttgacaagtagcgcttgagcgcgataaatgcgttcttggcttcttggttccactcgaacttgtcttgcttcttgagcagggcgaagaagggttgtcctcattctcccatctttgcgacgaatcggctcaattaagccatacatcctgttagccgctagacctccttaagccttgtagcgacttcatgttctcgattgccttgatcttctcggggtttgcctcgattcctcgacctgaaaccaagaaaccgagcagcttccctgacggtactccgaacgtgcacttctccgggttcagcttcatttgatatcttcagaggttgtttaacgtttccctgaggtcgtcgatcaatgagtcgcttttcttggttttgatgacgatgtcggccacgtacaccttgacttttgtccaagctgagtaccaagtgctccctagatgccgcgctgatatgtgttgcaccgaaaggcgtgatgaacgctgtcttctcttcgtcctcttttgccatgctgatttggtggtagccggagtaagcgtcaaggaaacttaacaactcacagccagccattgagtgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaagaaaaaccctaaaaagttccctttccctccccctctccctcttgggccggtccggcccagctccctccccctccctctcctctccccgtggcccatccggcctctccccgcgcgcgcgccgctgacgggcgggcccgcccgcctccctcgctgacgggtggggcccacacgtcatccccttcctcccgccgctcccgccgcctcgcccgtgccctagcgccaccgccgc

SEQ ID NO: 41614 - DNA, 12175 bp, Oryza sativa
cccttccctcccctctgtcggccgccgctccgccgtgcctatggccgccgccggcgaccataggggcgcgggcgcgccgcctcccgccgcagcgccggcgtggtcgccttcgggcgcaccgagcggctgccgcgtggggcccggctgtcagccgcccgcgcccttaggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtctagacgctgcagcttcggaagatccactcttcgtggaagttgaagccggcgtttgggaaagcgagcaaggcaagtcacatcatccttgaacatattgaatcccagtttataaaattatgttgctttaaattattgcattatctctttatttaaattcccgcgttatcaccgttttatctagccatgcctatttacctttgttatgaccttattattattgttattgttattattaccttgttcaccctagactaaacaaaaccccaactagtggacactctactcatggtaccactagtatgattttaggtagatgcttcgctgtttaattaggtaacattaggtgattttacaactctagactttgggaatgttctcatcacccggacactatggaattgatgaattattgtggaattggattcacaccgccccctctattcaaaatccccaaaaatggttttaggctgggctcggggtgcatggttttgatagtagcacctcagccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcctggtagtcgagatgtcatggcacagggccggtgtcctgctgctaggggctcagtcctgcctacctgtctcgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagctgagcaatgtacccaagttagtgttttaatccttaaaacctgcttaacaactaaaatgtggaatggttggcctgggttggcttgggacgagctgggacccagggtcgggttgccagttcggtctgaatcatcgtaggccttggggtaaggcaggttcgtgtgggttcacggccttgataaataatactgtatagttctagaatcgtgtttacaaaatagctttgagcaactaagtgtcttttaatgctgtttactgcaaaccctaaccctttatattataactcccttgtactccctcgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaagcgtctgtggtcgtcgccctagtcttccgctgtttcccgtttgtctttatgtgtgctaggccttcgccgcccatgtaataaattatctatttacgcttccgcttgttaaactctgaactgtatcaacttttggtgtaccttgcctcctgggacaaggaataatgcacgcacgtaaggaacgcccgttgggttatttccggtcgtgacattgagtccgctaattggtctatttgaggaagagggaagtggtccttggggcacgccttgttgaggtcggtgaagtcgacgcacaacctccacttcctgttggctttgcgtaccattactggatttgcgagccactctggatggatgacttctcttatgaagccagctttgagaagtttgtccagctcttctcatatggcttgttttcgatcgggtgcgaatcaccgcagtttctgcttaactggcttggcgttgggtcacaccattagtttgtgctcaatcacctccctgggtactcccggcatgtctgacggttgccaagcgaacatgtccgcattgtctcggaggaaggtgatgagcgcgagttcctatttgtcatccagtgatgccccgatcttgacggttttgtcggggttggcgctggacaacgtgatgatcttgatggtgccatctggttttggtgtcttcttgattttgctcactttcttggggttctcggttgtggcgggtgggttgggagtatgctcgactatgtcgaggctccgcttgtcgcactgcaccaccaacttggcgttccccaggatattgattgtccctttcggtcctggcagtccctttcggtcctggcattttgagcacttagtatgcataatccgaggctgccataaacatcgcgagtgctgttctcccaatgatggcattgtacgcggtgtcgaattccgcgacatcaaaggtgatctgctctattcagaagttctcggcgtgtccgaaggtaacatgcagcgtgatctttcccaacggtttagacgatgattccagggtaattccgtgtaagggttgatctgtgggcgtcaggttgcttcgaggtattcccatcgcatctaaagtgctggcgaagagtagactgatcgagctcccgccgtcgatgagaactcttgccaccttaatgttccgaatagtgggctccaacacaatcggatatctgccaggtgtagttgtgtcacgccctgaaaatcgcctaatttaataattcattctttaatgcatttttagaaattattttaaaagcctacaagttaaactctaataatctaggaaaaatttcaacataaaattgagctagataaaatttcattaaatactttgcttgtttatctattttctagatttttctaggaattatttgagcaaggaaagtatttttaataaatgaaacatcatttcacgaattattttaattgaaaaagtctttaaaaccctcccctaggccgttgggccgtttccggcccaactctcctcccagccacgcgcggcccacgccggcccaagccgagccgccgcccctctcctctcaatccgccgacatgtggggcccacatgtcggggtcatcttccacctccggctggccaagccgagcccgagcgccgccgcctcccctccaaatccgctgcctccggccatctccaagtccgattggttgaggtgtttttatccctttgttgtcctccatcatttcccccaagaatcggagctaattgctttgtatttcatcagaatcaaattcgttttcgagtttatctctccaaactaaccctaggatagtccgatctctctaatccaagcctatataaagcatcccctagttgtcctctacgtttcccctcaagtcccgaactctaccgttgcccgtagcgccgccgccgtgtagccctagtcgccgccgtcgccgacgcccttccagccgcgccgcgccgctgctgtagctgtcgccgccgccttccattgccgccgttgggttcgcgcggaggaggagcacctcggccgcccctttgcagccactggagaccgccggagcgctgccgtcgacgtcgagccaagccgtgccgtcgtcggagctcatcgccggccgccgtacgtcgtcgtccgtcgtagtttcttgcaccggtgagttcgcgtcgtcgtcctcttcgcgtaggtgttctcggatagcccggccgagccctctatcaccggtggtcgcgtcgtcccgtgccatggcctgtgatgatgtcatcgtgacatcataaatcatttatttaattcgtgataattttctgtattagatgaaaatcaattaaacttagaaaattcataactaaatcatcgtaactcggattcgagtggttcaagttgctaaattcatctagaatcaagatctacatgttaaaaatatccacatgtactgtttatgcttgtttttgtactgttttgttgattttgttcatttgttttagtttccgacgttccagaggagagcgtttacgttgaggaaggttcagaagggtttgaagaagctcaaggcaagtcacacagatcccaaacaactctttgagcatgttgaacccgtttaaagctaatgttttatttcaacttatgcattattttcgagtgtcatcgagtggtgagcctttcccgattaattaatggccgaagatgactttattttcctatgggtaataaattgatttagcttggaccttatatattggtttagttcagctaagtgctatataggcataattgcttagccatgcttagaaacattagctcattaatgggatgaatcatattacattattacttatggttataattaatggtagctcacgatggttaatcgtgttatgataattaattgataaataaaacctgattaaaggtgggttgtgagcacatggttgtgatggtcatgctcatgacaattaaggaccggttcacgagctactgttgtgaaacatttactgtgccaaccacaagccagcgtgggcaacggctttatcttttgtatagcatgattcattacggggtgccagactgtgaagcggcgagaagtccgtgggggtcgctggggagtccatgcctctggttttgagggggagattatgatccaggaatggtgcactgtggtgagttgtgttgtttgagaggtattgtcacagttcctttgcaaggtattgtggtggtactgaggcgcatggtgacgtgttgtggaactgtgtcttgtgggtacagtggtacatctctggccagagtaaaactattcgaatagtcgtgcccgcggttatggctgggtttaacaatgtttttcgtgattagtctcacattactcattattaatgataatattgtgataattaaattgactcctggtttggaatggtatattcctggtatggaggtttgatttgtacaaccggggttggttgttcagttgtggttgggcctacgcaacacgggtgtgttgtatagtgtttatttaatattgcttaattgcttaactattttactattttctcaaatgtttattaaatgttgtttatgcaaataagctttattatgccatcctttgttatcctgtgcacttgcatatttgctgtgtggcttgttgagtatgtcatatgctcattcttgcaatattcattcatcagaggaggagtacttccgtgaaggtgatgatcaggaggattaggctttgttcgggtcaagttgcttgtggagtggagtcgccatagctgtttagtcttttgtttttatttccgctgcgtagaattttattcttctgagaggaactatccacctctgtaataattattcattttgcgaatattaattagttgtttgatagtactctattatcaatttgttattgtgtgcctcggctgattcctggacgaggatttaacgcacatgtaagcgtttggaattttggatagaaattccgggcgtgacaagtcacggtcttggggtggtcggcttccgagaactcgatcttgtgctgcgaccacttcatcttggtggtagtcgcctgtgaagtggagcaaacttcgcgttccgctttcttgtactccctcttagaggtgtacaaagtggatccaccgaagatgtgggaaacatgcaaatcatactccgggaaggcggagttagagttgtcggtggtggcttcttttgcagtctccgtactcgctttcctctttcgattgctagttgtttcgtgagctcctttttgatgacgtagcaatcttccaaggcgtgattgcttgtcatgtggattgggcaccatggcttgcgagagtcgtcgccctgagggttggagcgcctggacggttctacttgctctgcggcaaggacctctccagaagacttgcgcttcccgcttttgcgacttctcttcttgcttgactctggtgcgtctttatcagtcgacttcttcttctcgtctcccgctttgctctttccctccttgcgtctcagagtgtcgtctgcgtggatgtgatccggcgcgttgccaactcttgggtggtgtaccgatctcggacgccagacttgaatgctcgaatgacagaagcgtcggtgatctcgaggatcgtatttctgcactcattgaagcgcagaatatagtcccgcaatgattcgcctgggttctgggttagtgcatgtaggtcgtcctcgatcgcgtggcgcttgtaagtcccttggaagttggcgacgaattgctgccataaatcttcccatgaacagattgagtttggcgggagatggacgaaccatgtaatgccctgattttcgttcgggattaaaaatcatttaataatgcttttctagaaattaaataaaagttaaagcaatttaatcaagtgaaattattgagggaattaaaaatttcctttaaaaatcatggccgggaatattttgtaatattctttgcgccctaaaatattctctgaaattttcccgtgaattttcggagctcaagaagtaattataataatacaaagttcattaaaccaattaaataaaaaagaaaacgaattaaaatcctcattctttgctttgggccgtttccggcccaagtttcctccccctcaggccggcctccctcctctctcctcccttcttggcccccaaggcccgtccccttgcaaagttcacttcgcctccctcaaccatcacctcctccctccctcgccgacaggtgggcctggcgaccccacctgtcagctcctccttctatcttcggcgtccagaaccaaagccgccatgacgcgcctttgtactcccgctcgcgtcctcgcgcccaaactgcatgaaattggttcccctccacctcctctgcactctccccacatttcccccaaaaatcgtgtcgggttcgagctccacttcgcccatgatgtcgcccatgtcgccggccgttgccacccgattccgccctctcggccacaatttccctcccccacgcccatataaagcatcgtccggctctcctctaccgtttcctctccacccccgagcttcccatcgcctccctcgctcttcccacaccgtcccccacttctgctactttccggcgaactctagccgcgcgctaccgccgccatagccaccgccgcaccgcgccactgccaccactggctcctctgcgccgagccaaagcccggccaccacttcccctccccaaaccaccgccaaaaccccgtcgccaccaccaacccgagccactgccgcctcccgccggcgagcgtcgccttgcccggccatgccgccgccacccacagcgctgccacgccccaccgcacctcggctgccgttccaagccaccgaaatcacaccgaagctcggcatctctcggtcgccggtgagctccaccattcctctcctatccggcgtggtattctcaccgctccgatcacctatgttcctccctaacccttctatcttcttccccagggaatcccggccgccgtccgccgcttcgtgctcatgggtcgccgtcggacctccgctaccacctttcccgagggagcgccgccgccgcccgttgcccccgccgccccgacgcatggtgagcagtcccctccatctcccctttctctccttcggcggcagcctcccatgcccgccaccgcgtcgcgtcatgtcgccggtgttgtcgccagaggccacatccggtcgtgagccgccgccgcccctggccgctctgtgtcgccgcccgtggaccactcccgtggtccgggtccacggtgccgcccaggccgcggtggaccgagtccaccgtgtgtcctccctttggagccgctgacgtgtggggcccgcgtgtcggcgccagcctcccccctttgatgacatcagcgatgatcttatcccttgagaaaacaattaataattgcgcaataaatcattaataattctagaaattcatttaatggctcaaaacttataaaattcatatctaactcattcgaactccaaattgggccattcaacttgcaaaattcatctaaaattgagatctacatatttatttaatttttatgtactgtttctttggttttattagagtttttcctcattttgcgtgccagtgtgtagtttccgccattttggaagatcgcggtcgcaaggaaaagagttcggaagattgtttgaagaagcaaggcgtcacacattccccttgagcatattgagcctattttacaaatgttttaccgtttgcaaataaatatgcatgttttgctaattacatgcgatccgggtattacctatctgctcgcttgtgccatatttacttgatatctgtcctttgtcaaccttgggtgataaatcgactagctcgtgttacttatgtgacctagctagaattatttgcttagccatgcttaattaacgctagctcagttgatgggataattgcagtattagaccttctagtatcttgatgagctgcgtgctcgagacatctggccatgtttcgtggtcataattatccaactaaaatgcgactgaatggtgggctatgggtgcatggttttgcgggtcgcacccatggcaattaaggaccggttcacgagaaaccctgcaagacttatagtgcttaccacaagcgggagtgggtaactgcttgatttgaagtatagctcgaccctttcctaggcaccggtggtgagggtgggcatgatggagttgggtcggtcggggtgtccggttgtccagctgccggactcaccgcggcgcacgaggggactgcccacctccggggtagggggtgggggtgaaagcttagcgtggtgtggatggttaggggagagttatgcggagagtctggtcataatcactcgacatggtgacgtgcctgcacaggcacggtgacatgccggtggattgtgtcttgtgggtacagttgtgcacctatggctagagtaaaactattcgaatagccatggccgcagttatgggcgatcgaccggattcaccgtgattagtctcacacttaataaatcggcccaatgcactgtagttcaggtggattggttgggcctgctcaacgtagtgtagcgttgatcagtggagatttaatattaccttaattactcaacagttctaccgttttgctcaataaaatgttttacaacaacctttctgcaaatagccacaagccattcttgaatccccttgcacatctgcatcgttggtgtggcttgctgagtatggtggttgtactcagccttgctattgttctcccttttcagaagtgtagtgcttctgagctgaagacaaagttagaggatcaaggctcagacaccagttgagttttgcctgtggagtggagctgaagcccctctaggatcgccttttccgctgctgctgctttcttttcagtgtgaggactaagagcctattctgtaagtattttatgctttatttacgtttggaactgtatattacttgtcgttttgtgtaccctggctagtcctggatagggatttaatacacaaaatagtctaaaaatttagggcttaatttctgggcgtgacaaaccatgaccgggcagagcctttcagcgcggccggcaaataatttgccaggacgttgtcgtctgcgccagcggcatagaaaactgtggagtagacttgcagaaattcttctgggtctgtacttccatcatatttcccgatcgatcccggtcagaacttctcgggccaccgcacgttgtgaagtgcgggtgtgaatgccctgcatccattgcctgggacagggcatggcccacgatcgcgatgcctttgtggaggtcgatccgaagaggacgatgaagacgaagatgagggatcgcttggatcaggagcccgacttctcgaacgatgatcacgtccacgatctcgactcggatgaggagatttggagtttcgatctcgtcattcgtcgttattcctttcttgtctccggggacagttgtcccgatcccggtcgttgtcatcgcgtcggtcgtcacgagttcgacgatcacgattcctgttggagatgttccttcggccatcgtcccgctctcgttaagatggggagtgaggacgatgctgtcggtgcggattgccatcctcacgatgaggagaacgatgttggcggcgctcgttctcgttgcgttccctcctgttacgccgacgtccgtttagatgttcgcgaaggtcgccatcttcacagtgcggtggtgtagggtcacgtcttggaggggagcggttgccggtaggccttccgtcggggttttcatcctctgcatctccggtaagtcgctctctatctctgttcggctctgggccacctgcggcttcagcaaacgcggtgttgaggttggtcacggtctcacgtagccactctgcccatctgctggtgtctaggtttgttaccggatcaaaagggccttccctcaatatcgcgtccaggttccgcaactgatgagctggtgttctcgcagcggcggacgagctcgtctcagtgttgtcaaccacgtttacatctctaggcgactgcgaggaggactcgtagccttctaagaggtgtaacacggatggcttgtttgcgtcgacaaatccaacaaaccgatccaggaccggagccgcatctggttccttggcaacacacggagtttgaattcgtggccgctggacgcgatgatgcgctggtttgagggtcctgaggaagaccctgcagttggtgagatcatgcactctagatctgtggatcggacagtaggtggtactcgttggtgaagtgcgttgtatcccccgttcccaacaggcgtagagttcagcttgcacgtggagtatcaccgggcagtcctcgagagcatgcttggttgtcttatgtatgggacaccaagttctcggtttcagggtggttgtccttgtcggcttcgatttttcacacgaggggtgaaactcagccgcttgagggttcctcccaggtgttggggctgtcgatgttccattctccaccggagtgggaggaattgtcggcggggcattgtttctctcagtcgtagccgtacctttctcgttcccgatgacgattgggccagtcgagattggtgtaacgatgtagatcggaacgacaatagatccgacttgagtccacaccagcggtgtcgaggtagaaactccttgattggcgctggtaacgaggctattgtcggggagtcttgaagtcatactggtggatccttgagcaccaagtccccctacctagcgctccactgtcacgagtgatactcgcggaccggaagaatagggtattggggtacgttggaacagggatctacgtagtacgacatcaaaacagacaaaagacaaggattatactggttcaggccccttatcaggtaatagccctagtccagtttatatgggatcaatgatgatgagaacagattacaaagagagtaaccgaattggcgatgccgatgagaccgtagtcgaggaattcgacgagatctcccagcgagttggctccggggactccggcttcataaactttggtgggagtgttggcgatgagatgcgatgccctttgactctccctaggggtcccttttatatcgtgggataccttgaccctcaagtaagacttgaagatatgtaaaccgacacgatatactggagattttaccctttccgagtaggacttctgcaattccttaacttcgtggagatattttccataatttgaggcgaatt

SEQ ID NO: 41615 - DNA, 4969 bp, Oryza sativa
ttacaagcaaaacacccaaaagacagtggtccaaaatatattttggcaattagcacagtacgagatatagttataaagttgagaaattttagagcccttgagaggtacccaaatttttagtgtaaatttggtacctctcagtagtactggaggtagtaagaggtatcaaattttatattagaaaatatatgacacctcctaatacctcctcaacctcatgtactgtaaaatcgctctataaagtttacacaaccactgagatgtgtccgcaaaatattggttttacgggattcaatacacaaataaggcagtacattttcattttagataggaatcaagctttgttataatttccattcaagttgaaaataaaaataaataccacacttcagagcatgtaatcggggtacaatagtgcacatggaatccatgttggcaagaaataaatcattgcaatggagaagaaacaaagcctcattttttttatcggaattaaattccctgagtagaatgacaacaatatatttacaatagatgaataatatatttgctttgttcttaatgaaaatacgtcaatatatattgttgtaacacctggtaggttcaataaataaattaacttaggatcttgtatcatgtgtcactgctatttagcataaaatataacaactgccatttaattcatctattcttcacttgaaggttgatgatgagagaaaatagctatatgcgaaatgatttgtcacactggtggagaaaccatctttggtcggtcggccgaaatccacaatagtcccagttccactaaaaaccgggactaaagatattctttagtcccggttggtaacatcaactgagactaaagatcatttttagtcccggttcaaaagacggcaggtggtgtcagacccctcttttatctttattcccggttggtgacaccaaccgggactaaagatctatttttagtcccggttggtgttatcaaccgggaaaaaagatcgacatgcgccacgcgagatcgagagaactgaggcgcacgggtggatcagttaataagttctgatctttatctcctcctctcctcactcaccccatctcttcctcttcctcctcccatctcttcctctacctcctctggatctgcccccttccctctcctccccacttctcaacctcctttggatctgccccctcccctctcctccccacttcttaggcggcggcggccgggcggcgcggaggcgccctcacgcggcggccgggcggcggcggaggcggcctagcgcgccctcacgcgatggccggacggcgaggcacagcgcgcggcgggtggcggggctgcgcacggggcagcagcgcgccggttctcctctattttttttataatttgtgattgagagatgtataatttcttttttagaatttgtgattcattgcatggatctaagatgtataattgatctgtgatacatttgatttgtgtgtaatttttttaagatttgtgatgtatttgatttgtgtgtaagtaacttaggatttgcatttgtgatgtgaatgatttgtgatgttactttgatttggggatttggggtttgatttaggtatatgcatgacactcgatttagagatttgttgtttgatctgggtatatacatcccacttgatttgggagaaaataaaaagaaaatggactaaccgggactgcccctatcctctctttagtcccggttggtagcagtaaccgggactaaagagagggttggtaacaccaaccgggactaaagatcgatctttactcccggttatttcacccgggactaaagatagcgatctttagtaccggattcgtaatctcggttagaaaactgggactatagaggggttataaaccgggagtaaagatgatttctccactagtgtcatgttctgaccaacctgaaagtgcaacacaaaatgttgttttgcaagataatagatataatgttaaggttgtgatgaaaataaaaatgctcacaatatggcaaattgaaaaggatgcttctcttcttccaccagtccattggcccttccgagtagatcatttcaaacatcttattatcaaatgtatttgtcaaaaataaaaacatatggaaagaccgagctagcaccaacactggattttttacaatttggccctttttgaaaaacttatttcgtaaatagacccctgaaaaaacttatctcagaaatagtcctttttaaggacgccagagtcgctggcgccgtcctcctgccaccgtggccgggggagtgcgccaatgtggctggcgagtgcccccccccccctatttttccctctcctctctagtatagaggagagagaaatgtggaacttatttttttattttttatattctttttacacttaggagcacataagaaccaaccgtagaaaaactaaactcaaatggcgttctctccctgttttggttttggtttttcctatagtccccccaaaagaaagtagattatatttcgaacactcttagcttttttttaatatcttttacatccctataaaaaaagttagggttcatgtttttttacatgcgggtgtcatttcttaaaacaggcgtaactttctcatacggactcggaatcagacaaataatatatctacggacatctacgaaaaaagttacattcaattctccttggctttactgggttcgacaaaattagaatctctaaattccgcgtgcaagattgtgtttcgtccatttgagttttttttctatggttggttcttttatgctcataagtgtgaaaaaatataaaaaagtaaaaaaaaacaaaaagttgcacctctctctctcctctacactagagaggagaggaaaaaatgtggggggcgctagccacattggcgcgctccccctgccacctcagcaccaccattccgttggacgacggcgccagcgactctggcgcccaaaaaggatcattttaggataagtttttcaaaaagactaaattgtaaaaatccagagcaccaacatggccttacacgacagccttccagtgttcatgcaagtccaggcataataacatggggtgtgaaagaaggaaaattatcatggggtgtgcaatatctcagcaccctaaagcaccatagcttgcaggccttgcacactggaaacaattgatcccaataatcccaaaagaacatgagtgatgtgatttcacactaattaacagagttgtattgtataacttaaatcatgtttaccttgaagccagtgcacatggattgaaattcaatatttaagcttgacaaatatattgcccctcaaatattcctacggtgacaaatacaacgtacacataactaaaaacttgatattattcacagtgcctcaaaatttagaaatttcttgtaataatatagaaacctaaagtgattttctttcttggacatttgctcaacaaaattatgaatttaactttggtttatttgtaacttccatatgtctgctgattgcaagaaaagctccaataccaagagcatcgtcccttatggatatggaattggtttttttctcagagcaacacaaaaacaatcaataatacattagtaataggctgcagctaatgcgatttttttcccaacaaaataatctgtctgagtgccttccatgcaatatttctttaaagaaaataggttatcacctatcatatgacaaaggtaaaaatgtattgctaccgattggtaataggctaacaacaaactctagtttgttttgctgcaattgcaatgagtcgatgcaacttgaaaactcccatgacaaagtaatctcggtaataactgaatgcacgagtctgatatttaccgaacataaagaaagttttagccaaggacatactatcagacattggaatgaaaaaaaaaatcaactatgctcatcctggaaatcagtagcagatcctcccaaacactcctagtccggtagtccccttatcctctgatgcacatagggagcagttgctctgatgcggccatcctgtggtctgaaagttatcgaccgtgaaaaatctttctttcaatgccaaccacaagaagaatttgattctagagggggctcttgtatcccacagcagagtagcacagttccatttggtgtgtgtgatgaagaacatctcatatgcgacattgccgaggccactgggaagactcccatcttctgtgaattttcagattatcttgtctttgttttgctgttgcactactagaaacgggcacacacgtcgcctgtaggcaaaggttcacagccatatcatatgtgtaggaggaagggcgagcggcattacaatgcaaggacacattactagtatggctaaaagtgaataaattacccaaacaaaacctgtgcaaaatgatattcaaatagtaccatattccttcccaaaatcttatattcaaaatcaagaaaataacctcctaaaattcctatgaaaagttcggtgctaatcaatccttaagaattcaaagatccaaatatcatacatatttcactccaaaattctttcttgatcaaaatacaaatttgttcaaaaaaaagatatcagcttcaaatctttccacaagttccttcgaatttaccaagtccaagtatccaatttaaatcataacttccattcaaattcataccaaaatccttctcttaagataaaaatatctagtttaaaaggttgattatttacaccaccaagtttagcattagcacaagttctgtaaaacaagggcccaatagagtatattctaattcatctgtaaaaagatgcccagtagagaatttaattaactatatattctaatccatcatcaaggttgaccaaacaactttcacccgcatcttgtaaagaccacagctgatcacctcctcatccaaccctctagtaaatggagtgaacctcaaagtgcgactgg

SEQ ID NO: 41616 - DNA, 22886 bp, Oryza sativa
attgatctcgacagtgccctccaaggcttccttaacagaagcagatacaagctccacctcactgagcctactctccaaggtttcactcacaatcatagacttacgagtgtaaaccttcatctcaagcaatcctttactaaattctttgtcattgcactcttcattttccttaatcttcaaatttatctcaaaaaagatttcaccatggaaaacaattcctctagttgggcccgtgagaattatattttcattctacaagaaaaattacacaagaagttagctagtcacactaatgctatatatataaataggtgatgacattatccatagaatataatgttattatttaaatgacatggctcataatattacctagttatatttaagcccactaaaaataagtactggtatttcatatgaaactaggggtactgtggatgcatatagacaacttaaatgtagctagctttggtatgcctttaactgtacagaactgtaaagaaattagttcaatgtatcatgtgaaatagggaaaattggtagtgtttaagagaacttagcaatacctctgactggataacttggcaattgtccctattgcgccggaagatgaagatgcagttaaaatctaatccatctctgactatcacagtcccatatagattgataggataaccaacatctgatgattttaccttcagagaaagtacattcaacgagctagtcaacatgtggtccttgttgataattgaatccgtaaagcgcattggaccatattgcgctgagaaaaacgaaaatggagttagtttgcaacagggaagaatagtatgtcgacagaagtatacactagataatgtctctagactctagagttcaaaagtctctagaggacatacgtctgcatatatatcaaccgtagtgaaaattattttagctgtttcagaaatcaaattattgtagttgagagagtatttggccatttctaatcttaatcaaccattgttgagcaaattccaaccatataactgtccatttgctcaatgagatctatgggctgagagagagagagagagagagaatatgttcaatagcatacagcatgcaagttaaattctgatattggtcaggaaactgaactaaatcctttccaatccctgcttatcttagcaaagcctaaacagtatgagctttctaattcatcatataacagcttaactgtgtttgactttgacctgccctccaatcaagaaaattgatcatttgcatctcatctcatccacctgtggcaaactacaacatctcttcccagtattccccatcatccctgacatagtgtccctagctgtagcatgcgtgggcagacaacagcaccgtgatgttcctcctcatcctccaccctggatcgagcactcaacatttcaggcctctgcacctgcatctagagctcactaccagcgtctaggccctccagtgcaaggtcctcaaggaaaaatacaattcactgcttattcgcaatcactgtgaaaagaaggcccctagaaatgagcaggtggattggtccatggctgctggtggtggtactaccactgactaccgaagccgaaaatggtgaaattgtgccaccgaatcaaattccttcttctcagtcaccattgcagtttaagctcactgtcaccattgctgcatgggaggtgaggtgaaggggaggaagaatggggatagatggccatttcagaccagaagtggcaaatagtcaactgcattgtgggcagagtggcaagtgatcaattgaaatataaggagctggaaacgattaagaaccactgtgaagagtggaacaatcaaatttccccagttagtgaggattccatctagttaatcttaatgccactaacaacagctcccaagcaaacagagacatgatagggtttgaatgataagggtatatttgtctaatctttgattgttgaacaaaatgtttatcacttaatgaatgccactgtttctgtgcttgttgttgcattgttttgtacttaaaattattggcctgccattcactctgcatgtttgattggatttcgcaattacatggttcagagctgcgaacaatttgatggcgacagatcagtagcccacatagggagtaccttttactagaatttgaataaatatagactagaatttgaataaatatagactagaatttgaataaatatagaatgctcatcctcatccacagtcttagaagtaatgtgttattaggtactattgttgaggtgtatacatactctccttgtcgaggtcgaaggtggtgaggtcgcggaagcaggcgcgggtgtagtagctgattcctgtcttggggtcgtgctcccaatacttggccgccaaagcactgctcctcgcccgcctctccttcacctccggcgtgtccagaaacgacggcgcccgaggccgccggggcttctggctctgctcccgccgcctctgcttcgccgccgctcctgcttcatcttcctcctccacaaacaatggaagatcaaagctgtcctcttgctgctccgccatggtacgcgcggattcagtcccaaaccctagtccataaaattgaaatagatcggactgaatcagattggaagaaaggaaggaaggaattagcagatagcaaaagcctcctacctcctctcctcctcctcttcctcgtcctcctcctccgccgccgccgccgtcaccctcgcgttggggtccgccgaccagccagccgccaccgtggagatcgatcgatcgatatagatataggagaggaaggaagggagaggttggatgtatgggccgtagatgggcccaaattcgttctgtttcatgaatcatgagatgagaggaataaggaataagtctattttgcttacctcaactcatgcccctagttgaatcgcatccattaaccacaaaactgggcataacatgtccccccaactcctaaaaccgttgcaaatcgactccccgaacagttttggaggcggttttatccctcgtcaagagccccacttatcaagagcgtcccacctcatcctattctcttcctcacctctccccccccccctcttctcttccgtgatccctctctctctctcacacacacaccttccagccacccgcttgttggttctgccaccaccgcgctcgtcgctttgctgctgctgcggacgaccttcaccttgcccccgccgacctctagtgaaaaaggtttttgattacacaaaatctaaaccgagagcgctctcggtttcgctctatcgcgacgcgttttggagccatccgattgcctgcatcgtcgtggcatctatccgtgcgggcctcccagacctgtctccgtggataaggatagagacgagaccacttaggcctctcacagtgcggtgaactggaccggtgctataccatgccagctgagatttccgcgcacatggcagatggatggtgtaacataccgaaaattagctattttcttatcttgcatcatgccaggtcttatgttcttaataacttcctaaacctaggaaaatataattagcgagacctcccaaagctaacctgcataaaattcctctttgatattcaaaagcccttgtgattttcatttaaaatttatcttgaaatattccttgatttggttttaatctaaaaccttctttcgtctaaaacttcctttatttaaatttagtgtgaaaaaccctttttactattatgaattatggtccaagaaaccttcccatattgtcctagaacctaaaccaaagtaattccaattttattggaattaattgttagcccatcctttgatcttaaacccatcctttgattctatctaaattcctccttttgatctaaccaccaattttatctctgtggcttgatttcctcttcggcacacgaataatattattaaaaatattatgaataattgctcttgtgctaagagaatagactttatccctccgtccaaaatccagaacctcatttagcccatatctaattctctaaatttcataccacatattttgggctaaaattttatttactctactcccaccatattccctccacatactcaaaaatattcaaatctagagccatattatttatggtgttgaatattttgaatttctatttgagtgcattaaataaactccctgtccaaaacattgcactcaaaccaactagagaaatatttcttttggaaattatattcaaatataatttccttctaaactctctctcagtcaattttccttcaaattcaaattattcaaatcctttttcaaaatctagccatccaaattcctcgaaatctattatttgaatctctaggaaaattagacttcctcctttttaactttgggccgaattcttcttctctctcgcgcggcccaagtcggcccatagctgagccgcccctcctcctcccgcaagcgcgcgtgccgtgcacgcgcacgccgccgcaaactcccttccgtcgccgctaaggaaacgaagccggcgccgtctccttctcctccactccatcggcgccgtgacccattcatccttctcctccgaactgcctttcacccctataaatagccggccatttccccccttctctacatacaactcgagctctctttctctctcttttgccatgtccggccattagtgccaccgctcgatctccctcaccagagcttcgcaagccaaaccctcgcgccatcgtgttcgcctcgacgagatgattccatttttcccctttcccctctttcctatccactccatcaagccaccataaccacctcctttgcagccgaagagaagctcttctacttgccgttccggcctcctctcctaactccttcgctgggcgaccacttccccgggtgcgcgttgtccggtaacacacttggccgccgccgtcgaggccgttccaccatcggagcaccggcgccccttctctctttctctctgctgttgcacgggaagaagaagagaaggaagaagaagacgggaggaagaagagaaaaagaaaagaaaagaatctccctgacaggtgggcccatcaacagtagcctttcatatttttcttagttaattcaaatcctatcctttagaagcacatatctcctaaaccgtagatccgattccggtgaaatttggacctaaattcatcttaattcaaaagctatattttgatatcaaatttgctatttgatcattttatttgataccgtttgaatttatatttaccttttcaaatatcttcttttagctcaaattaccctttgccactaaacaaccaccgtttgaaactttacaccttccatggggacgttcgtacggtctactgaccccccgatgtcgaaccgttggttgtaaagtcagacaaaacccaaatctaaagtcgaagtgttgctcctaacaccttacgcctcaatgcgtataacgttcagagcttcactattcagtcgacctcaactgtacaccacacagttagcttttaagctctgtgtaatcctagccgctccgtcgctacccacggttgccggagtaacacttccgccccactaaacctgcacccacctcctatttctctagctgatatattgtccaacgatatcggctagagaagataccaaacttagtcgtcatactacccaattctaatgacgactagcaaatacccaaaacccttgccgatgtttatcctacctcgatatcggcttaatcaaatgaaaccctagccatccagcctgctattcaaactccataccagccatttatcctccaactacccatagcttaaacatgaaatacgagccgatatgctatcctatttcagcatcgactcgagaacaactaaaccctagccactattccaccaaagcctaatcttgattccctcttcaacctagcctccaaccaactagagcctacgcataaaatactatctcaataacccattaaagagatagttataccccaaacctagcttttctcgcctttcatcattttcttgctattttatggcttttattgaatttggttattcctcttctttaatagagtctattttattctggatggcaacctgtggtatttcgagcatcggataatcaggttgcctatcttggatttatttgcgttggagcaaggcaagttattattcctctcctttgagtataattatcctatactctatagctttattctatgcattagccattcatgattttgaatgcataacctgaacatatagcaaaccagatatatgctagattttgcttagccatgcttagttagaatatgcataaaatttaatgaacttcgattgggacagtacgtaagatttggttgatttccgggtggctagtactgtctcgatcgatataattgccaccgaatacttatgtcaaacgaacgagtacgaccgcagcttctagaatggggatagacctagttattaggttaattaacaatgtggtatctctgtacagtggttcttatctaagtcctcgcgaaggaggcaaacttatgccgcgaagggcaaatgtgatatttaccgaggcgcagataaatatcttgattatattacgatcgctgtgtgtgtgattttatggaaacctggttgagatgacgtggggtctctcaactagttctctctaaaaacctcgggaacaccagaactcctctcgctgctgataacgttacgttcagagcgcatggggactagagtttatggaacaggggccactattgttaataacctaaggctgggctacgactaagctaatgaatattggcaagtcgtggactgcgggtaaagcgtacatttactgcagtaaagtgaaaatgaatctattcgaatagccatactcacggattgagtatcaggactcatggtatttggttagaaacttaattcaagattttactaaatactgttgcataaagacatcccaagctttctttctctattctcagctttcagccagtaaacctagatctacttaaatactatttcatgcattcattatttgatataatagcttgctgagtacgttgtactcacccttgcttcaacctcctttttaagagtccatttgatgttcttgccgaagtcaggagttcaatcacataagttagttcccttttaacttaatcttcaagtctaagttatttagatggtttaagtctatagtaaaacagcaaagttgggtcattctaaagcttctgctgtaatagttagccacaatctcgtaaataccatattactttatatatccttcaaagctatgtctaaacatatgcaaagacgatccagattattgaagttgtatcaacctactgatccagggcttgatacagttaaacatgtcggtttccgaatcattagttttgggacccgacagatgcgcgccctagctgagctcctcgccccgaagcagagccgcgtggaacctggtccaagcgagggagcgcgcgttgccgaaagtcacgggcacgcgcgctgtgggcagcgtcgcctcgctctcccgtgacctcgcgcccatacctcctggtgaaatcttcgatttgccctccaaaatcctctcccgccgcacctatttccttctttccgccaccgaaacaccccaagcaagaactcgatccgtcccaagaacacaagaggaatcaccaagaagcaaaagaaacaaagaaatctcgatccgtcccaagaacacaagaggaatccaggccccagatctcatattaaccaatgaacaacacatctcacatgcacaaaaacaacactcaataaccggagttggagccaatccatcattagatcaagcgcagccaagccaagaaccggcggccgcacgccgccaagaaccggccgcccagaaggtgccgccaccgccgcccgagacgcctcccgccgccgacttcatcatagttgccgccgcgccagttgctcccgtcggggacgtctcccgctgccgggccagccaccgcgcgagccggcaaccgtggctgccggagggaggagaagagaagcagagccggcgccggccaccggggacgccgcccgcttccgcccttctccctcgcccgcttcctcctcgccgccatccgctcccgcccttctcccgagcccgcttcctcccacgcgtgagagaagagaggcagagcgtgggacagagagggaggggaaaggctcgccggtgcgcgcgatttcttgcgacgaggcggcaccgtcaacctcaccgttttgtgggaggcgaggaggcgcgcgagcgtggcaggagaggaggaggcggtcgcgccgaggaggggaggcaaaaggctcgcgcgagtagtaggcgagggtagttgagagaaataattgtgtggtaacgcgtctggggtcacgcccactgtgggcttggtaccctttactagtgcctccattcaattaaaccacacaactagatgtgcttgcactatggaatgggtgtctctgggccaattttttaggcgaggggtacgggccccatggcttgcactgtgagaggccttagaacaagtctaatagtacagcccactactagctctaattcatctatagccaatctaatagccaattcatacaatagctgcttactatactattaatatatggtcccacctgtcatacacgcagtgtatcttggagtccgtgctgcagctggctacatatctgtagcccgctgctcttctctctcatcgtttatcttattaaaatatgtttatagctggctaatagcctgctattgtacctgctcttagactgaacgtcgcactcaatcccgcttcactgtttgaaatcgggagtcgcgtctgagagagagagaagcagaggctgcggattctcccccaaatccctcgacggcgacggtgtcggcgactgctggcttctgcggaggcgacagcgactcatccaccgagcggagaggggcgacggtgagcacaaggtcttcctcgttgttgtcaccaggcttgaggcgagatctagcaggggcgacgaccatggcgagcgctaggctgagcagtgaagcgcatcgtgcaaatcaggtagtctcatctctttgagctcttctgttggctactttagttcggtgctctgttgccgtacaaacatgtttaaggtcaaattagtgctcacatatctctccatcccttttacttctaattttgtctaatgcaaatcactgaggttccctttttggtctgtgatttcaattggtttcagcaccacatttggagattttcacacggattttgggattttgtcatatgacctatagataagttttctgtaaatgcattccgtgaatgcctctgtgcaattatgtgtgattttctagtgcaaaaaattaggatgtggatgtcatggtgttggaattcgacccaaattagtactttgctttaaaattagtagggattacctttgtgctatgtattgttggtgttaatttagtatgtgtttacttgctgcatgcacaggattaggtcgaggaaccctgcatggtcaaaattttgtccatgaatttttttattttagtgtcgagaagcctgataccatagcttgtagttagttgtttatagagcaccatggacgaaggcttgctcgggttagagggaatggatgtacttataggtcactggttttagagtagatgtttttatagggcgaatggaattaatgtgcttaacttcagattccatcaggaagatactagaaaactatttttctatgacgtaattttgcttactgtagaagtaactttaggtgtaagtggttgttaacttttaggtgtaaatgatgaggattttttttttgttgcaggctatgagttcagaaaaaatgcttggtattatcatcactgaaatttttacattttggtcctttttgaaaatttattttacaaatagacccctgaaaaaacttaaaccgggaatggtcctttttgggacgccagagaggctggcgccgtcctccaacatagcggcgccagccacaatagcgccgcggccgtgccaccgtggcaccagggcctacgtggacttgctgactcggcagagcggggcgccagccaccctggcgccgcccctcataccacagcgctagcttgtctagcgcacccctcctctgcgggccccaccaactttctcccccccaattttcgccaagtctcttctgtctccgggcaatggctggcgtccccccccagaccgcggtgccagccatcctggcgctgcccccttcccccacccgaggaccttctgcctctgggccgaggctggcggcgccctcacagaccacagcgccagggtggctggcgccgccctcctcccccccgaaacccttctgcctcgcggcactggtgtaacgccctgaaaatcgccctaaatttaaatcgtgctttaatgcatttctagaaattttaaaagcctaaaagagcttccaacaattaaaattcaccaagatttatatcaaattggcttgtgggtatttttaataaattccccatgcttaaaaatgtttaactaatttttacttgaattttcagagcatcctaaatatttttaaggcaacaaaaactattaaagaattttataaaatggaaaatataagagaagtcctcttcctcctcttgggcctcttctggcccatctctccatctctccctctcttggcccagccgccccctctccttccctctctcccctcccctccctctccttgggccagcccagctcctcccctcccgcagaccgaagtccgaagtctgttttgcctcctccgcgcgcccagccagagacagctgtgctccctctcgatgacaggtgggtcccactcgtcatccctaacctccagccatcctctctctctccggccgaattccaagcgacggcaacctccgattcgcctcctccacttgccgtttcatcaaattaattgaggggaattaattcccacctcatcctctccaatttccccataatttcccactcaatcccgcattattcgtggtggattttgatgatgttctttaatggtgagctccaccatggccggcgtcgatctccctacccggcgtctctctccctcccctccggcctataaaagggacccccgactccctcctctctcccctcacaccgccgccctctccctcctctctccgcggcccacgtgccgctctcttcttgtgccgccgccgtcgcaactccggccgcccctcgccggtggtcgggacctcatcggagcccggcgtcgccaccatccgcttcgccgcttcctcctcttccccgtccacccctccgtggagcatgacgaccgcgggaacgacgacgacaccgacgacccgaagttcctcgccgtttcttcctcactgccgacaacaccgtcgacctctcgccgccgtgtctgctcggtgcgaaccgtcgtctcctcccctttccgtttttccccttcccgtactccgtcgcaccgtcgccgcgccgttggctgtcgccggcgtgccgcctggctcgggtgcttctccttcccggccgtgcttgtgcgccgtgagccgccctcatggtgtaccgagcggctgccaagtaggacccgcccgtggacccctctctctcttctctgtgcaataaatcaatttcctttagaaaaataattcacaaaattacaaatttccatttaaacagcacataaacttcaaatggccatatcttgactgtttgaactcggaatcgacccgttcaaatctctaatttctcctaaaaatgagtagaacccatttatgtgtttattgcttctgttcatatggtttttattagcctttttgtatttcttcgcattggtcgtgtagatcctgccgttccggaagatcggctcttcatcgccgtcgacgtcgaagactttgtgagtgatcaaggcaagtcatatctaccttgaacatgttgaatcccatattgtgaaaattatgttgttttacttatattgcattgctttataaattatatcgttcattattaataatgttttattagttattcctatgctcttggttatggccatgatgttgatttgatatccatgatctttgtgaaccctagtaaaattataacttgactagtctagtaccctacatgatggactgactagttgctttaggtaaatgcttagttatgcttagttccaacctagaacttttggttaaactagactatggtggttaacaactaaaactggattagttatggactattgacgggtttgtcaataggtggtgataaaatgctttgtgcaactaaaatatatttttgggttgggctcagggtctaagctagttactttggtagtcgcaccccggctaatataaggaccggtcttcgggcctctattgcaaggcatcttcgtgcaaccacaagtctagtgggtaaggcctgactggaagtttagatcttctcaaaacagagaccattggttggaagggtgtggagccaggattaaggccgttttttcactcggcgcaagggggggcctgtctcatccgggggatccgacaacctttaccttgtcggggaccagcgggcggcgaaaccccagcaggttctcctattttgggtagacctagatggatagtcttgtcacgacctctatccgagtaccgtggtggtacccggcgcgtggcaacgcgtgttgaggttgtgtcttgtgggtaaagttgtacacctctgatcaaagttaaaaactattcgaatagccgcgccctcggttatgggcaagctgagcagtgtacccaaagttagttctgttttacaaaaccttgggtgggtgaaatcatgatggtgtagtcatgtggagattaaggcaggttcgcaggctcatgcgaccttggtgatattataatattggcttagaataggatcgtgttttaaaatgtgctttaacctgattaaaatgtttaaactatggctttatgcaaaataaaccctattaggccatttccttgtttctccctatgcattattgttgcatttctggtgtgacttgctgagtacggtggtggtactcactcttgctcacaaaaataatccagaggatggacctgaggaagatgaaggcttggatctctagttcactccgccgtcgagtgcctgtggctgctgctgttccgtagtcttccgctgttttatttgtttatctttgagtgcgagggcttgagtcgtccatgtaataaagtacttcctttacacttccgcaagtgtggctagttcactccgccgtcgagtgcctgtggctgctgctgttccgtagtcttccgctgttttatttgtttatctttgagtgcgagggcttgagtcgtccatgtaataaagtacttcctttacacttccgcaagtgtggcttgtaataatcaacaatgtctatgtgtaccttgcctcctgggacgaggattaatgcactgagcgtttggaaatggtgtatatttccgggcgtgacaactggctggcgccgccctccccaactgcggcaccagggtggctagcaccgccctctgcctccctgcaaaatgaagatccatattgcacaaatgtaccaattcacagttcgcaattcaaatcacaattcacagtttcatacagactaaaaccagttccaattgcacaaatcacaatgccaaaagtccatcacatagtccatctgtcacaccctgaaaattcaaaatatataaattgttgtttaattggaattttttagaaataattttaaaagtcttgaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaaaccgctctctctctcctcggcccaagtcggcccagtccaccgccgcgcgcgcgcgcatccgcccgctgacaggtggggtcgtcgtcaacctccggccgccgccgcccgaaaccctagtttcgcgccgccgccgttcctttccaaaatccggccgttccttttcgtttccggtgaaattgattgaggggaaacaatctttgggatctcctctaccttttctcctttggaaacatcggctaaatcggtttggaatgtgtttgattcgagttcgaatcggatcggtctctttcctccgaaccctaaaccttccttctcgtcgccagccgccgtgggccttcgccgtcgcctcctagcccctttaaaaggacccccgagctcttctctacccgccgccaccttcgccttcgcctctcgtcgtccgtagcgccctagcgccgtgtgccctagcgccgccgtcgccgccgtcgctccagctgtgcgccgccaccgttccagacgtcgccgtcgctcgggaagaccgccgtcgtggtcgtcgtcgcgtcgccgtcctcgtccgccccttcgccgtcgccgaagatcgccggagcaccatcgccgccgtcgacccgaagaccgccgccgtttcttcgtcgtcgccgtcaccgtccgttgatcttccgctgctcctttggtcaccggtgagttcgccgcgtcgcgctctacccgttggtgctctccgttcgtgccgaagcgccgccgttcgccggcgagcatgcaagcccgagccgccgagccgccgccgccggtggtgacgtcatcgctgacgtcatcgtcgccctcttccgtgagccggtcgtagaccgatcgatctcggccgtccgttttggatggatcgatcccggccgtccgttcgcgtgaaccgtcgcccgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgttttagttggttcaagtctctaattttttctaaaattgagatctacatgttaaaaatatccacatgtactgttcatgcttgtttatgtgctgttttggtgattttgctcttttttgcttagattccgtcgtttccggagagtccgttttcgcaggagaagagtttgaagagttccaaggccagtaaggcaagtcacacagatcccaaacaaccctttgagcatgttgatcccgtttaaagctactgtttctattcaaatattgcatttattttcgaatgtcattgggtggaattaacctattgtttgttatagcccttttgttcttgattactttattccttgatacctgtgttattataacttgactagttgagctttacatattggttcagctagatattagatgtgattgcttagccatgcttagaaacattagcacattattgggataacttatgactcactattatttaatgatggcttaatgatagttcacgatggccaatcgtgattggttaattaatgaatgtgccaactaaaacttgataattgtgggttgtgagcacatggttttgagagtcgtgctcatgacaattaaggaccggttcacgagtttcggttgtgaaacattaaccgtgccaaccacaagccagcgtgggcaacgactttatcttttgtatagcatggttcattgcggggcaccagactgagaagtggcggagataagcccacgggggtcgctggggagtccatgccttgtttttaagggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgcgcccgcggttatgggcaggtctaacaatgtctttcgtgattagtttcacacttctcaccataataaaagatgctataactggtaataatttgtttagctcctggtttggaatggtatattcctggtttggagatagaactgtgcagctgggatggttgttcagaatggttgggcctatacaacagggtatgttgtatagcgttggattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagtcttagtcaagctgcttgtggagtggagccgtccgcgccgtttattttattttccgctgcttagatctttattgattgagaggaactatctacctctgtaatgacattttattcgcctattaattggagtaataattgtactctattatcaatttgttattgtgtgcctcggctgattcctggacgagggttcacacacatgtaagcgtttggaattttggatagaaattccgggcgtgacaccatcacgtattccacacatcaaacaatgccaaaagtgagaatgattgtttacaattctttcatctatttgacatgagggctagagggtggtcttggagcaagaaaagttgggcaggattatggtacgactgagactgagttgggcaggagcaagcgggttggattggcctgactcttcaataccaaagatactcggcttcctcttcatcaagtcacgaaattcgacccttagttagctgcaccaaaactagagcaggcccaagacaagcaagaacagtcagtcagcaccgatcaggcaggaagcagacagtaagctaagaatactggaagaaggtggtcgctcagccaaagccctagttcaaccagaacagtggggaaagcggtagaggctgctccgtagctttggtcgtcgcactctaatccgctttagaagaagcagctattctattggactgcttggctataaagcctataagtaagaactctggggaaggaatccgcagatgaagcagaagcaggcaaaaggcgagcgcacagcgaggaattttccatactagatcgactcaacattaccaaatctactctgagactctcttctcttcatggttggctgtcaaaaaagagtctctttagtccccaactctatggattttactttttggctcaacaccctgctcttgacgtttgctcgggacgggaggctatgaaatagttgaaagcagatgcaacattaaagaaagtaaatccagtagccttaagtcgtaccgaacactatgtcctaatagtaagggatttctttcaacccggtggtaccaggagaaaacgttgcccgaaggaagggactaaacccatctgttcaagtagtagccaagtagtaccgaaggagtatctccgagttaaggagtaccgaagggaaggcagaaaaaccaagtgaaagaaagagatcgcaatggtctaagatatagtcagtgaacaataactcagatctgatgtcggatcgaaacataaatgcaaaaagacaacataaatgtaaaagatcgaactctaatttagttactgagtgagatgttttgctacctacaaaaggttggttctgttgatatccttgaggagcatgtgtcattatctgcaccggcaaatgatgacagtgatgaggtagaagatgtgtatggtgagtcgatactaaagcaatcccggaatttttcattggatggcagtaaagagtctccttcgttacctacgtggtacgatgaatctcgccttatgctaccaaggtggtagttttcatttagttggatacagcgatgccgagggatctgctgataaagatggacgaaaaaaggcaagggtatatgtttatccttgaaggaggctcaatatcttggtgcagtaagaaagaagattgtttctctttgtctaccatgaaatcagaatatatagcatgcacggctgcagttcaagaagcaatatggctgagaaattatcttctctgtcttgatgtgactaagcatgcatatgagacaaccgtgatctactgtgataacacggctgccattcttttcttctcgacaaatatcataccatgggctgtacaaagaactgaccatgatctcttgctaggggaaggtatgtatcgggacaagatggttggtgaggtgggcgcaaacacttttcattccaatccctatcgttgtggttggaccagactacatgccaagaccctttattccaacattttctcgctgacagctccttcaacttatttttctattcaattgttgctttcacaatcaatcactaaccacattcttgcaattcatgtgcggttggcatctattttagctttttaaagagttgactcgtcgggcatgcttggccttcttgtcgccttcctttgttcctcttctttctgcgcagatacttttgatccactcctttcctataccgcgccctctgcctattacggtcgatacccagaaagtagtttccttgggagaagaggcagttcacaaaccagtactaaataaggaaaaatgtgctaatctcatcgagaaagaagaatttttctaaatcacttcgggtgagcggggccttcaagcatccgaaatatgccggggttgtaaatgacatagccttcctgatagaaaatgacggcccgacgagtcatctactaaaaaggaccctccccgctgtgcgcccctccttgaattattcggtcatgcaatacttttttaatacaaagaacaaaatgcatttcgaccccgtcgtagttctcaatcatttcgtggcaccgggtgtggctgaaccatctacgatggggggagcgaagggaggaagcttagataagagaatacgctctcgcaacagattcaatagaagaactcacagccaaaacaagcgaaagaggaagggcggaacatggattgcctttttttcctaactatcagaaggtcgttgctgtctttttcgcattggatttctttcacgagactcggaaatcaagaggatgggaacgactactgctcaaacgcatcggactgaaaaggagggagactctcaaccagagccgttatcacatattccacacatcaaacaatgccaaaattttacctcaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgactctgtctctaaatggggcgtgctccatttgatatccaactctagtccggacatcatagggattccgcctctcatcggagtcgcggtccttctctatgtcggcttccgtccaagtagggcggaggaatagtctatatgtcctatacagccaactaagctactctgagaaaagatgattttggtgtattgtcttgatgtacctgtcgttccttccggctgtcctccattcatcaatgtatctgttatgctctagcccccagtctttcaccttctttgttctcaccctgtcatacctagacaagtggaaggtgatgaaacaatagtgagcatcgacaagggttaaatggtacaaagttgaacattaacaatgaaagcaaacaaagataacaaatatttacttgtgtaattcaactccagttgagatgtcctcaaccagacagtcttgtttcttcccgaactgtcgcatgacacggtgcggaaagtggtactcaactgctcagaaacaaatcaatgggcactggtacatgaagtagtcagagtctcgattgcacatcgagttcagggtcaggcttgaagcctcatttgtgtggtatggtaaccactcaatctgcaaaagttgaagagatgacgttggttagtatctcaattaaagaagtaaatgtcgaagtacaagtgatattggaagtacttacatgttgaggctgtaagcagtccatctcattgacataatgcttgtatgccacatcccggtgagcatgtgcagtggcagtactctcaaacaggtaggccactgtcttctccatgtctggctcattgtagggccaaggagtgaaggttttgcctccacttaggccttccaaccggtagtgttaaccacatccacaactgaatcgatagcacacaaccactcatgttggatgatggtgcctgacgacaacaggcctcacagagctgtctatatgtccacgccaacactgctgagccccaactgaaatggcccagatcaccaaggttggcgaccaaaggaatccatatcaccgaagcaatgtcacccccagcatcaggaaacagaaccacactcaacaagtgcaagatgtatgcacgagcataacactcaacacgccatggctcagcgtcgtcgtcaagatgtgagaagttctgactcagctaagacaggggtattccattctgcttcttcttgcccccttgcccctacttaatgttgagtggaatgccaaacaggtgctccacttgtgcacgccatccaggattctctgtcctgcccgtcaccgcatgcccccgtaatgggagggccaagatcatagccacatcctatagagtgatggtcatctcaccactgggggggtggaagctgtgtgtctcaggcctccatctgtccacaagtgctgtcaatgcaggagcgttgaacactggcattcctctgctcatgaccaaggccaccccgagcaacccgaccgcccttaggtacgggatgtaccttttgtcaaacactgggggggcatgagttctaactcggagcggttgaagtatctgcattagcaattgtaaatcaattagttaatataatgtcaaacacacgctaccgatacttaggtacaagtgaatcaatgccgattcataccctccccgcctcgatcgcagccccgcgatgacgggcctcatagtactcctccaaggctgggtaagtcggcggttgtccctccttggccatcctacatgaaaaagtaataaattcaccgttagttatcaacatgacataacttaaaaggaaatgaatgcgagaatccaaaataaataaatagacattaaatagacaagaataaaacatgcattgacttaagtaggaaaacaaaatatttacctccctaacacttctattttatttttggacttcttcttttttggacgcttaggacaattaggtttcttgtgaccctcctggttacacaacgagcatctattttgcaccggcgcagcatctagttgaacacatgaaggtggtttccttctagaaccaccaagacccgagtccatttcgttcttgaatcgcttcgatctcctcttccctcttgttttaatcttcaaatttgggtcagcaacaaattcttcaccatcgtatggtggcaactatgtggggttgaggtatggctcaaagcgacttgcctatgtgttcacaacggctcttgaagagaactgatacggcattcggttgggagattcctcatcaattgcatgaatcagataaacgtggatgagatgtgagcaagcatatggtagagcaatggcctttggtaagaacatgagttcccctcaccttcatctttgaaggctcttgcaccgaatctaacaccaccacgcgttataccacccctctctgtgacctcgtatgtctttttctacttatcgaaacaccttgaagtgtgtttgttagccttacttttttgcaccttcatcttactagcaaccttggtggaccaacgctcccataactggactcgcttcattgcttcatcatgtctgttcacaaagtaatcattgaacttcatgaaggtaaatgatactatggccgtcactggatgcttactaacaccaactagcacgctattgaactgtttggccatgttggttgtcaagtaaccccaccggcggccatttctatcaagccatttacgaggaccttcgggaatacgctgccttagtgcctcaacatccctctcaaatatccacttctcgtcaatctgacatatccttaggagctcttttgtctgatgcttatctgcaccggccttgtggaaattagcactgaagtgcctcatgcaccatcggtggtgaaccggtggcaatcctggaacaggagtcctcatggcattcattataccagtatgtcgatctgagataatacaaacctccctgtgctgcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtattttccagttaggaaggttgcatttatagctagtactggcctgcaatgcttaaaagcctcaatggaaggaccaacgcaccagaatgcacgcataaaaattttcttggtcactccatcaacgttgacaaccctatcaggatgagtatcgatgtggtagaccatactgggatttctctgcttaatggcttgtagcaaagtgggcaaacggacgtacgcttcaccccattcaccgtaaatgagcttcatagcctcctctcgtgccctccaagccttgccatacttcgcccatcataaaacgggggatcc

SEQ ID NO: 41617 - DNA, 8287 bp, Oryza sativa
agtagcacagctatgtgccttaccaacccgtgatatcctccacgtgccactagacctcttagttgcatggaccttccatttgcaccatggtttttcacatttaacagtgtacttcctatttgcggcagaattgacaacacggtatggacgatggtgcacgatggcgtactcctggagccatagcttcaatgtgaccatggatgggaactctaaactctttatgagaccatccacctggaatggttctggcaactgatctaggttgatgccgccatctagtattgcaccatgggcatgtgttaggtccctaaactcaggaatatccggcttcctctcaaacaccttctcaaatgcacgccattcctctaatgctaacttgtcattgttagttagtggagggaatggacggtcattgtcacatcctgattttcgtttcaggatttataaattatttaataaattattattagaatttatattaaatgttcattaatttataagtgaagttaaatgtgggaaataaaatttcctaaatataaagcatggatggatttaatttttattaaattctccatggttaattatactctctgaaattttctcggatttttcggagctcaattcctaatacaaagagcatttcagaaattattcacatattaaattaatcattaaatggtctgcttataatttttttaaatacttatagtgttcaagtattttcaagatttttcttgaaattattcgagcattgaaagtatttttaacaattcaaagatcatttcagtgattaatttaattggaaaagtaataataatcctcttcctaatcttgggccctttccagcccatctccctcttttgtgtgcacggctgtgcagcccaagtcggcccagccgagttcccccttctctttctttctttcctttatttttcagccagcccaagacgaaagtctaatttgcctccccgtatactgttcatcttcaagcttggacagaagcccgagctgccgtcctgtgctctagccgacgccgcttcctccaccaaatccgccgcatcccgtgctccgtttgcaaaattagttgaggggaaatattcctcttatcctcctctaccctttcttccaagaatcggactttatcccgaagaaatcaacgcggaatcgaattcgttttcgagcttatctctccaactaaccctcggtttttccgactcaaatcctctcggttggagtccgatctcttcaatccaagcctataaatagcatccccttgacgtcctcttccgtttgccccaagtcccaagccgagccgtcgcccgtagagccgccgccgccgtcgccggcgatcctccggccgcgttgcgctgccacggtagccgtcgccgctgccgtccgtcgccgccgttgggtgcgcacggaggagaggaaccccgtccgccccttcgcagccgccgaagaccgccggagcgccgtcgccattgttgacccaagtcgagccgccgttgaacctcgtcgccggccgtcgttcgtcgtcgtccgtcgttgttctttgcaccggtgagttcgcgtcgtcgtcctcttcgcgttggtgtcctcggttagcccaaccgagctctctagcgccggtggtcgcgtggagcagtgccatggccggcgatgacgtcagcgatgacgtcataattcccttttcttagtttctttattagatgaaaatcgattaaacttcggaaattcataactaattcatcgtaactctgattcgagtggttcaagttgctaaatttttctaaaatcaagatctacatgttaaaaatatccacatgtactgtttttgcttgtttttgtactgttttgttgattttgttctttcgttttagtttccgacgttccggaggagagcgttttcgttgaggaaggttcataagtgtttgcggaagatcaaggcaagtcacacagatcccaaataaccctttgagcatgttgaacctgtttaaagctaatgttttatttcaacttatgcattattttcgaatgtcatcgggtggtgagcctttcccgattaattaatggccgaagatgactttattttcctatgggttataatttgattagcttggaccttatatattggtttggttcagctaaatgctatatatatatatatatataattgcttagccatgcttagaaacattagcatcattaatggggtgaattatactatattattaattatggttatatttaatggtagctcacgatggttaatcgtgtaatgttaattaattgagaattaaaacttgtcaatggtgggttgtgagcacatggttgtgaaggtcgtgctcatggcaattaaggaccggttcgcgagctactattgtgaaacatttaccgtgccaacaagccagcgtgggcaacggctttaccttttgtatagcatgattcattacggggtgccagactgagaagcgacgagaagtccgtgggggtcgctggggagtctatgcgtctggtttttgagggggtgattatgatccaggaatggtgcactgtggtgagttgtgttgtgcagggggtattgtcacagcctctattcgggtactttccagtatcgcgacgcatggtagacatgatgttgaggctgtgtcttgtgggtacagtggtacacctctggtcagagtaaaactattcgaatagccgtgcccgtggttatggacgagttgagcaatgtttttcgtgattagtctcacacctctcacaataattattgatgctataactggtaataatttgtgtagttcctggtttggagttaggtctgtacagccgggtatggttgttcaagatggttgggcctgtgcagcatgagtgtgctgttcagtgttaattaaaatttctgattaattactctactgttttacttctcttaaatctttgctaaatgctgcttttgcaaatgagcctatattatgccatccgttggtatccttgtgcacttgcatatttgctgtgtggcttgttgagtatgtcgtatgctcattcttgcaataatcaatcaatctcagttgaagaaaaaggatccagaaggagaagacgtttggcttataccccagttgagctgcctgtgggagtggagctgaagccatcgctagaccgttatttccgctgctgttgtttttcttttcttttgtaagtatgtaacgttattattatgatggatttgtatattaaattgtcagtttgtgtacctcggctgattcctggacgagggttttatgcacaaattagttcggaaattattagtgaatttccgggcgtgacagtcatcatcagagtcttcagcaaattcaacatcatattgctcaacacttgcctccttgtcaacctcctctctattgacttctactgagacagaatcgtgaccaccactcaattcgacaacaaagtaatcatctggattcacatattggcctgctacttccgtcgggtattcagggttgcctccgtacgacaaccaatgcacactctccgacaaatgttcacttagatcaagcccctcttgtactaactcccttttcatctccctcactgcatgcacatcatcactaccgcaatgtctctttgatggtcctgcctcccctaaatcatttccaagcaaaggtctcttcttctctccttccccctccaagtcttctcgtaccaactcagtcttacttgcatcccctccatgacgagaagaatatgtcacaaaattcttctcaacgtaatgataaggagatttgtttagatccaaattttctacggtacttaccaactttgatgcaaacaccactagagatctaaactgaagactcttttaccaaatcaaagtaaacttcccattccaactgacctatcacatttaatatatacttatgcccttgaccaacattgtatctcccataaaaacgaatctccacattatcctcggtccatccaagaacttctttcactcgtgaccttagttcatctagagctgggtgggtgggaaacaaaatggtcttaatgacatatcctcaaactcaatatgtgcaccaacataagattccaccactctaccactgtagtaaacacgaacaagtctatccatctacaccaaaaaatcaaatgtaactttgcaacaaaaattaaatcttcattcctaaacgtagtccaaaccgacatattataaccaatccataacttaaattgtcccaaagctactactctaaaaaaaatatttaatccacctacaactataaacaagtttactagtgcattacacatcgaaatattataaatactccgtcatacaacccaacctagttctaattaactataatcaatttctataatgcaaccaaaattttctccccttcatataattaatggttaaaagtttaacctataggctatagcatcaagtccatcaaattaaaattactttcatgcctcaaccctaatttttcatccatccatccaaccaaaccatccaaaaattaacattaccacatatatggttaaaaaaatcgtgacaccaatgagtacattgcaaatatgtagcactacaacaagccaatctcaagaacaaatgctaaaaatcacaaatttgggcaaaaggggggttctagggttaccctccgatcaacaaattcaccaataaaaaacgaaaaaaaagagggaggaatggaggagtctacctttctcttcgatttccacaaaaaatcccgcgaaaaacggcttcaaattgagtgagatttgaggtgaagacgtgagggggagagagaggaagagctgctgcgctgactgctcgggatgcagcttgggataaaaatagagagtgaggagaagaaagatagtaagacccacagggacccagggcgcggccaacagagaagaagcgcgccagccaagctggcgccatggtatgaagggcggcgccggtgtggctggcgccccccttctgcccagtcagcaccgccacgacagcccaagtgccacggtggcacgggcacggcgccagtgtggctggcgccgccatgttggaggacggtgccagcctctctggtgcccaaaaaggaccattcccggtttaagttttcccaggagtttatttgtaaaataagttttcaaaaaggaccaaaatataaaaatttcagattatcatgatcttttttttttccagaactatttgtatgctttatccaaggttccaacttctgaagtttttttgtcatgccgatagacacacctaggtgaacatgtagcattatgaggtcaaatgaccgatgctaaactaagtaggagtaagacaacagttaatttatgtgctgacagtagtaattattttgttttttatttaatttgttgattttttttcttttcccaactgtatataaatttaggatacacggaacgaagaacttggcacataaagggacgataggcacctatggtggaggtggaacaagctaaacaatagggaatgaggaaccgcggtcatgaggaaaaccagggacaagaagcaaatgctagaacatgagaagaaaagagattttggagaagatcatctacatttgtacaacaacccactccaagaaaggtctagaaagaaggtattaaacctgtcatttttttctttttttataagcaaaatggtgttgcaaaacaatgtgatcatgtagaaagtaacttatagaagcatttgcgaagcaacttttatatgactaacaagtaaggtttaggaagctacttttacatgctaaagaagtaacttttagagataaaggaagtaacttttaggtgttttaagaagaaaattatgcatgattcaacagttacattctcttgacttactcatccgatctacgatccgattacaccgttgcgttcgtaacaattaaatctttataaaaagatctcacatgattatattttgatgaaaaaatacaaattacttttagattatatctaaattacttttagatttcattaaattacatcttagacataaaaaagtaaattcaataaaacctaaaagtaattacatatattatagaagtaacttaaaacaaagagaaagtaacttgtcacgacattagaagtaaatccatcgtgtagtacccagacttacggttttacccccacaatagatttacttttaatgtcgtagcaagttactttacttttgttttaagttacttctataatatatgtaaattactttcagactttattgaatttacttttataactaagaagtaatttaatgaaatctaaaagtaatttgtatttttcatataaaagtaattacatttgtacagtttcatctccacttatatatcatcttctctggttttctttttcatatactggcagcaagggaatattagtaatctaaaagtaattacatttgtacagtttcatctccacttatatatcatcttctctggttttctttttcatataccggcagcagagaatattagtgtcttttatttttttcgtatattgatagctgaaatattcaaggtgctcgattcgacgagggatgagatcaatgaatttctagtatcgagaagtaatctggtagttgcatccatcaagattatatggaaagagattatgtgggaagtctttgagaatcagtatcatccagtgccctattatctttactaatggatcaaagcaaccaaacatatacacgacagacacttgctgctacatattttttaaaaaacaaattatgtggaattaactttctggaactaagtttaatgtttttggggaagtgactttcatgttgaaggaagtaactttcttgcttgtagaaagtaacttttacttctagagaatgtgtatgcagctgatgcaactttttgttaaagagtccatcaaaatgcataccacatcagtatgctactagatatatattttatgtttttgtcaacctaagaaataaactgcatagaagtacgcaaaatctaaatcgagaggcatctcgttttagtgctaacgagcgacgccagatgttgtccgaatatgtgttaatctatagtacttgtctatcaagtaagtataaaatatattcctaccacctatgcttcaaataaaattttctcttaacttactcatccgatctacaatccgattacaccattgcgttcataataatcaaatctttataaaaagatctcacatgattatattttgatgaaaaaatacaaactacttttagattatatctaaattacttttatattatatctaaattactattagatttcattaaattgcatcttagacattgtaagttcaagtgccttaatttggttttggtgattaatgacaaatctaactatatgagactaataatttttatgagcctttctttgactagtctcatttggatatgaaagtaaaaatgatgagaggtatgtattaaacttcacatattctaatttggtctctcttgtggatccaaaatatagtgtgagcttcctcattgatctttattgattatgtgcatatgcgttccttcatatccatatgtatgcacatcttgaggggggagcttattctatattttgttttttataagatctctaccttgatttgaaattatctttcatctcatctctctatattgtttatatcgggttattatctatcacaaaagagagaaaagattgaaagatcttggattaaacaatttgtgtaattgttgctttggtgatagatgataaaccgatatttatgggattaacctctcttttacataagttgtcaactaggtcatttcccgataatgagatgtggtagatggaccttaatcatgacaaggataaaatgcaatggagataaagcaatatgtaccacttcttatctcctactttttgataggttcatatttatgatttccatgttattgttatataagtgtgagactaatgtttacttgagccttatcttatttagtcttctttacattgagaacatggagatcatgaatgtatgtgtttttgtttgtctttatcattgctacgtgccttctccatgtgtataggataaacccccattggttctttatttatgcatacacttgcctctcttgtatatttctttgtatgcatatatttagggggagcaaatcctatacatttattatgcatgttctagatccatgttgttcacctattatttgtattagatctttacacttgagcttgcatacgagtatatgatgcttgtggtgttaatgaatact

SEQ ID NO: 41618 - DNA, 12878 bp, Oryza sativa
atgtgcaaagaaataggtctaattgtgatgaggcaaatggatgataccattagttgatggtcaccaaaccaaagacatcgccatgttgacaagaatgaaagcttgtgatgagaagaaagtcttgaaaaaggatggacaagacctcggcataaacatagttcaaccggatggtcacaagtgttgatcttggctcaagcattgacctcaagttggatggcgcaaggcaaaggtataatggaggtaagaatgttttcttagacttttcccggtcttggtgtttggtgtagaccggatttgctggatagccgccgtactatcaagaggggtctatgaagcgagcatgtggatgatcttgtgccatattagttcatatgtatgtaggtgtattttgtggccttgtctagccaagtgtggtgagttttctcaagtcctaaacaaaaagagaagtgggcaaatcctataggtttgggtagcctcatgtggttatgtccggtggagtatctttcggagtgtgaaccctttctccctgagaaaagttgtgtttcttggatggattgttcatggattggatagccctttgaataagctttccatagagtccaagaacgccaaatttcgagacccgagtcaagagatatcgccgttttactaacggtcggttgagctgaaaagtgacctgcggtctgaccgcctccattatggcggtctgaccaaagtatgttgtccggtctgaccgcctctcccatggcggtctgaccgctcatcctgattttgaaggaggtctcgtcttggcgatccagagccgccagagccgcagccggtcagaccgagcccatggcggtctgaccgagccgtggacggtctgaccggccgctacactgcggtcagaccgagccgttacaaagtaatccggtctgaccggccacactatggcggtctgaccggtagagcacaaagttggggattttgactccaacggctagtttggtggttgggtgtatatatacccactccccagcagcaagggtaaggttttagcactccattgcattatcttgaacccttgcaagagctctcacacccttgtgcacttagtttatctagtgaggtgttggagagtgagttaagccaatccaagtgcattgcttcattgttagagctagtgtggtacttgatcatcctcggcaagcatcctagacttgttactcttggaggttgccgcctcctagacagcttgtggaggtgttgcccggtgacctctccgaggagattgtggaggaggcccggcgccggttgtaagtggtttggagttcaccaccttcggagtgaaggaacaactaccctagtgatcgaggcttgggtagtcctctccgtgggccggctcctaccttgcccaccccttgacgaagggggcgtgcggtggcttcgtggttgagcggtggagttgggctcgcctcaacggggattaggaaaccggcaagtttccgaacctcggtgaaaaattccttgtctcttcatttatttgttgcatttacatttgagcaagtttacatactagagcttatttgtgctattatcaccctaggcttgcaaaccttaacataggctagcttctttgtgcacttacttgagactagttgatttaggttttgaattgtgcaaaaccgttttgatttacgcttccgcatacaaaacttggttttagccaaaagttttaaaaccgcctattcacccccctctagtcggcctccttgatcctacagacatataaaagtaaattcaatagaacctaaaagtaatttacatacttgtcacgatattataagtaaatccgttgtgtgtgtaactatgatatgtagattaaatctaattactagatagacttatgtttttacccccataatagatttacttttattatcgtaacaagttactttacttttgttttaagttacttctataatacatgtaaattactttcatgctttattgaatttacttttataactaagaagtaatttaatgaaatctaaaagtaatttttatttttttcataaaagatataatcatgtgagatcttgttataaaaatttaattgtttcgaatccaatggtgtaatcggatcgtaaatcggatgattaatttaagagaaaattatataagaagtaactttaaaattcacaccatcaaaataataagtgtctttaattttttgttaaggcaaatgtatttcatatttacataggaagtaactttaactcttcctggaagtaaattttagatgacatataagtaacttttgagacaaatgcatcttggatgtaacttttcttggcacaactgatgttttttttcctctctttttactcttttggtgtattattagaaaataatgagatgaagctcggtaaatacaactgcaagaaataactttttatgatccagacgtaacattttgatacacgcatctcagatgcaagttaacggtactgatattttttttctctttttattcttttgatacagcatcaggaagaagaagatgaaacatgttgaaagtaaaaatgattttattgggtccttggaaataactttatgtgaattgtgattgaatctgctctttttttatatgaaacatcaattcagatatgtgatctttgtgggagatgtaaatttacatgatatctttggtggtttgatgcttgatcctctccagatttgtttttctcactctttctccgttggatcttgttcctccttttatcatccctcttgttcctcgtctttttgtcatgaactttttctgtgttacgttcatggcattacggtagctacgacaatcctaccagttatggccttcgtgggctacaccttggcccaggaacgatcctgccagttgtggccttcgtgggctacatcttggcccacgaagaaacacgcacgaggggcaggcacgagggagagcacgggttgtaatatttcctttcagtaaaatacatggccggtccttaaacttgcgcgcgggtttcacttaggtccataatcttgcaaattgcacagtcaaagccaccaacttgttttaatgattcagggcaggtccaaaccccacttgaccggctctgaccgccaacgtggcacgccacgcaagcaccaattttgcaaacaagcccgtccgcaaacagtagcgccggaataattgcagttaaccccttgtagctacagtagaggcgcgtacagcaccctaaattcccaaatccatcccctctctcccattattccccaatcctcaggtctggagggaggggaagcgacgagtggctcactccggggatcatcggcgtttgctgcgattcgggcggcgcatccatctgcaggagtggcggcgggcgataggctgcgtgggccggccccctcgtcggcgtcggcatcggcgttggtgcagtggtgacgatggacctcagcctgaggggggaagctgaggcggcggcggtgtatcgtaagtaccccgccctttcttgtgatttagcatccgtttggatggtttgtggttgtgaagtatcgttttttctatgcaatgcgagatgatgatgttggagcagttaggattaaacctagggttttagtttgttgttgatggggttggttttttttgccattggtaggctctaattcgaagcagttcacaattgaggttcatcatgggggatttttctatggtatgggagtgaatcgcagttatgtggatggcaaagttagctggttcgattatgtcgattctcgagagtggggtagttctctgcagttggcagatttggttgctatgttgggttatgatgcagggccaaggctgaaagtatattggttgctgcctgggaagaacttggttgatggtttgagaattgtggacagcgaagtagagattaatgtaatgaattcagtgtgcataaagtcaagaactttgttatctatttagaccatactgaccatgtttcaggcagaaatcaagaagatatcgtagtgagcccagtctctgagttgcctatagtaatgagccctgttagaggttgtcagcagaagggagatgggaaccaggggggtagtaatgtaggagtacaagcatgtggggttgtagatgaagtagctgatgaaattgaagatgatgttgaatatgacagtgatggtagtgaagttgatgattcagactttgtggacagtgactatgagttccaagatgatgatgatgatttatttgaggataatgtggatggtgatgtggtggaccagggcccagctcctaagaagttcaatcagaagaaggttgcaggtggcaagctgaagggaaagagagtaattagagaggaaggttcagatgaggagtcaagtgatgaagagtgcttggaactgccagagaatccagatgagatcaatttgaggttcaagtcctttaacccagaagatatgaataaccctgtctttaaagttgggatggtgttcccttctgttgagctgcttagaaaaacaatcactgagtacagcttgaagaatagggtagacatcaagatgccaagaaatgatagaacaaggatcaaggctcattgtgcagaagggtgcccttggaacatgtatgcatctctagatagcagagtgcatggttttattgtgaagacctatgtgcctcaacacaagtgcagaaaagagtgggttcttcagaggtgcactgccaattggcttgcattgaaatacattgagtcatttagggctgattctaggatgacactacctagctttgccaagactgttcagaaagagtggaatttgacaccctcaaggagcaaactagctagggctaggaggttggcactgaaggagatatatggagatgaggttgcacaatacaacatgctgtgggactatgggaatgaactgaggagatctaacccaggcagctcattctatctgaaactggatgatggcaagtttagttgtctctatttctctttagatgcttgcaagaggggttttctaagtggctgcaggcctatcatttgcttggatgggtgccatatcaagacaaaatttggtgggcaattgttgacagcagttggcattgaccctaatgattgtatatttccaatagcaatggctgttgtggaggtagaatcatttagcacatggtcctggttcttgcaaactttgaaggatgatgttggcattgtcaatacttatccttggaccatcatgactgacaaacagaaggtaatattacttgtaatcatttaatgtctgttgtacatcatatgtaatcatgtaattactgattataatcatttaaatcatgtctgttaccttcttgtagggtttgataccagctgttcagcaactattcccagattctgagcacaggttctgtgtgaggcatttgtaccagaattttcagcaatcatttaaaggtgagattcttaaaaatcaactttgggcatgtgctaggtctagttcagtccaagagtggaatactaaatttgaggagatgaaggctttaaatgaagatgcatataactggttagagcaaatggcaccaaatacctgggttagagcatttttcagtgatttccctaaatgtgacatcttactgaacaatagctgtgaggtcttcaacaaatatattttagaagctagagagatgccaatactgaccatgctagagaagataaagggccagttgatgacaaggttcttcaacaaacaaaaagaagcacaaaaatggcagggcccaatctgtcccaagattaggaagaaattgctaaagattgttgagcaggctaacatttgctatgtgttgcctgctggaaagggtgttttccaagtagaagagagagggaccaaatacattgtagatgttgtgaccaagcactgtgattgtaggagatgggacctaactggcatcccttgttgccatgcaatagcatgcattagagaagaccatctgtctgaagaagattttcttccacactgctactctatcaatgcattcaaggcagtgtatgcagagaatatcattccttgcaatgataaagccaattgggagaaaatgaatggaccccaaatattgccacctgtgtatgagaagaaggttggccggccaaagaaaagcagaagaaagcaaccacaggaagtgcaaggtagaaatggtcccaagcttaccaaacatggagtaactattcactgcagctattgtcatgaagctaaccacaacaaaaaagggtgtgagctaaggaagaaaggaataaggcctaagaacaagataagaagaaatgtagttgaagccacataacagccttcagtcatgcctcaggttattaaaactctacatttcagattatgttgtgttaatcccttgaactaaccaatgttgtgttacaggaattaatgggaccacaagcaggtggctcatcactattagctgaggtgaatgacaatatgttggatcatatgctgcaggaggtaattttcttgttaaggtttagatcactttattcagatgtaaacacatgtggcatttgtaccataactgtcctcctttataaacctgtttaacattcagtttgctactttgctctgatttttaattcatgtaggcatcacagcccagtcaactaactcaggaacatggtccactacctgactgtgctttcattcaagaaaaccagccaacagctagaccagtggtattaaccacttcaacaaaagagggaagatcaaagatgaccaagcctaagaagaatgcagctggcacttcaaagaaaaagaaggcaacagatggcttgagtgatggtgctgctgcaaagaagaagaagaaggcttgaaggaatatagtactgctgctgcaatgatccatgcttgttcatagatcataggaatacttttgcttgccaactcatgttcatgacaagaaatagtgcatgtggatgtggatgtggatgtatattttggacatcaatgttgctgccatgtaaatgtgtctgtagtgccatgacagcaaacattctggatgtggatgtgttatggtgatgtgcttttggataaaacattaaactgtcatgcaatgaagtggctagttctcagatcaattgtgcttttcatttatgacatatatgtgtactgatgcaatgttgctgtcaatttcaatctgcaactgtcattttaatcctgcaagaagcaatttcttctctgaacctgtatttgtaaatcctgaaactgtcatttcaaacctgcctttttaaagcctgtcattccacacaaattccaacacatttttcaaactgaaaatgctgtaaatttcagtgcaaatggcaacattcataattattccagcccaaccaaaatacattcatttccaaaagttggcacaaccaaaatacattcagcattcttcattctccattcaattccaccttcatttcatcaagacaacaaccagaacacagactaaaataagaactccaaataaccctacaactaacatgcacttcactgccaacagtatttctctaacaatgggcactatagctatcaatttcttctcaatttcatcttgtctcccaaaagcatcttgattcagatccaaatgctgagcagtcttcccatatgtgccatcttctccagcaatgaagccattcctcttcagataattgatgtaaccttcttcccaataccaaaagttacacccagttccatctttctacagaaataacaagcaaactcaaatcaacactaatcagcgaggttgccagctaacaaattccaaccaaaccaaccaaactaaaactcacctcatggtcaggacaagtgtaaaaaatccggccttcattagcatctgtcttcgctgtgcatctcacgatggtcttcacattgcatgaggggcacacgatcaaaggtacaactaacctattccggcgggtgcttaacgacgatgagcttgcagacgccatggctgcaacctcgccgcctccgaccgccgcacaccgccccctgtcgccgccgcacgccgccctccgtcgccgccgcacacctatccctcctcgcctcaacagcctggctagccgctaaccctagaatgggatggttgcgaaggatttggggatttttgtgtccgccatggtgctactgtttgcggaggggcttctttgcaaaattggtgcttgcgtggcgtgccacgttggcggtcagagccggtcaagtggggtttggacctgccctgaatcattaaaacaagttggtggctttgactgtgcaatttgcaagattatggacctaagtgaaacccgcgcgcaagtttaaggaccggccatgtattttactcatatttcctttttcggaatatcgcgcgttcggcggggaaaacacttttggaaaatctacgtcgcgcattagcgctattacgctaccatgcgcggtgtagtcgcgtccttttgattattccaacttaccctgaaaatttcgagttttaaaatccggaaacaaaagttggaataatcaaaaacctttttcaaacttttcccatgctggtctttattagattttattttccttccctgttgtgctagtgccttaattaaattaatttgaaggattatttgcaaattctaaattcaattattaatttagaataatatttattaaagaaccatgattataaaataaaattaattaaggaattattctcgaatgaaagtaaatactatttatctttcttaaaaactcttttatgtattaatatcccttttgtgagttattttacgaatgaatttaagtgttaattagtttctaaaaatcccttctaaggtttgatcccttaattattttgtaagcaaataataattattttcctcaaacctctttttaggatttcttcctccaaggaaatgttttgcaaaaaaaagggatttaatatttttattttctaaaaacctccttgtgaagctaaggatctaattcaaaggcttttcttaaaagtccagattgcatgcctaggaagcctagctcgggccatttccaccctaacttgctctctggaaagtctaattttgatccctcaagttttcacatatccccttccttttcttcctcccagcctagcccacccggcagcccgcttgcccggcccggcctagcaagccaagtcgaccagagccgccaacacggcctagcaagaagtcccccttcttcctctgcgcgtcgagcgccgccgttcggccgtttttgcctaggccgcagagtccgggctgccctagtagaattttttttatttatacattttttattaaaatatttacaaaaataattttttttcgaaaatttacaaatctaatcgcttgccgccctttaggagggcgatttttaactcccaaagggcggaaagggacctaaatacaaaatttttatttgtgttcaaaccctttccatcggttttaattacttaaaaactaataatgcttattcgatactccaaatgattttaaatggaaaagtgataaactacaaagttatagatctcatcaagatctacaacttttatataaagtttatctccatccaatgtcgtttgaaatgtagatctgagattttttaaaatatgttttatattttgtaacgaatatttggatatctaaaacatcttaaatgaaaaagttgttaactacaaagttgtagatctccttgagctctacaattttgatataaagttttatttcatctgactttatataatataattttaaattataaaatcatagagctaacaagttgtgctggaaaatttgcatttaggtcccttgccgccctctggaagggcgatttttaagggcgggcgatttttaaaaatcgccctcccaaagggcggcaggcgattagatttgtaaattttcaaaacaaaaaattatttttgtaaatattttaataaaaaaatgtataaataaaataaattcgtcgtggacgagcccgccttcgtgcgctgccccttccgccacgccctgccaccgggaaccaccacgtacgccggcaccaaaccctagccgagccatctaaccctaacccttgccgcggagctcgtgtgcacacatggtgctcaacgcagcgccacatcgcaccatgcgccgagccacgctccagtgccgtgtgccgaactgcaccgcacctcccgcctcacatgcgtcggacaagcaacgcgccgagccgcctcccgaccgcgcgctgccctgtccaaccactcagccatgcgccacgcccggtcacaagccgcaccctccctgcgcgtcgcacgcactgccgcctcacaccaagggaacatcgccatgcactgcgtcgtgacaaaccgcggacgcaccctctctgcctccactcgcgatctttgccggacctgcggaccctacctcggcgacttgtgcccttggctctgtgccgtggcccccactcggtgacggctttctcgccgctcggccccacgccgccactgtccctcaaatcagccgccgccacgcgtgccatagcaacggaaatagcctcgccctccgccaatcgctttgaggtctatatatgtaatacttcgtgatgaatacactatcgcgttgagcgaatctctctaacgaggaggcatgcggatggtgagatcaatagacggggcaatcagctggcagcgcaatagtgaagaagaccggtcggcggggccttgcacggggtaatctggtggcggtgcgaggggtaccgaaccgcgacagatcaacgacggcctgttggatcacggcggctaggattgggaaactccatgacctgtggggcagcaacgtcgatgaggccaaattctcgatgggtggcgatggcgacagtggagcaacggtgggcgtcaatgattgtggggtaggcgtggatcgcagatgatttgggggagatctgcaaagagggcgacgtacaatcgcggacatagttactgatgaggagaagggggagccaaatgttctgagtcgttggatgtaacacaaatgaatacatgccggtggatttgatgaatgaagtatgacggatgtaggactgtgttgatgaactatagggtagaatagtgacatatttcaacgtatgtcttcattgtgtttcaaaaaattcatgcaactaactgcacatattctctgtcctctctctctactctatcaatgcaatgcatgcatgcatgcacttagtgattttcaaaatattttttctcctaaattacttgtccgatttatgattcgatcacaccgttatattcattgtaactaaatatattttacaacaagatattgcatgattatattttgatgagaaaaaaaacatatgtttcaatccgttccattgatgttttatacgtgatagcggatcacaaaattttaaatgtttcgttgactaaatgggttgttatagccgatactgatcaaccaacaatcaacaccataactgataaaacgtacgtagtacctgaaactgaaggagacatagaggtaatatagtgatcaaagacacttatttactgatagacctcatttgaatgcaagacaatggtaggcaggcaaccaccatcaattagtagagcgaacaactgcataagagcacatttttggctcctagcttggtgcttccagtatggaaaaaaaaagaaagctaatcacaaacaaataaaccgtcgaaactaaaactgtaatacccgtgtagaattggtagtggtttgccattacaaaatgttggagcagcctgaatcaactgagaaggaaagacgatgagcagtccatgcacggccaattttaacaataacattcaccataaaaatgctataagtatgtttgtttatgttgcaacgaaaaacaaaatggaccttgggccaaggctatggatctacctacagaggaagctgacaagccacaatcactagtaaatacgcattgacgatgctagacggttgtggcgttacgtcatggcgatcgactatgctacttgaaagttgtttttgatagcaacacggtttccaaaacataactttaacttcttatttctataaaaatatttattgaaaagtgatatgcataattttatgaaagtatttttcaagacaaatttattcatataatttttatatttttaaactcaacaactcgagagttattaatgatttatatttctaagatataacttaacattgttataaacgactttctttacgaatatgaagttagtatatataagtagtactagtatgttggctccccgaccccgagacggacgaccgcatggatgagatgcagatggagatggaggcgcaggcgcaggcgcatgtgctcctcttcccgtggccacagcaaggccacatcaaccccatgctccacctcgcctccgccctcctcgacgccggcctccacgtcaccttcctccacaccgaccacaacctccgccaccgcttcgctcgaccccatcacccaacccgtctccgtctgctgtccatccccgatggcctacccgacgaccacccccgcgccgtcggcggcctcatcgagctcctggactccatgcgcacggccagcagcgccgcgtaccgcgccctgctgcttaccgagtcctcccgctcccgccccgactccctcgacgacgctccgccaccggtgacctgcgtcgtcgtcgacggcgtcatgccgttcgccatcacggtggccgaggagatcggcgtcccggccctcgcgttccgtacggaaagcgcgttcgccttcctggcgtatctgtccgtgcccaggctcctcgagctcggcgagacccccgtcccttccgacgagcaggtgcgcggcgtcccagggatggaggggctc

SEQ ID NO: 41619 - DNA, 1783 bp, Oryza sativa
tgcaagggtcgccaccaataccattgcactagaaaaacacgaggacgacgacgaggacgacgacgactacggctgcaaggcgtggctggacggccaggacgaccggtctgtggtgtacgtaaacctagggagcctcacggtcctctccagcgagcagctggccgagttcctccacggcctcgtcgccgccggctacgccttcctgttcgtgctccagccagatatggtggccagctcgtcggcggtgctccaagaggcggtggaggcagccggtgagagggcgctggtggtggagtgggtgccccgtgacgtgcactacgtgctgcggcaccgcgcggtggggtgcttcctgatgcacggcggttggaactcgatgctggaggccgccgtggagggcgtgccggtggtgtgctggcccttcttcgccgaccagccggtggtcagccgcttcgtggccgccgtctggaagacggggctggacatgaaggacgtgtgcgacagggccgtcgtggagaggatggtgagggaggccatggagtcccccgagatcagggcgtcggcacaggccatggcacgccagcttaggctggacgtcgccgccggtggctcgtcgtcctccgagctgcagcgcctcgtcggcttcatcaacgagctcagcgccgtgcatgttcgatctagagacgccgacgagaattcatcgcccgcggtttcacttctcacttgatcagtgtcgaaatatgaattccgcaataataaaatggggtagcgcacgagacctaaaagtgaatggatgcggagacaaaggatttagacaggttcaggccctctcgatgagaggtaataccctactcctgttcggagatttgaatccgccgggtgaattatagatctgacgatctagttgtctcatgccccctaaagggtctcctgcccaccttatataggatgggggcaggattacaagatagaaaccttaaccaatacggtatcggtttcctaaatctactttagaatcttatcaaaccaggactttaggccgttccataatatatagggaaacgtaatacccaagtcatgatccgttacatatttcatagatataagttatcccttataaccagtcggataatcacgccatatgggtatggggtacccataatctccacaatcaatatcagccttgggctcatcttgtgggtggcatggtattctagtagtgcggtctctgaagctaatttggtcttttactgtgtgtgaagttcttcgtatgatcatttactgctttattatatgtgcggtaaactacaagtatactactccctccgtttcacaatgtaaatcattttagcattttccacattaatattgatattaattaatctagatagatataaaatcaatatgaacgtgaaaaatacatctatctagattcattaattaacatcaatataaatatgagaaatgctagaatgacttacattgtgaaacgggggaagtacaatgctataataagtagcaaggcatagcattgcatcacatttatgatgtagaggctgggatttttattctcttttttttaaaaaaaaatgtgtgtgaagatatgctcttctatcaattaaaccatttggattcttgctccctgccctcgcatgcacacatgtgtgttttttttttcagatttgctaaagtatattcaccgaactttcaaaatacagtaacagctaattaaaagcctaaattccaagctatttcctccgtttcacaatgtaaaaacttttagcat

SEQ ID NO: 41620 - DNA, 12144 bp, Oryza sativa
aaaaaccaaatatcgatttatggcttcaattcatctagctagtaatcatctcaattctgtatttagaattggtgatcatgtacgtgttaagctataagcaaattagatcttgagtaaataagttcaataatatatatggtcttttatttgggtgttatatagatcatctttatctttacctattataaaaattaaaggtatttttgccacaattttcatacgtcgctgcgtccgattcctatttacatcgcgcgacgccacatattcatggccgatttgccatgcctgtcctttccatgtcgaccactgcatatggattaaaccgtttcagtccaggggcaagaaacagccatgggcacgcatcggcagtggaaaagcaagcagagaccaatccatcggctcgcacggttcctgagaaggccaagaaaaattaatttgctgcctctgtcacttgtacagtggttaatttttagcgcacccaagcttgtgcaccaggaggttttcagattgtcgcttcgtgcaccttcgtaacagggaacagggaatcaattcatctgcactgctttggttctgtttggtaagttaggttcagtttttgctacgctcacatgccagtttactaggaggtttttatgcagatcaaaatacttcgtttttccacctagagtatcgcgtctcttctaggttcacacatgcttataccaacagattcactattattcctaatagtaagtttgaagtacggttttataatccaagtgactatttggcgcacaatgatttaggcacattatgaggttgtttggagattgaaaatttttatactacaagagaagattcatcttaagatgaagatgaagatcgttaaatatgtgatccgaatttgagcatacaatatattcgggttattagttggctaataggactttgtattacagtttcctaataggactttgagtatttgcatattaggactttgagtatttgcatattaggactcctagattttcctttatatatctcttttatgctgcgcgaaaaatgatgccacagctcaatatatctcttacatttatatctaactcctccatactaattattgccggtcgatgcacatgattttttttcataaggattttcacgtaaaattgatatctctatatccatcataacaagaaagacctatttgtctaactggctttataaatgcattcatacgtataggttgtgaatgcatgcaaaaatcatagcaaggctcctattttcatcgagcaaatgatggttagctccttcttgtcaaccttgagcttactttctagagtaggatatccaacggacttaagtaatatgtaagattaaaatttctttaacccgttgcaacatacgggtatttttctagtaaatttaaaaatacaacttcaaatcagtaaacttgttaaatgtatcaacataggtctaaaatttggcgtacgtgcaggtatggccacacggatactggcgttgtatcatcctaacccaacaccgtctacaccaagccatgattttaaaaaaatttactgctctatttttttttcgcttcttggttcacctctaatttggagaaaatatgtccatttgcacgaaattcaagtggatggccttaaatgccaacttgctcatttttagagaaaatgatgtgggagcgctctatatttttgcactcgttaccagactattatatccgtgatgctttggcgccttgcgataatagacttaacagacatattgaaggcatcaaaagtgaaaggcatccctatggcccatcactgggtttgtcaacagtgacgcgccgcaaatgcccatcacttttagggtgtcactactatgcttcagtttttaggtacgtaggtggtgcttgaatctcctgaagataaagatgaagataaagattaagtgtttcatggaaaacaagatggtaataacgtgcgattaattgagttttaattattacaaacttgaaaaatggattaatctgatattttagagcaactttcatatcgaaagttttcgcacgaaacgcaccgtttagcagttcgaaaagcgtgccacaagtatccaaaatttcatccaagagttgttgtagtgctataagttacattaatcctgtgcttcactcactcctagaaataagatttttgcaggcggcccaaaaccattttcacaggcgggggagaggaccgccactaccatctcgcctgtgaaaacagaccattttcgcaggtggacctgtggcccgcctgcgaaaatcatctcagaaaaataaaaaaaaccacgggacgccgccgccggcctcaccacggccgccgccggctagggctcccctccgtccgctgccgtcggcgccgtcttcgtcgttgtcgtcgcgttgacgaggagagccggcggcgcgcggatctagagccgtcgtcgtcgctcgtcgtggccggcggcgtgcgcacgtgggagaggagggagccggtggcgtcacggtcgtcattgtcgtcgtggccggcgtcggagggagccggcggcgcgcggatctggagcggagggagccgtcggcagcgaggagggagccggcggcgtcgcggtcgtcgtcgtcgtcgaggagggagcccgccgatggcgaggagggaggcttcggcgcgcggacgtcgtcgtggagggagctggcggcgggcggacgtgggaaaggagggagctagccggctatttttctaagtgtgtgtcaaagagagagagataggagggggagggaaatgaatggtagagaggagaggataaggatggtggagaggataaggatgactgattttttttggtaggtactatttttgcaggcggaccacgtaaggtgcgtctgcgaaaatctattttcgcaagcgtcgcttaagtggtccgccagcgaatttcatcccgatttatatttttgtaggcggtcatttggctccaagagtcatatccgcctgcgaaaataagacccctacattggggaaaatgctttttctattagtgaccggaagagacaccccaacaaaaactagcgtttgctgccaatctgtgtgcaaagttagttgaggagtccaggtacagcattacctcaacaacaaaccggtgctgtagacgaattcgtttttcacccgaagtcactaacacaacaaccaagcctatcagagaaagagatcggtagaaacatcgaaaatcaaaatcaatttccaaaataaaaaaaccctcaaacttggatggagattggtctgaccgatgtgtaaacgtcggtttgcctgcactagcaccgacggtctgactggcattgtagctccggtccaaccgctctacactactggagaaaccatctttggtcggtcagccaaatttcacaatagtcccggttgtattaaaaaccgctcagaagtattttttgatctttagtcccggttggtaacatcaactgggactaaatatcatttttagtctgggtttaaaagatggcaggcagtgtcagacccctatattttctttagtcccggttagtgactaaagatccatttgtagttccggttggtaacaccaaccaggaaaaaagatcggcatacgcggagatctaggcgtgcgcgcggatcagatctcctcctccctcccggttctatctctcctcctcctctcctttaactcccatcctcatctcctcactcaccctatctcttcctctccttctcctctcccccctcctccccacaccccacttcagagagttgttaacgaccaaaattggtaatctaagtatcggagatggagatggaatcaaagtagaagtcgagatggaaatcgatcggggaacagagtaagatcggctgaagttcgaatcggctacggctaagatcggcagagttcgagtcggacaaggttagccgattgagctgaatccgacaatatgacatagcaaacgttgtcggtttaagttgatgagcttcatgatgattgccgcacgtggatagagtcctgagaaggcaattgtatctattaattaggatattttatgtaatttccttagagatatgtttgggcaaaagtctgccgcaaagacttatggtatcttagagtttgttagagataagagtcgtgtccgatatggacatgttgtgtaattcttgggtataaatagaccccgaaccccatgtaatcaattaacacacgttcaatacaatcttggcgcatcgccacccttttactttcgttttgtttcaacgagttcttgctttcggattgagctgcatcggttttgatcttcaataagaggtaaaacttgttatggcggcttgcgttctcgggattagtgcttccatctttatgatactctaatcttgtttatgtaattcgtcgagttatcatatatcttacataatctctggcaatatcgctatataatctacaatcggctaacatctatcggtagagggtagccgattaggttagatatcgatgttgacttagattatatagggtatccaccactctatgaaacttccaatggcttgattgtctagatattgtccttcttttcatacttctagctgcatcagttgagtttgatcttataagtcgtgattagaatctcaatctctagcctgcttcttggttgccgattagggtagtatcagggtttcagccgatcttacctgatttaactacatttactctatatgcttcgttgatatgttaaatctgccctttatgttaagatctcattgcatttaagtatattaggcctttgtttgatatattctacttactttaatatcttaatatagagtggtatcggagtattagccgatacatgctagatctatctgatcggctatgctatgaacatatatagtcctattattaatatatatttcgatctaagtgatttatactatcccggcatgacgaccgatctatcccaatcacttgatttaagtatatatcgatataagcagtatatattgttaatatctacagctgatcgagtagatttagttccttcttacttattcatgattgttgatcgatacatatatgacatcgactcaaagataaatgatatgtcatcggcacttagccaatctgctatcgttgatgggtttaaccgcggtttctttgtctttgtttcttgttgattacaagatcaaatcaactggcacactagcatacccgaaggcgagttttggacctgccctggagttaagcagatctcccaggcctcgtgttttacgtcaataagagcacgcggcggtggtggcctcgtgcggcaggcggcctgcgcggcgggcggcgaggcggcggcctacacgtatccagacgtgattcggcctgcgtggcagtttctttccttttttatttagaatttgtgatttggatctgagatgtatttgatatgtgtgtgatgtgaatatgtgatgtatttgtgttgaattttgtagaacttgtgatctaatttttttaaagattttgtgatgtatttggagatgatcgatttgaggattgggaggtgataatcgatttgagacgatttggagatgattgatttgggatctggggatggggatagagtgaaatcaatatattgcaaacaatgaagaaaagaaaaaaaaaggagcaaccggacctagcctggctccatcttgttatccccatatctctaccatggaggcaccccctaggcccaaatagaggaacccccctcccctcgtccaaaccaatttagctaggtccagccgtaaaaataagccgagtgcttccccttgaaatcacgtaagaaagccaagcccaaccgttagagcaagtctaataatacagccaattactagcgatagtagtatccaggtcatctaaagcctgcaatagagccatcaaatacaataacttagctatagtaggatggcccaccaaattgtataagagaataactaattgtgacaaaagcacacgaaaccttctctctctaccttatcactttctctgtcgcaccagccaccatgcgccatccattgctttctgatctcttctatgttctctcccatcttcttcctttgttttttgtatgaacacaagcagcagccggcaggccaagcttgctcttgagcttatcgtagaccgcctcccgagttcttgcatgccacgccatcctgcggcacctcctatcaccgccatggcggcatatccttgagctccttcaatcatcatcaccgacaaccttgagctttacgtgacaagctaggaagcagtcgcaagtgagtccgctggttggaggcctagagcaagctaagcaatggtgagacggtagcgagtaagcaaggatatgatgatgaacccacgacaatcttaagctcctctcctcatcaatgtcttcatatgggaagctatgctgtagctgggcaataggatatgtcacgcccggaaattcactagtaatttccaaactaatttgtgcataaaatcatcgtccaggaatcagccgaggtacacaaactgacaatttaatatacaaatccatcataataataacgttacatacttacaaaagaaaagaaaaacatcaacgaaataacggtctagcgatggcttcagctccactcccacaggcagctcaactagggtataagccaaacgtcagctccttctggatcctttctcttcaactgaggttgattgattattgcaagaatgagcatatgacatactcaacaagccacacagcaaatatgcaagtgcacaaggataccaaaggatggcataatataggctcatttgcaaaagcagcatttagcaaatatttaagagaaataaaacagtagagtaattaatcatcaattttaatcactgaacagcaccccaatgctgcacaggcccaaccatcctgaacaaccatacccggctgtacagatctaactctaaaccaagagctaaacaaattattaccagttattgcatcaataattatttgtgagaggtgtgagactaatcacgaaaaacattgctcaacccgcccataaccgcgggcacggctattcgaatagttttactctggccagaggtgtaccactgtacccacaagacacgattccacacatgttgccatgccccgaagtaccaccacggcactacaaagggggaaatcgtgacaatacccttcgcacaacacaactcaccacagtgcaccattcctggatcataatcaccccctcaaaaatcagaggcatggactcccctgcgacccccacggacttctcgccgcttctcagtctggcaccccgtaatgaaccatgctatacaaaagataaagccgttgcccacgctggcttgtggttggtacggttaatgtttcacaacagtagctcgcgaaccggtccttaattgccatgagcacgacattcaaaaccatatgctcacaacccaccattgccaagttttaattatcaattaattatcataacacgattaaccatcgtgagctacatttaaatctaaccataagtaataatgtaatatgattcaccccattaatgagctaatgtttctaagcatggctaagcaattatatatatatatatatatatatatatagcatttagctgaaccaaactaatatataaggttctagctaatcgaattataacccataagaaaataaagtcatcttcggccaataattaattgggaaaggctcaccacccgatgacattcgaaaataatgcataagttgaaataaaacattagctttaaacgggttcaacatgctcaaagggtcatttgggatctgtgtgacttgccttgagcttcattaaacgcttctgaacctttctcaacgaaaaggctctcctccggaacgtcggaaactaaagcgaaagaacaaaatcaacaaaacagtataaaaacaagcataaacagtatatgtggatatttttaacatgtagatctcgattttagatgaatttagcaacttgaaccactcgaatcggagtaacgatgaattagttatgaatttctgaagttttaatctatttgcatctagaaaaaaaactggaaaaaggaaatatgacgtcatgctgacgtcatcatcgccggcatgacacgggcgacgacctcgccggcgatagagaggtcggcagggctatctaaaggcatctacacgtagaggacgacgacacgaactcaccggtactagcaaacgcgatggatgacgacgaatggtggccggcggcgagctctagcggcggcacggctcgggtcgtcggcggcggcggctctccggtgaccgggaacggcggtgagggggcggccgaggttccccgcctccgtgcgcacctaatggcggcgacgggaagcggcggcgactgctaacgcgacggcgcggcgcggctggacgtcgtccggcggcggcggcggcttggacagcgtggcggcggcgctacgggggacgagaaggctcgggagttggggcaaacgaaagaggacgccaatgggatgctatttatgtcttatattagagagatcggactccaaacgagaggatttgagccggaaaatccgagggttagttggagagataaactcgaaaacgaattcgatttcgcgttgatttcttcgggataaagtccgattcttgggggaaagaatagaagaggataagaggaatatttcccctcaactaattttgcaaacggagcacgggatgcggcggatttggtggaggaagcggcggctgcacaggtacaggacggcagctcgggcttctgtccaagcttgaagatgaacagtaacggggagacaaattagactttcggctgggcttctacttccaaggactgattaaaggagggaaaaaagcagacttcgggaaagagagggaaaggactgcaggctgagaggagactgggccgagagtgagacgacttttcctaattcggcccgaaaaggaaaaggtgaattttaattacttttccaattaaattaatcactgaaatgatccttgaattgttaaaaatacttatattgctcaaataatttcaagaaaaatattgaaaatacttggaccctcaaagtatttaaaaaagttataatcagaccatttaatgattaatttaatatatggataattactgaaatgttctttgtatgattaaaattaagaattgagctccgaaaaatccgagaaaattccagagagtataattaaccatggaggatttaataaaaattaaatccatccatgctttatatttaggaaattttatttcccacatttaacttcacttgtaaattaatgaacatttaatataaattctaataataatttattaaataatttataaatcctgaaacgaaaatcaggacgtgacaggatagtcgtcggctcacccccctctctcttccaactcatcactgtagtcgacatggcctccttatcgccagtccacgatggcttatcatacatgctctaagaaagcggaggcctcttgtccgtggaaccgggagaaggtatagaaggggttaaggaggctcggggtgcataggaacgacgaagaagggcgaccggagggggcagtatgcggcagagctcacctcgagctgggacagctctggcgagctcaatcttcgagtgggcagcaaagccgacgctggcgaagacatgacttgacatggctccccttgccggtggcaagcggctagagcggtgacggacgacggagcatgggtggagcaatggggaggggtttgggggcgcgaagggcttggagatgtgggggacaaggaagagggaggcacgaggggtcttttaatggctcgaggagatggtggggaggctggggaaaggcggtaaatgacggcggataggggcggtgatcttggcgaaggggagctcaattggcgtcgactttttcaagaggattaggtgaaggtggaagtggtggaagagatccggtccaacacatttgactagcaagggcgggagcgggagcacgatgacgtggtgtacgtgccttgcggttcccgggcggaggtaggagactaaggtgataggtgtggtcccatcccacctatcagcgagaggaggaaggaggagctgatccagacctcgcgagataggctacacgcgggggcgggccagcggtggggatgagaggaagtcgagaccgaagagttgggctgtgaaagtggtgcatcgtggggagaacaggatggtggcccgagtaaagtggtagggaggaagaacagacttcgcccaaggagagagtaggttggaagtaggagtggtcggaaatgacccaagggcaatgcggggattttaattggttttccaatcctctcttacaataaagttataacgcactaaatactaaagcttaacatgtaaagatgccacatcatcatccactaacagttattacatttaagcatcatgcaaaattatatataattttataatttattaaattttagagatttaaaatacaagcatgttaaatcatcccacataattcacataaaatttcatccatcatttttataatatcctacatacctaatatttgaatcatcattatatatactatttaaatttaattcacattgttggaacagaacaaacaagtgttacgctagtgtttctgtgaattcttcgattcctcctcccttccgagggttgcatttacatatttatacttagtagcatacaaaggaagttacaatgttatccctataatcctagctgatctatggtggtggactagtgagccagccaatgggttataggtaaaatccacagggacaagggacagctgagcccattaaggaggtggcatggtgccatcactgtgctggcttttacccgggtaatagccagctctagccttcacatcgccaaccgtgtcatgacgtcagcggtggttggcgggtgagtagtgcgctttaacggcaccccatgctcctttttgggattcatcctaggctttggctttggagccctggtgagagctccggagcccttgagttggctccgagacctccagcgccagttgccgtatccatgcgaaccaactctgttgggcttctgatgatggccttacatgcggaggcagactctgcaagcctgtggctggagcctccgaagcggaggccctagtcccctcgggtgaccgcgagcgggggtgggaggggggggagggtaacataagggttggaatccttcccccaacatacatcaatttatgtaagctcatatttatgtaagcatatgttgtttaagctatcttacatattatttttagttattgttttcatagtaaactcccaaagcaacgcgcgtggtttcacctagtttaaataagtgcttcaccaaaaagaatcaaataattactgaaatgaactgtgtgctattaaaattagacattaagttctaaaaattccagggagtaccttaggacatggagaatacaagacaaatattcctagccatgatttattaaacaaactttattgcccacattaacttcacttgtaaattggtttactttttaatatgaattttattaataatagtaaatgatttttaaatccataaaagaaaatcacggtgtgacactgggagatagaggtccgattcctctacttgttcatttgttcactattcggtcattcccttcttttgctctgttcccaatcaatagcaatgacggagtagttcgctgtcgcccatcgatctacgcccgtgtatggccaatcgtcgtccccgtctgcgtacctggccaccctccatcccctatctccctctccatcccttgctcaactcctccagccatgcagcgcctctgtacctttgctatcgaacccccgatgcagctggtgcgtggcggcattggtggacctacatgttggcaacggcgtatctaggattttaggtatgggtggtccaattttatataaacttttcaatatcataaatgtaacattacaaatatattacaaatatacagtacaagtataaaattaacaaaattagatcattatattagtaagtgtctcataaacgttttaaaatcaacaattagtcacaaaatgggccttgagcggatgaatttttgggtg

SEQ ID NO: 41621 - DNA, 3512 bp, Oryza sativa
  unsure (1)..(3512): unsure at all n locations
ccaccccttgtatacgccagtgcatgttggcgttgttttaatttgtgtctataccttactctccctctattgagaaatataagatgtattttatttcgttagaacaaaaatttaaccaacaattatctatcagaacatacttttttatgataaaaatgattttattatatttgtatttaaaattacttacatgtgattatgcctttatcacataactatttatattaggtggacaattattagtcaaaccttatcctaatgaaataaaatacgcctcataataaaaatggagagagagtattattgatgcttaggataaattttggtcaacgatttaaatttcgaccataaataatttctcaaatgcttagttttttttaaaaaaaaaggtatgcataaattagcctaattaaaaaaactattgtacaatctcataaaaatatatacttactaggttttataaatttctaatatgaaattcatgattggaatcacatgtactaaaattcatgtttctaataatatttgattaaagatttgatcaaatcttatttcaaatgttaatatttatgactgagtatatggatactcatgtgtggatttactttaagattggtttaagctttccagctacttgtgtaacttacctttgcacgtgattgtttttttttttgccttgtcccagctccaagatcacatttttttctggatccactgctgagcaaatctaatagaagggagcagtatgcgtcaaatctggcgagaggttgccgagtcttctttcccctccccttgctacagtagtttcctttctctcctgtttcctggcccctcttcccctgattccggcggttcaccatcggtgagtgttggaggaggggtccggccatctaccctactagtatagtgtagctaggctcgtagtttggttgtcaggtctttcctgtggttcgggtctgtctcgtatgagtgttttgctggtgaggagccatggatgcaggagtggatggcggcggtgatagcaggtggcggtggagctgtgagatcagaagatttgttgaagaaccgaagggtggtgatgtctccttgtggtggcgtcggcggcagcgctggccactgctgcgggctccccatcctgctccgtgcgttgacggtggtggctacttgtggcctttaccgatcagcgcccggctgcattggctggagtaggctggtccctattccgcaggctggtatgctttggacatgtgacttcagtgaattttgaactatttggagttttggacatgttacctattttgttcagttaattgtggttggactatatggatttggtcagtgatgtacggcctcatgtttctatctagtgtttggtagaattgctttaacttaacctagtttgctttttggctggatttggtgaagatgtatgtactaaacttatttattttgctatggtcaatgtactgatgtatatgaacatattgtgatctatgagtgaacctgtgtggtgacgacatgtgctatattggatgttaagtgggcttgtgatgtattgattgttaattgggcaatcaattgagatgcatgggtttgttatatgggttattggtatattgtttcggtctatatgggcttttgaaatgggcttgacccactttttatttggatataatataattgggctgaaaatagtgagtatagtgctacacattagatgggctaggtctaaatttaattgggcttgcaattgggcttaggccataaataggatgtttactacatggatcttgatgtgccataagacattntgtgacttttttagactagataatgacgaanataagcatcataaagttaatgacaaaagtaggatcgtcactagatctatgacgaaagaaatatattttcgtcatagagcatgattagagacgcataataggtgatgaacgaaacttcgtcacgtgaacgccattgatttcaaaacgtgaaatttttttctgtttttgtgacataaatgaaacgttacctatcgtaagatctcatgtagtgagagggggcggcgatcgtaggcgtcggctgcaggtgtcggtggcaggctgctgctatgctatgaaggtgacacagttggcggacgcctcggtgctggtgcatgtagcaaatatcttccatggcgtctccattctccgatctaggcggcacttgtttgacagcagcttgcttctctcaagtggacattcccttggcggtctggattggaggctgtggcctctaaacaatgaagcattgattttgcttttgctggatttgagttttaagtgcttcaagacttcttcagcaatccctggccttctagaaagacagaagttctatcgccaccatctgattaagggtatgtttggttgggctgtggcttttgaaaaagcagctgtgagctgtgactttttgaaaagtagctttggaaaagtagttgcgaggaagccaaaagctcatttggttacacgcaggtggcttttggaaaagcacttagtagaccccacatgtcatgtcatggtgttgctgctcagagcagcatgaagccggcggtggcgctggggagacggtgccgaagagaggtgaggcgcgggggaaacagtgctggagagaggagcaacgacagcggaggtagaggaggagcagcggcgggaggagtgtggccaggaggagcggcagcggaggaggagcagcaccggtggctcggcgaggagaggagcggcgccgggcgaggatgggcggcggccggccggggacgagaagcgtcggcggcggccggggatgagcagtgtcggcgttgggcgactgttaacgaccaaatttggtaacatctgtgtcaggaaagaagattggatcaaagcgaagtcggaggcggagatcgagttcggaaacagcaggaatcggctggagtccagatcggctatgattaggatcggctgggtctgagtcgggctaagtaagccgatacggccgattccgacaatacaacttgtgcgcgacatcgggttcgagttaatgtacttcaagatggttgccacgcacggatggagtcctgggaaggcaattgtatctattaattaggatatcttatgtaaattccttatagataaatgtgggcaaaagtctgccgcaaagacttatggtatcttagagtttgttagagataatagtcgtgtccggtatgggcatatcttgtaattcttgtgtataaatagacccgagccctatgtaatttacaacacacacattcaatacaatctcggcgcatcgccacccttttgctttagttttgtttcgacgagttcttgctttcgggttgagctgcatcgatttcgatcttcaacaagaggtaaaattcgttatgacggattgtgttcttaggattagtgcttccatctttatgatactctaatcttgtttatataattcatcaagttatcatatatcttacataatctatagcaatattgccacctaat

SEQ ID NO: 41622 - DNA, 5972 bp, Oryza sativa
gttccgttaaaggcaaggcgttgaagcagggattgactgacatcatttatgacaacgtcatgccgatcgatccagagaaattcacgcctgagcagaaggcggagttgaagcaaccctgcagcaggcacgggatcagttcctgaactcatttatgcaaacccgcaagggggcacttgttcagaagtataaaataaaagtggttgctgatagtcctgggaccggctcttctaaagatggagaagtgaaacaagctccaggcggctcgggtcagccgagtactaaaggtgctaccgacggctccccgagcgatcatggcgacaattctcaaggagttcgtggcgttcaaggtgatggtgctcaggagccacaaggaggaaatcttgaccagaatagtgaactagcacaagattttttcaataacttccaagatcgggttgattacgctgtgcatcatgctttgatcaatcagtctggggtattagtcaacacattgtcaaacatgatgaagacaatagccggtggttcgatagctgagcatcctgcaggcccagtttacttgcagggaggtgtcttcccaagttatcaatctttgatcaccgatgttcagccgtctgttcaagcagttccctctgttgcgcccacaactcagccgacggcgccagcgtcgactcctttgcctgctatactagctatgtcgccaggacagccggtgaaccctcggttgttaacaagggaacaaccacaacatggcgggcaggctacgaatcggctaaccaaaaatcaggttgctgccatgtttctaccacctccacctattgttgatccagtgcagcagcagccaattcagcaggcaccaccaatccagctggttgtacagccaatccaacaacaggtcatacaaccagctcagcaaacaccaccaaggcaacaacctctgcagccggttcagcagacgccaccaaggcagcagcctcagcagccgatccaacagactccgttgagacagcagatcgttcagccgattcagcacccggggtcagtgaatgcatcggccaggttcgtagtacctggtggtcagcctgtgcagcagtttgtaaattaggtcatcccagaacatttggttcaccatgcacagccggacggcacaatgataccttagatggttcctgagcacttggtgcgcaacatccagccgaatcttcataattaccaagggggtaacttgagctatcaatatcagcctccttccccgcaagcccaatatcagccagggggattggctcagccctagttcgcatctcagtatggtcagttcgagtctatgcaacaacagccacaaggagcagctcagcaacgaccgtgggtcgatgtgattgccgatgtaatgagagaacaatttgggcttaaaccaaaagagactggaagcttgtatcggcagccttatcctgagtggtttgaaagagtccctctccccaatcggtttaaagttccagatttctccaagttttcgggacaagagggcgtgtcgacttatgagcacatcagccgattccttgctcagtgcggtgaagcatcggctgtagacgctttgaaagttaggttattccggttatctctgtctggatcagcttttacttggttttcttctttgccatacgggttgatcaatagttgggccgatttggagaagcaattttacagctatttctacagtggggttcatgagatgaagttgtccgacttgacagcgatcaagcagcggcatgatgaacccgtgcacgagtatattcagaggttcagggagatgaggaacaaatgctttagcttgagtttgactgatgcttagttagctgatttggccttccagggtatgattccttcaatcagggagaaattctcgttcgaagactttgatagcttatcgcatctgatacagaaggtaaccttgcatgagcataggtcggcggaagttaggagaagctctaagaaagttaatcatgtttgtccatacatgtatggatcggatgacgaggaagatgattctgaaatagctgcagccgaatgggtgaggagcaaaaaggtcataccatgccaatgggtaaaaagtcctagaaaagaggaaaagtatgattttgatatcaccaaggctgaaaagatctttgatttactactccgagaaaagcagattcatcttcctgctggtcatacaatcccatcggcagaggaattaggcaagaagagatattgcaaatggcataattctgggtctcattctactaacgattgcaaggtttttagacagcaaatccaggttgccattgaagggggaaagattaggtttgatgattccaaaaagccgatgaaggtcgatggtaatccttttcctgttaatatggtgcatacagctggtcaagcagccgatagggtccgtgcaaagggttttcaagtaaattcggctaagattatcaacaagtatcaaaggaagtatgataagcagcaggagaggcattatgaagaatacgacgatggttttgatcctcattggggttgtgagttctttagattctgctggaatgaagggatgaggttgccatccatcgaaaattgccctgggtgcagtgatatcgttgagaactcgagccggtcatacagtagaggtaatcggctaaggcaggcaagacttcctgttcatcagagattgggtccgatgaatcaagattgtggccaagaggatgaggtaatcaggaagaatcaatggtgtccttctggtattttcacgaagaatcagaaaagaagggtccagagattgaggaacagggagcgttttcaggaggttgaagaggaaatcaaccatcggctgaggaaaccaaagccaagacaggagtggcgtgtcaagaatcaggttcctgtagccgatgatgctgcagccgatgaggcgaagaggttggcaaaagggaagagcgttgtagcggcaccaattaacatggtctttacattgccagccgaattcgggatcgatcaggccgatgtcgatgaggtggaagagggatcagctaagttggttctgtcaccagaacaggcagtattcgagaaacccgaggggacagagaatcggcatcttaaaccattgtatataaacggctacgtcaatgggaagccgatgtctaagatgatggtcgatggtggggccgcggtaaatttgatgccttatgctacgttcaggaagttgggtaggaacgccgaggatctcatcaagacaaatatggtgctcaaagactttggtgataatccatcggaaaccaaaggtgttctgaatgtggagctgacagtcggcagtaagactattcctaccacgttttttgtcatcgatgggaagggttcgtacagtttggtgcttggaagggattggattcacgccaattgttgcattcctttgactatgcatcaatgcttgattcaatggcaaggcgacaagatagagattgtgccagccgacaggtcagttaatgttgctagtgccgatttagccctttgggagatggatggccttgattgtttatctggaaaagtctgggatagagattttctaaaagtgtccgattctgatatacagccaatcgaagatggagaacccaagctattactttgagggcgtcgtggagggttcaaatgtctacgccaaggatatggtagatgatctcgatgacaagcaaggtcaaggtttcatgtcggctgatgagttggaagaaatagacataggtccaggcgatcggccaaggccgacatttattagcaaaaatttgtctccagagtttagaaccaagctgatagagctcctaaaagagtttagagattgcttcgcttgggagtattatgagatgcctggactcagccgatcgattgttgaacatcggctacctatcaagccaggggttagaccacgccagcaacctccgaggagatgtaaagccaatatgcttgaacctgttaaagctgagatcaaacggttgtatgatgccgattttattcgtccctgccgatatgctgaatgggtttctagcatagttccagttattaaaaagaatggcaaggtcagggtgtgcattgattttcgagatctgaataaagctacaccaaaggacaaatatccaatgccagtggccgatcagctggttgatgccgcatcagggaacaaaattttgagttttatggatgggaacgcaggatataatcagatctttatagctgaggaagatatccataagacggcttttagatgccctggtgcaatcggcttatttgaatgggtcgtcatgactttcggcttgaagagtgctggagcaacatatcaaagagccatgaattatatatatcatgatttaatcggctagctggttgaagtttatattgacgatgtggttgtcaaatctaaagaagtggaggaccacatagccgatttaaagaaagttttcgagagaaccaggaaatatggcttgaagatgaatccgacaaaatgtgcttttcgtgtgtcggccggccagtttttgggatttcttgttcatgaaagggggatcgaggtaacccaaaggagcgttaatgcgatcaagaagattcagcccccggaaaataagacagagctacaagagatgatcggcaagataaattttgttagaaggtttatttctaatttgtctggaaggttggaaccttttacacccttattgaggttaaaagccgatcagcaatttacttggggggtagaacagcaaaaggctttggataatattaaggagtatctcagctctcctcctgttttgattcctccacagaaaggaataccgtttaggttatatttatcggctggtgagaagtcaatcggctcggttttgattcaggaattggaagggaaggaatgagttgtattttatctcagtcgacggctcttggatgctgagactcggtattctcctgtggagaagttatgcttgtgtctgtattttttgtgtacaaggttgaggcattatctattatctaacgagtgtactgttatatgcaaagccgacgtagtcaggtacatgctatcggctccaatattaaagggaagagttgggaagtggatattttccttgactgagtttgatcttcggtatgaatcaccgaaagcgattaagggacaagctatagccgattttattgtagagtatcgtgatgattcaatcggctcggttgagatagtgccatggactttattctttgacggatcggtatgtactcatggttgtggcatcggcttagttataattccccctaggggggtatgtttcgagtttgctatactattaaaccatatgcgaccaataatcaagttgagtatgaagcggtgctcaaggggttgcaattactcaaggaagttgaagccgataccattgaaatcatgggggattctttgctagtaatcagtcaattggcaggagaatatgaatgcaagaacgatacgttgatggtttataatgagaagtgcttggaactaatgaaagagtttcagctggttactttaaagcatgtatctcgagaacaaaatcttgaagctaatgatttagctcaaggggcgttggggtataagccaatgatcacagatgttaaagttgaaattgcagcgatgtcagccaatgattggaggtacgatgtgcatcagtatttgagtaatccatctcaatcggcttgtaggaaattaagatataaggcattaaagtatacactgttggatgacgagctttattatcggatgattaatggagtattacttaagtgcttgagtgccgatcaggctaagtttgcaatcggcgaagtacatgaagggatctgtggtactcatcaatcggctcacaagatgaagtggttgcttcggcgtgcaggatacttttggccgacaatgctggaggattgtttcagatattataaggggtgtcagg

SEQ ID NO: 41623 - DNA, 19786 bp, Oryza sativa
aagcattgtggtcttataggatggcttgtcatggatcgattcaagttcctccttacaaacttgtttatggacatgaggctgttttgccatgggaggttagaatcggctctcaacgaacggagttgcaaaatgatttaacagccgatgagtattacaaccttatggctgatgagagggaggatttggttcagtcaagattgcgagcccttgcgaaggttactagggataaggaacgtgttgcttggcattataataagaaagtggtacttaaagatttttcggaaggagaacttgtatggaagctgattttgccgattggtactcgtgatagtaaatttggcaagtggtcgccgaattgggaatgaccattccaaattcataaggttgtgtctaagggagcatatatgttgcaagggcttgatggtgaagtttatgggcgagcgctcaatggcaaatatttgaagaaatattacccaagtgtttgggttaacgcatgatcggcttatattgccgtgctgatatctatgagagttggagtcatcggcccttgattaaacaagaaggcattaatggtgtttgaccagaagtaagaagcagctgccatcaggggttcatctttggccgagtttgctatggtaaggtcaagtgcttggccgattccaatttcagtgttggctgatattgttatatcgcccttagttgttttttatggtgtaatcgtttgtggttcgccgatgtacaatggccgatattgttatatcgcccttagttgttttataattttatcaatgctcttgacattgtaaaactaggggggcacatatatatcaaaatcaaaatggaatgcaaaatttttgagcaaatttcaaaaagtatcggaatgtcttagccgatttcaaaagtttctaagttctattacacaaagattattgagataagtatcgctggatagctgatatagccttctgcctaatctgttctacttcctctatggcttgggcatcttgagcatcggttcaagggataactttcagagacttggtcagatcagcaacatgcttgatagccgttttgagtcttgctttctgttcttcaatagactttgggagatcggctaacttcttgtgctctatatccagctcagcgttgcattcttcaagttgtgctaagagttcaatcttgcgagcctcgagtcgatcaatgttagacttgattgggccttcagatagttgatcaagcttggacttctcttcatgcacaagttgtcggttggctttgctcaaggtaaacggctggggtaaggatatcggctaactcatctgggattagagcctaaatctcatgtagccgagccctgattgagccacaatcaaccaccaagctatccagtgatgatgcttctagccgatccaagatattttccagagttttccttacatcatcagataaaggggctaaggctttgcttgtggtatcttcttctccttcatcaagatactctctgatgtcaaaagagaaaagatcggctaatacctgcagcgataatttagaagcagttagaggttaaatagtcatagccgatttgaatgcttgttgagacaaagagaaacttactgggatagcaggagcagctggttgttcttcttcctcgacgtgatgactccccacagctgaaggagtctggtcacttgacgattgctgtacagaaggagaaggaggagggggaggctgaaaggaaacaagtgtcaggcaaaatcggctgaaaattaactaatgaaaattaaaactatcttactggtggagctggtttagatgttattgcaaccgatttcttcttcaccgcagtcttctttttctatagttataaaacttgggagtgatcgactataagacagataattatgaaaggaattaaagaaagttgtctactcttgaaaagtggaccggagcagaaggagttggaggggtttgcttgggcgaagccgatggtgttctttcagtatcgcttacttcggctgtggcctgatcaacttcgtcttcaattatttcttcatccagagcttgttcaatagatggatctagggtaggcagatcatcggctgacttggttttcttcgtcttcttcttcttagttggggctgcgatgtttacagccgacgatctggttttcctctttttgccggcatcagctggttctctgataagcccttgaagaagagctgaggtcttgggggcatcatagccaataatcagaggagatagcccacctccattaggaattaagcctggggcatattggatgtccttgccactgttgctttgatgaggaggggaggattctgttgtctgcaaaccaaaaggaggattagttgagattaatcggccaaacagatatgtaattgaaatcaagcaaagttaaagacttacttgagggacaacatctagaaagaggtctgtcatatacattgaagctggttggtggaatagatgcagcttccattcgccccaccacctgtcaaagtttctgcttctgaatgttgccagttctatgttatcaatactgcccagaggaggtccttgaaggttgagcagccgatccatcatcagggttgatgaaattcctcctcggcattggatcttgtcggcgaagaataagccgattgggagttgtcccattccaagttgtctagctgagctcattggatgatagaattcgtaagaagcttggatgtttcttccttgatgaatgccaacaggaaggatgcatgggctgattgcagctgagaaaatttccctagacgattggtatacttcatggttgacgtcttcgaatctaaagtccaatgggtgctcaagttctgcagaatcttcatagagaaaccaaactggagcatctttttgaaagccttcatagaagctgcagaaccaatctttgagtagttcagccgatagttttgccccagcctcagttggtgtagaagcgtattctccgtatgatgtgcatctccgatgagtacgctcttctccatcatctcctacaatcggctctagtcttggaaactcagcttctgatacggatggccgagtgacaaccttcataactatcaggtttaaccaggtttgtagcagccaccagggcccacctactccaactactgagccgacgactatcttagccgatgcattgtttaacatatggtatagatagccgatgaggattttgtccaagggaaattgtttctttgtttctaaagcttcagctagaaattgccagttggttgtggggccgcaacttgatccacagaacagaaatttttctagccacattaacagaaagccacatgttcccgaggggtgaccgagccctggcccatgtatgccgctacgtagcctgaccaacctcctatgctctttgtcttgaagtcatattggttctttgtgttcaaactcatagggttggccgatgaggtgacatccagacccgtgatcatgctgatatctatgagagttggagtcatcagcccttgattaaacaagaagggattaatggtgtttgaccagaagtaagaagcagctgccatcaggggttcatctttggccgagtttgctatggtaaggtcaagtgcttggccgattccaatttcatcccagtggaccctcttgctggctgatacacgtttgaaccatgtagtccagctcttttctggtggaactttttctagagacggccaggacttgaaagtattctttcattgacctagatctgggttggttaatctgaaggggatcctattggtttcaccaataatgaactcggtggggtcaggattgccgattgggccgagagagtagtggttttcatgcgttagactaggaattgcgacttggtaggaaagatgctacaaatccaaggcaaccaagagaaggaaagcaatatgagataggagaaaatcgatctgctgctaaagaaggggatttagccaataagaacttacctcaacgtattcggttgatggtgcaccagatgggctggcggaagacgacattggtgcgggcggagatctcgtcgaggaggaagtcgcctagaaattgcctttgcgccgggggaatcgccggagaagagaaagaagaggtttcacttgagcggtgaaaacggaagtcacggcatgagatttctcgggggtaacggttagtatttaaggtgctggaataacggtcaaaagcggcggagtgcgaaacttgctcggagtcagtacacggcaaatccggaatattatcaaatatcccagacttggggggcatgtgttaacgaccaaatttggtaacatctgtgtcaggaaagaagattggatcacagcgaagtcagaggcggagatcgagttcggaaacagagcaagaatcggctggagtccagatcggctatgattaggattggctaggtctgggtcaggctaagtaagccgatatggccgattccgacaatacgacttgtacgcgacatcgggttcgagttaatgtacttcaagatgattgccacgcacggatggagtcctgggaaggcaattgtatctattaattaggatatcttatgtaaattcttatagataaatgtgggcaaaagtctgccgcaaagacttatggtatcttagagtttgttagagataatagtcgtgtccggtatgggcatatcttgtaattctcgagtataaatagacccgagccctatgtaatttacaacacacatgttcaatacaatctcggcgcatcgccacccttttgctttagttttgtttcgacgagtttttgctttcgggttgagctgcatcgatttcgatcttcaacaagagataaaattcgttatgacggattgtgttcttaggattagtgcttccatctttatgatactctaatcttgtttatataattcgtcaagttatcatatatcttacataatctatagcaatattgccacctaatctattattgactaacatctgcataaaaaagcagccgattaggttagatcttgatgttgatctagattatatgagatatctaccattctatgaaacttctagcggcttaattgtctagatatcgttctttttttcatacttaatgctgtatcagttgagtttgacctattaagtcgtgcttagaatatcgatctctagcctgccttctagttgccgattagaatagcatcggagtttcagccgatcgtatctgatttaactttatttgttctatgtgcttcattgacatgttaaatctgccctttatatcaagatattgctgtgtctaagtatattaggctcttgctcgatatattattcttgctttaatatcctaatatggagtagtatcggagtattagccgatacatgctagatctatctgatcggctacgctataaacatatatagtcctgttattgatatatatttcgatctaagtgatttatactgtctcggcatgatgaccgatctatcccaatcacttgatttaagtatatatcaatataaggagtatatatcgttaatatctacagcctatcgagtagatttagttcttctttacttattcatgactgccgatcgatacacagatgacatcggctcaaagataaatgatatgtcatcggcatttggccgatcggctatcatttatagatttaaccatgatttctttgcttttatttcttgttgattacaggatcaaatcaattggcacgctaacacatctgaaggcgagctttggacctgcactggagttaagcagatctaccaggccacgtgttttcagtcaacagcgacgccagcatggaagggcgggggcggcgtcgcgcggcatcagttggggaagggtcggagccgcgccggcgtctggatgggcggcttcagttgggaagggcgggggcggcgaccggcggggaagggcggggccggcgccgagcggggccagacgggtggcggccggccggccggagggcagcggcggcggaaacctcgatgcgacgatgctcggggccgtgtgcgacttgcgaggaggagacgggaagagaatagcgaaccatttttttcataatggcagaggtgggtaattttttcccccaaaagcagggggtagaggtgcttttgatttgtactacaccaaaagctgactttgggcaaaagcaactgtggcttttgggccctttggttggcttttggtttttgcaaaagcaaaagcaagttgaaaagcccaaccaaacacaacctaattttgtgatattggctacttgttctttggaatcaagcttctttttgtttcaaaacaacagtatccatgcagggtttatcgttcgggttgagcaatttttgctcctcagatttaatggtgaactctgtggaacctctttgttgagtcgggtgacgcctacaccaaaatctacgactcagcaactaaccttcgaattgtgtcgtttctgtggtgacagccgtaggagccttccagtctgtcaagaggtgtgcatgtcatcgaaggcccaagcattcagttgtcgcagcgacgccgtagagctctgtcaatctgatcctttactgctgtttagtctcatctgaaagtttgcttctttagtttagttaggctccacattgttagagattgttactttccatgatttgtatccttatgcgatgtactagggtgtataccctgaactctgtcttctttaatttaataaagctgtttaagttataaaaaaatgcgtcaaatccggtgtaaaatgaaataagcgccatccacccgatgtaaagtgcaatttatcaaagggagcatgtacatagtatttatcatggcaatacacatggtaaactaattacattcataaagaggcttgctaacccatggtataccgttggaatggcataatcattagtcagacacctcaaccctaatgcgcatggccggtgcgcatctgattgcgtgcatgtgctagtgctggtcgtggatactgtatatttttttttgggaagcaattcacaacactagctaattactactactctgcgcaatctgccatgcatgacatgacaagtgctcctcacttatacacccatagattatgaatgcctatccttttggtcacacattactacaaactcctctgtaattgcgtgcttagctatacatgctgttgttattatagctatactcagtggttgggctggtacctcagtatcttatattatgatactattttttacatgtcaaaatatgactatctataatagtacctcgaaagtatcgtaaagtacctatcataatacatgtgggtagcaaaccaagcacatatcagctggtatacgtgggtctcagttttaacatatacccagtctgatactaaggtatcacttatgatacctgatagctctagaatttgtggtactaagcatgatacatatatgtattaggttgatacctgtaggtagacccgatacttatatgcactagacatgatacctaggtaccggtcgtgatacatatagttaccaagtctgatacttataagtaccatacattatacctaggtatcagtcgtgatacatgtaggtaccagacacgatacatgtaggtaccagatctgatacttatatatgtactagacatgatacccaggtaccggtcgtgatacatttagttaccaagtctgatacttataagtaccgtacattatacccaggtatcagtcgtgatacatgtaggtaccagacatgatacatgtaggtaccagatctgatacttatatatgtactagactagacatgatacctaggtaccggtcgtgatacatgtagttaccaagtctgatacttaccatacatgatacccagatatcagtcgtgatacatgtaggtaccagacatgatacctagatacgactcatatactcacgctattttacccttgaaacaggaccattcatcatcaggtcacataggatcacatatagcaatagagaatcaagtcattttctcttgctcattggcattggcaactttaacttcgatttgatgcatatggcatcatcaaggcaggagtagtattagaccgttagacagcgacaataattgactggtagtgcatgtactcctcttcctatactactagtgcatgcattagtatatggcagacagtagtatagtacggagtacgactgtactagtactgcatgcgcaaagagttaatccgtggggctcgtgggacccatgcgggaggagagatgggtggtttatagcgatgctgggttggacggtttaatgtcgtgcataacttgtaccgtcctgacaatataccgtttcatagctcttctcttcataaaagcgtctaaaagcgtctagcactaatccatgtactatggttgtattcggagtaatctattagcgcatgataaattaagcattagcaaaaataaacttttaaaatagattaatatgattttctaaagtaaatttttctagaaaacaaatcatttagtgatttgagaagcgtgcaagaaaacgagaaagcagaaattgaaagtggtgataaaaacacaagtttgcactaaataaatccaaagttctacgcaagaaagaaaaaaaaggattagcgtttttggttgaggcagtgtgaagcaaggtgcaaaagcaggacaacggaagcacgcaacgcaacgcatcccccacgcctttggtagcactcgcaaaggcggtataccgccgttaagcatcgcatcctccgattcccattctcccctcccaaccatttctcctgggccttgctccgctccacctcccaccaaaccctaaccctaaccctaacgcgcctaccacgcgaggcgcggcggcggcggcgggcaccatgtccgcggcggtgtgcggcaaacgggcctcctccttcttcgaggacctcccccattcgccgtcctccccgccctccaagcgcgcctgcttccgtggaggttcctcgccctcccgcccgctcgccgacccggccctcgtcgcccagatccgcccgcggttcccctccgtcggcctcgaggtgatgccgtctgctcgtctccctcgtaaattagcagtcatgcgtgttatgatttgagatggaagtttaatctttggtcccaaagtagtacctggtgctggtgctgttgctatgtaaggggtgagccaatcaagcacatcctgctcatgattatgcgtggtgctgtctgtgccgcttgctattgctaggtttaaaggttagatggaattgcagcaaagctaccatatgtacatgtaatctaatcatttagcgatctctttgttttgttccaatcttgcaattttctagtttcctgacgaaataaatgtggcttctgtgttcctatattttttcttcaattatggaatgcaggtctcgcagactttgttcctggttagggtttgtgttaggatttatttgagaatggtgacttggtttatgttacagttcattttttccttggagtgatagcaattttttctatgcatggatttgtatttattattttagtttagtcattgttttctttgggaactgtcgattgtcgtttttgagcggaactggtagatattgagaacttacttacattaatggcttttaactgatgggaatctggagtgcatcggagcatttattaatttgttatccttttgtccgttgatgccgatccttgcgatccgcgcacacctcttcccagaaaagtttttgttgcctagaaaaacgtattattcatataagaattatagccagcaattctatgaagcatctatgggccttatatggttgctttcctcttttcttaaaatggccactcgcgggaatggtatgttaccatatttttttgtttgttcagatagtcatttttttctgttcgtttggattctctgaacaatgtgcttgttgttataacaaagcataatatcctacaatatctggtaaaatttccttaacctgaccactaaagattttcacttgtgtttgtcagctttctagatacaattcgtcaacatattcaaagtatgttcacttgttggagctttttaacgatttagtaacttaaaccttatggaaacttttgttcctgcaggttattgagaacgcgttggaggaatgtgaaaacgattttgattcagcaataaagttcttgttcaatttgcatgtaggacccacagaatgtaatgtggatcctatttatcaatctccatcaggaatgtctactgagcttcaagtggctgatgaaggtaaactttggacctctggatgttgtctatcttctatgatgttatgttgataccatctataagacttctatcttctatgatgttatgttgataccatcttaggtgtccaaactcctgagggttttcattatcaaactgtcttgagaattcttgcaaaattcctgtgttgtgaacagaccctatggaatcagtttttcagtgccaatgttagattgtctaatgatgaattgtaatacaatacggatctgttttcttagctttgttattcacaacaacttttccaattggagcatggctttctatgaaattagtgacacagttttatctcattgaacgcatgattgtggtgcaagtgtcaaacttgggcacgagtgtctgatatggtagcctagggaaaataggattcaaggatttgattggtatatttgaattatttgaaatcacaaaagactcatgcactaatgtaggcacaaaagattattcaactatgtagtgtgaataatcatatttactaagcaaaaaaaaggcattggcacaatgagaaaaggctgctcattaattcaatcacccgtatagaaaatatttcaattcctttattctgtgcatctcacaacctctagatcccctctcctccctagacctgactcttgccatctcctttctctgaaatctcatctgatttcaacgtttgatcaagcaagattccaatacaaaatttagtttttaacgtcttccatttaatatgctctgcatgctatcaagcaattttgtaaccatatgttttttctttatttgaggtgctgacttgaatgcttttggatctccaagacttcaactaaagttgcatggctattgctgtacaacttgagataaaatatcgttttattatatgcttttcactttgcatcctttgtaacttcttctgtatagtgcaccaacaaacttatgctttcgaactcagtatttcaaatttagttctaggcatagaatagaactcctgttagcattaaccaatttgaccactttgagaatattgttctgaagaatattattaagtatggcagatgtgttgctttatggtccaggtattttggctggtaatgaagctgctgtacctataggaaatgctccctgcgctgataactttccatcaagcagcacccagtgggttgagattcttgtgaacgagatgactaatgcctctaacatggatgatgcaaaggctcgtgcctctagagtattggaggtgtttgagaagtccatgaccgctcatgttggtgcaatggggagctttcagaaggtaattcaaatcccttccaagagtgcttcagaactttcagggctgcttgctagttatctaggggtgaaaacggatcggattcggacggataatagctataccatatcctaaaccattttttttaaacggatgcggagcgggtgcggatgacgtgcggatgcggatgcggagcggattatttcggacgtcggattcggtgcggagtcggtgcggagtcggttcggaaacggacaaaaagttgtcggatgtcaagtttgtattcaatccatacaacaagaggacgccaatacaattagccgcaatacgatggcaaaataacatctaaacatgatctcagttctctaggaaaaaccaaccaaaacacatcaataatataattttgcttaatataacacatccaacaaaataatccaagatacatccatcactcattagtcactggtcactgcattgcttaaaatttaacaatataacttataagtcatcactcatcagtagttcagtacgacatgcatgctgcatgcagcatatgagccagcaatgttatccacatcaacaacaacaatagtgttgggactttcattgccactgcccacagttgatggcccttcttccccttcagctggagctggcgacgaggcagcaatgctactttcagtagcagtagcagcagctgctgcttttgcccctctttttctaggtgccattttttacgatcctaatgaatgatgaacaattaatcaaattataacttgctattgacgtaatttccgtaagcaaagctcatctctacatttctaaatcagtaaatcccaaatttgatacttcaaattggactgcaagtgtacaagaaaacaatacctaatctatcgtcgacttgtcgttggactggaacagcagctgcagctctaggcctcgagcagttacagcacgacgacgacacggcacggctgacgacagtggtggctggcgagtggcgacgccacgacggggatggctgctggcgacagccaacagggatggcggctgggctggtgacggggatgtgacggtgcactggcggcccggcgctggagacgtgctgatgggcgacagtggacggagtggtggcggcgccgaggagccgaggaggcgaggacgaatggcagcggcgccaccagcctgtactgcagccgaggaggagcggcggcggcgctagcagccaaggaggagcggccggccggcgctgggtcgccgtcgcgctgggtcgactcgccgtcgcgccgccactcgcccactcccctacgactgagagctgacgggagaaagagagagagtcagagagagagagagggatctgccgatctgggggacagggggaggagaggaaggattaggttagggttagaatagatgggttattgggctagaatgctagatgggcctgaaagttgcggattatccgccaaacactatatcggataatccgattaaaaaatcggataatccgaatccgtcggatatcattgataccacatccgcatccgcatccgcatgacaaaatccgcatccgcatccgcatccggccggatatctaacaacccttaccatatcctcacatcggacggattcggatcggatcggataatatccgctccgttttcacccctatagttatctgacctttgatgtggttatgatattgtcgtgttctttcatccttgtccattctaggttaccaaggtatcgttgttcctactgggtaacctagtggtcagcgaaaaactgtttgagtggagaatcattttaaacatatgagcacattttggcaactctgggttttacatacttctccaggacatgatatagatggataaactaaatgtaaaaaaaaagaagcaaaatgatactttggccagcagaaaacttcaaatcttgaggaccgattctaaaatatggacacatttgatcaagcatatagccatataccaactattgttactaggctagttaaataacttttggggatgccaaaacatggattgacttggatgtatgagttgggagtggattttgatacctcaaggggatgtcctattgttgtttgcatgtcacttaaaaagttataaaaaaaattgaaaaaaatttgagaagatgtattgacatgttatcacttcacaaacatacaagttcaaattcaacttctacatctcgcaaagaaaaaaaaacaaatttgactgaatatgtgttaactagctgtagtttaatttttttttcgttgcgagatgtataagttgaatttgaatttgcatgtttgtggagtatatcacatgttaatacatcttctcaatttgttttcataattatttgactgatgcaaacaacgaggtgacatccccttgagggatcaaacatcatgaatatctatgatggattaccacgtagacttttaacatcttttatttggatgctttccagaggattaacttccaatggttatgaactgaattgcactgcagatttgtgctgattataatctattgtttactatggagaacacttgatggtaagttttaaaataaattaacttctctctgatattcttactttcaaacaggaaagctctgtgtataaggaacagtttgaagcaataaccagggaaaatactattctaaagaaagccgttgcaattcagcacgagcgccaaaaggagcatgatgggagaaaccaggagattcagcaactcaagcagctggttgctcagtaccaagagcaaattagaagcctggaggtataacaatcttagttgttttcgctattcttgtttattggccctttttgaagcatcataagtggttctggctaccgatgttttattttattcattttcttgctgtgcaggtaaacaactatgcactgtccatgcatcttaggcaagctcagcaagccaactcgattccagggcacttccatcgggacatcttctgaataacttcatacctaaaccggaggtttccatagaatgagatatcgttcacccaacaattaagggcagagttcttgttcttggcttatatccaatatattgccaagttataaacatagtttaatgtatgttgtagacctgtgtgtacatgcttgtcttgcgttgtgctgttggccccctaagatgggattgtgtgcgagcaagcgcaaagaaagcttagttcattcgaacggcagacagaatatgatcaagttagaaaagaaaaaaagaaaagaaaagaaaagcgaaagagcctttaaaattattctccaacgtcggctatttaatggttgtatgtgagatggtctgacttgaaatcttagtttcctaaacgagaaatctcaccggttaatggaatttggagagagttgtagattgcgcaggtcatatgctgttaatttgcggtagtggcgcacagctttaaatacccgcagctactcataaaatcttcattttatcaaacaatctaggttctcaatttagattctgggatgggattcaagcaccgtaccagctgttccttacgtttcttacctccaaatatgatcaaagacatgtgcgttaggatttgaacatataaaactttatctacatttctaagttataacaacggtaagatggatggagaaaatagtactttcgcaaggtgtacaccctgttgcaccttccactaaaaaacacatacttcctccgtttcacaatggaagtcattctattatttcccacattcatattgatattaatgaatctagacatatatatttgactagattcattccatcaatataaatgtgggagatgctaaaataacttacattgtaaaacagtgggagtaataggttatgcgactaacataaggtggtttgcgacctatctaataaagctcgtgaaaacgggttattaacacaagacggctagcaatctgaaactgagtagaactcgatctcaaggcagcctttcgcacaaagcagcaggtagatctagaactacgaatgcgaatctaaaccagtgaccactaacttgacataggacacaaactcaacactatggactctgaaacaaaattatgcaaaatactaaaagtggttaaaggataggtataaacctaacactactatattttttggttttttcgtgtactactggatgaaagcaaaaataatacaagggtaaagacgaaactgacggtatacctaaagctttgataccacttgatggcaacgggatgctcgaccttccatcaagtgaagtgaagatagttatcgatttagtggaaacttgacacacacgatcaacatgatctaaaccctgcaatcgcagcgccacgtctcctttggttattaatcgtgccgaaacccgattgacctcgttgagaaggctaatccctgcgtgtgaattgaaaaacacaagcaagagcaagaaagacaacaacttaattacagataaatgattaatcaagaactcgaagttgaggttccacaaatcgaactagcagcgaaactgtaatagcaaaaataatctaagcaaaacccaaccctaacacaatgacaactactgaatatataggttatagggtcgaccttggactcatggacacatccctattggactccaacatgatacataacccaacggacccaaaaacggtgacgtagcacctagactgattctgaacgcctttttgttttgacaattctcattgactcggaaagaattttgatgtaggaccatatccatttcgacgtcgaaatcggagtccaaatgcaatctcggtgataattttagtgtggactgctcctggagcctgaggtggacatgaacttgatatgagttggaccttcatctcggcttcaatgtccatgacgactttgtccatctcttagcctctctccaagtactccataatcctctctatagttcctatcataattaaatcattaggtagcaatctatcatcaaaagcacataaataagtacttaggaacgagctcacctataaattcaattgtcgggcgcgagctctagtaattggatcttgcataacaatttgagaggtagtgtgtgtattaaaaggagtgatgtcctcatcagcgggacagtagcaccaggagagagcggcagcggcggcgttgcgtggagggagaataagcggtgatggtgcggtgcattggcagtagcgcgtgaagggagatgcgctggacagtggttggggtggaccgggggagggagtggaggtgtgtggcaacgcaaggaagagcctgattggtggagtcagcgtggggaaggtgggccttgctggtgaggccggcgggtgatgcggaaaggagggcctctgggagagtggtcggggatggggtctcagacggtggcgtggcagatccaaccgccggtgtggtggatgggggcatcgtgggatccgggcataacaaacattactatttccagaaaggtgaaataaaataaacagtatcttcaatctagacagcaagagcaagatacgtgagatggcaagtaaactatatgaggaggatgatatcttgggtgaaattaagggaccaggaagtgaaaatcagttttacatacgtgcctcttaaaggaatcgactataaagttcgattttcacaaacggttatataaccatatagggaaatcgacgatacaatagttagaaatgttggttttattttagaaaaataatgctatatctcttcgttgattcaaaaagctcaatttgaggggattttctaatccgataaatatttgttatcgtattcgttttattttgtattctctcaatatctgtacttgataatattcgattttgtttacgtatccgtattatcgattccgattccgatgaagaaaaataaaaatgaatatagtagagctggtttccatccctttctgattcgttttcatacctactccatagagatgctctaattaatagggaaaatatacgcagatccttacgaagaatatatgtgggcatgtcacctactggcattgtttagtttgtaaacggccaactatgaccaaatttagacaacagtagtcatcatgattaaataatccaagtaaattgctctacccagccgggctgtcgatcttgtgatgaatccaatttgctactttctacgtgagcacaataatactgtacaaacttattatactttcatcttcaaatataactatttctaatacaataaagtaacttactccaaaataaagctaattctccacatgccccttcctctcaatcaaccacaacccttcttttaatttttcacctattttctcttctcaaccaatcacatcattcctccaatcattttcacctactttcttaatatttgtatctaccttaaaaaatacttgagggagtagtaactgatgatgtgcacacagcacgcatatatatgtaacccattaaaaaaaatccatggccacataccaaaacaccaaatgctatatacttgaccggaatgcatttcaattggatccaatttaaatggctgacccaatatatatcaagaagattaattttcctaaaagaaacatgcatgactccatccttttactagctgcatgttaatccaagctaagttgtaattccaccaatatataatcttactgaaagcacgctaaatatatctttacctttttttaagactaattaaatataatgcctgaaccctgcgcccttcgccagtagactatcacacacgcttacacgaggggatggctaggaggagcttaggaacaggtgatgtggtaataaatcacaaaaaaacaacatggcgcaaattgcaactactacctggcaacaatttgaaatagctgaattaatatgcaaatttgaccggaacaacagaacaaaaacattaggaagcttccaaagctgctcatcaatcgagcacttatttcgattagttgttgctctcactgcaattttgggtgatgatatatgcgacgcacgggtataatggtgaactccatatcatcagctgcataaaatgacattaattatcaggatcatagtgtacatgttttatgtgttgatcgaatatacgacactcgtgattggccgagcagaagggatcaatatatgtttaagcctatgattaattgattataatgatcataccgtaattaattgttcctcttaagtgataagctccatatatatgtatatggctcagaaatacgctgcatgacaactgtgttagagataagtgttgtacttatgttttccagtcaaaatagcgtacttattaaaaagtttccgctgcctgcaggtggcaattgagtgctcagtaagtgtatacgtacacagctcattttttggcacaaggtaattaaatggatttattgtactgatgatgagtcttcctcgtttgcaatgactatgtttagaagtatctgagagatacagctcgtagaattaataggggagaatggagagataaggcttcaagtccactgtttaaattaaaacgttacacattgcattgaatttacttaatttattaattttgggccatgttgttttatgttaattttctccctatatattcctgctccctaggcttatagatgcaatccacagttagccattggagcagtaagctcctactaccaacatgtttccttctcccggcggtagcagcaactccgctgcaagtgagactccaagtgagaaggtaaataagagtactccattgaaagaaaatttatatgaaatgcttttaacttcattgctgattatttcgttttactgtaagtgttctttatattctgcttgtttgtgtgtggaggacgtcctgaaaaattgtttcattttaagcggttgtttatctacatgtcctcaaccgaccaacaattttagtctggtcacatgggatctgactgattccttctgatttggtcccttgttgaattcatatagattttaaatctactgttaaattgctaccccgccgtcccaaaatgatttcttttaattgaggctatgcatctggacaagtacctgtaagaaataatgggacgaaggtagtaccgtataatttatgataatctcaatggtcttgcaccttaaatcaaacaaatatattactagtcaactccaagaacatactaataggatgattgaattgaaatcggagaacacttttaccactattttgtatacatgggata

SEQ ID NO: 41624 - DNA, 1000 bp, Oryza sativa
aggatcaattggagggattccacccccaaagcccttgtcagtgtgaataccaaaatagtaaattgttctctttgtttttaacttgaacctttgtgaaatacccaatcgcaacaacaaatcattgcacttttgtgtttttgtttgctaccctacagatcttttaactcgcatgatgctcggtttcaaaagaaaaactcgcacatgcttggttgaagcagggatgaaggcccaaattatgaaccctagtccaaagtggtgcaaaaagggtaatgctatgtggtgttaagtgtcctggacagttaggtctgctcttggtctattgtgaaactttggttaataaagataaccaaagtaaaatttactcaaaaaatatatcagatttccaaattaatatgcactaatggaccaatgcaatctttgtgcaagcttggatatttaatctgagcacaaccttgaagtaacagaaagccagaaaatcctcagagaatgtgtaagaaatgtggcaaaactatataaaatttcagaaaagaatactattatgccgagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaac

SEQ ID NO: 41625 - DNA, 2147 bp, Oryza sativa
ctgatacatcagagtggttcaagaacatggatgatgatgatgagtcacccctatggctaaacgtactgctgagaaccgcattctggaggaagtgtgacgtgcatgatcagcttgaaaatacacatagggctgaggaaagcatcttctgcaccaactgcctcaagacaatatgcccacactgcaaacatgatcaaccgagccaccaactcctcaaggtccgccgctacatcttccgcagcgtcgtccatgtcaaggacatgcagaattttggtattgacatgtcttacatacaggtattacttagataaaattaatgcccatgctttgctatggataaaagaaaatatattataatatgcaatagatattttaaaattatcgaatatgttagtatcacttgtttacttgtttgaatatatggtatttacttgtttgaaccaaatatttggactattccataatatcaaaaaaaataaaaataatcaggagcatatttgtaaaaaactgtaaaagcagtggtgaggggacttttaaaggagtatagatgtatagttggcactgtggttaatcaacttggaaagttagtttctctagctccaactagtttaattagcttgtttcgaattaatcatgataagttcgtttgtgtaaggtttgtgtgcaataaatctttgttatttaaaactcctaatttgatggaagcaacaacaaattataatctgatcactatttgcttcatttttcttgtttagtcctagcattagtaatgataatttattttgcgacaatgtgggtttgaaggcaaataggctggtctccatttagagcccttgcaaacccatcctaactggttcactgatcagctagctagaccacacaggtcagacacaatttgacacaactttgtttggaaacaatttgacacaattagagtcgatcaaacgcactgaatttataatgaaatgaacaataatttttatatataagtgattgcacagtagcgtagtaaaggatgtgtcttgcggcctaatactactaggataaatggcaattaatagtgtcccggaggtgaatgccatgatcatctgaactcaacttttttttatttaaattactaccattctgaactcaactttaggctagaaataaaagatttaattttgttcaaacacatggattgattagaaaactgttttagctcatctgaaatgcataatttggtgcatatatatttattgattcaaaatatgtatctaattaatatcatgtagttatgcaagcacatctatgtaatcaaaatatttacaaagatatgtgtactcatataatgcatccatcacatgaagtgatcaaatcttcttatgaccatattacattgtataattcagtaataacttagtgaaatcttgaaaacatgaaagcacacattttttttttgcctttttagctttcatgtcactaagttattattacgatcatatcagttttgataattcagtaataacttagcaacatgatttcccatgaaatctcgaaaacatgaaatcaaatattttctagggttaagttctggacatatatacgcagaaataaactgcgatagttgcatacacagaaatagttataaattaataacataaatatttcacatcgaaacctaatagtgttactgaagaaaatcgatcggtaattactacacattttctcacatgtacatataatagttaatactacaataacaaacttgatcagccacttactcccccatatatatatgtgtgtgtgtgttatcccgcaatgctagctagcattagatcgatccaaaacctccaactgtatcggttcttcaaaaatcttttttttttgcatttgatcaatttgtactaactttttccaaaactgattgcattttctcatacagaaacatactccctgcgtcccaaaaaaatttcaattctagggatgaatctagactcttttttttttttggggggggggggggacggaggaagtacatacaaatacatcttgggaaatcatgcatgtttggtttgcatagtttatgaatatattggtattcatctatgctgactcctgacatatgtgatgggcttaccaagacaattttagggtgtgtttagttcacg

SEQ ID NO: 41626 - DNA, 11766 bp, Oryza sativa
gcacccctaatttagctgttagaccgcagctttcgtgcgtattatttatttgtcatgtttaagttgtactgtgcaacatgtttgtcacattccgactgaacctggcattagttgctttctcatttgctggtcctttgctccttatcaaaataataatccagtttaaactggtgaacattaattattttgtgattgactattgttctatcccttcttttgtttcttattctgaacacaggtgttgcattttctttctgagatttgtgtttgttgatttggtgatttggtctgactttgaaacgataattacctttccctttcaaattattattcgaatattcaatatgtgagttgacatgagtttgctaacttttgttggagtcaattttgtcgtgaattttcattgttatcttgttcagaagtccaaactaacatataaatagtatatggcatccgcattgcaattttttgctttcttattctattgtaacttaaatcgagcaaaactaccaaccgtgatgcaaaatctctatctcagttcacagtctacctaatgagatgactaggagacaaacacaaagaacaagattacacaaacacatgaagttcctcgggtctaggtaattccttcccgccctctgaacacaagttcaagaataaaaacaaacaagaactaagcacacccaacaaccagaagagggggaggaaaactctaggcactcacactacacatggtacaaaaggtgcacaacacaaattgatttatcctcagcctctgtagcgattgaaaaacaccttttcccaattgctagtgcattgatcccgtccccggaaaagccagggtacacttcaacaatcatgatacaaaagacacatatttattgtatcgataatatttacattattacaaaggctcttcaggcctaacaaacaaaaaataaatagcagcagaccagcgggcctacgacaacatcttcataggcgctcaactggggtataagccaagactccacctcggacttcttttctaaagtttcttttactgaaggttggaaagattgagcaagaatgagtacaaccacagtactcagcaagtcaaaccgggagaggcatgattaatgcaaggggtacaaggagtaataacatgggggttaggttaaaaattagtttgactccaaattgaaaaccatgcttctcaacaaatgaaacttttctatggttgacatgtacactctttatttttgctaacacttacttgtgaacatatatctattgtaggaacccttgctaatctaagtaattgatatttgtgatatggagatgacaaaagaaattcctttctaactgtcatgatatttgggattttatctttgcaaaaaaataaatttttgagcaatactccttagtgactatatgattacctaccaaaggccaaatatgattcatcttgcaaaccatatattttggttgcttgacattacattgagccttgtgtgtgacctatgtgagatgcttttcatgctttatgatcaagatcacacacactccacatagattaacatcctgaacttctacactagaagctagtgtccatttcatccatcatccacaaaataaatactcctcgttatttatgtatttttctccaaagttcattcaaaggaaaagggaggcatggctatgcaaaagaaagaaagaaagaaataataaagtcttgctcatacaaatatgaagcatgagaacaaaaagatagccatgccatctctcaagtctcaaaagaaggagaaagatgtgtagaaggagttatcattttccttttccacccacaatcatacacatgcacattcttgatcagaaagtgtgacttgctatctccttggggccccttttttggcctggcaaaatatgtgatgcaggtacaccccgattgatccctaccgagctccacatatatagccttctagaatagggacaattcggcaatacatgccttggtgaggatccaacaatcaaaatgagtgattcaagagagtcatatgaggagtatagctatattttgaaaatatatgaaaaactcaagtgattgacaggaggaacaggaacgacttgagtcacgaccattcgatttatcaattacccaagatggtaagatagacactgcaaagttcataggtataggtgtggcttagaataaattgtatactagtaccataccttgggatgttttattccacaatagtccttaacctttagtcgagatgagtaaagagctaagtgtgggggtttgttgtaatgccccgattttcattcaggattaaaaatcaattaataatgcattttctagaaattaaataaaagtaaagcaatttaatcaagtgaaattattgagggaatttaaaatttcctttaaaaatcatggccgggaatattttgtaatattctttgcgccctaaaatattctctaaaattttcccgtgaattttcagagctcaagaagtaattataataatacaaagttcattaaaccaattaaataaaaacgaaaacgaattaaaatcctccttctttgatttgggccgtttccggcccaagtttcctcctcctcaggccggcctccctcctctctccttccttctcggcgcccaaggcccgtccccttgcaaagttcacttctccttccccaaccgtctcctcctccctccctcgccgacaggtgggcctggtgaccccacttgtaagctcctccttctaccttcggcctccagagccgaagccgccatgcggcgcctttgccgtcccacgtcgcccatgattccggcctctcccgctcgtgccctcgcgcccaaaccgcatgaaatcggtttccctccacctcctctacactctccccatgtttcccccaaaaatcgtgccgggatcgaactccacttggcccatgatgttgcccatgtcgccggccattgccgcccgattctgccttctcgaccacaattttcctcccccgcacccatataatgcatcgcccagctctcctctaccgtttcccctcctcccccgagcttcccatagcctccctcgctctccccatgccatcccccacttctgccgctttccggcgagctacagccacgtgctaccgccgccatagccgccgtcgcaccatgccaccgccaccactggctccgcagcgccgagccaaagcccggccaccacttcccctccccaaaccgccgcggaaaccccgtcgccaccaccaatccgagccaccgccgcctccaggtgcctcccgccatcgagcgtcgcctcgctcagccatgccgccgccacccacagcgccccgtccaccgctcctcttccccaatgcattgccaaaacgccgccgccacgttcaccatctctctccgccaccattgccgcctccagccgtgccgcgtcgcctctctggtccacctcgcgctgcgcagtcgccttccccagcaccgcagccatcgtgcgcagctcggcatccactccatctccctcctccacccccgaagcactactcctaccgcgaacccaagccgccactgccattttgtcacatcctgatttttgtttcaggatttataaattatttaataaattattaatagaatttatattaaatgttctttaatttacaagtgaagttaaatgtgggaaataaaatttcctaaagcatggatggatttaatttttattaaattctccatgattaagtcaactctctgaaaatttctcggatttttcagagctcaattcctaaatgatacaaagaacagttcagtaattatttgatcaataatgatctaattataattgttaagagcttttcttgtttaaaaatccttaaattataaattgttggttaaaaggaattattaaaaatgatcttaaaagcctaaaagagaagatctaattttaatttgctaaatctcaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctctccctcggcccaagtcggcccagtccgcagtcgcagccgcccgcgcgagcgccctcggtcgctaacaggtgggtcccacctgtcaggttcgtcgtcttcctcgcgtcggtcgccgctcgaaaccctagcgccgcgccgccgtcgtctccttccaaatctggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcgtaagtatttatcgttttagttaatttgatgaatctgtatattaaattgtcagtttgtgtacctcggctgattcctggacgaggattttatgcacagataagttcggaaattactagtgaatttccgggcgtgacaagttggtatcagagccatctcgactgtaggataagccaaatggtcaaaccttaaggactaattttccgaaaatatgatttgtgaaaatttctcctttcttccttatctagaattctttgcaaattgtttcgttgtctactcccctctctctttcaacttgagtagttctgagacattgaaacttgaagacgccaatgatgtcaacttatggaggtcagtcaagtggatcgtggaaggaccgaagtgccaagtggtcaagatggaatgaagtttggatcctatcttagaacctatgccaccaaactatcctcgaagaatagttagtagggtagaacgtttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttatctttagtgtaacccctctccttctatcttctctaatatgcaacagatggtgaacactcgcgccagtggaagtggaaacaataacaatgaagggaacccaactcttgctcaagttctggctcaacagactcagttaatgaacatgatgatacagcagatgcagaaccagctcaaccaagggaacaacaatgctccaccgacgcagaacaagttagctgattttcttcgtgtgaggccgcccaccttttctagcactaccaacccagtggaagcgggtgattggctgcacgctgttgagaagaagttggaactgctccagtgcacggatcaggagaaagttgttttcgcttcacatcagttgcaaggacctgcatcagaatggtgggatcatttccggatgaacagagcagaaggtcaaccaatcaattgggaagagtttaccgaaggattcaagaagacacacatacctgtaggagttgttactttgaagaaacgtgagttcagggcattgaagcaaaaggatcgtaccgtggcagagtatcttcatgagttcaaccgtctggcacgttatgctccagaagatgtgcgtactgacgaggaaaggcaggagaagttcttggaaggcttaaaggatgaactgccagttacgttaatctcccatgactatgttgattttcagcagctggttgacaaagtaattcgacttgaagacaagaagaacaggatggataaccgtaaaaggaaaatgactgtattctaggaggcacaaggtagtagccagagacagcgtatcaagccactccaaattagtgaacctttttccgctggtcaaggacagtcgcaacagttgaacatcggtggtgagatcaaatcagagactaatgaaagcaatgaagttaacatcgagcaagctaatcagccggtgccagttcagcaggaccagtctcaggagaataacagtagtggaagggagcagcaggtatgtttcaattgttacaaggcaggccactttgcaagagagtgtccgaagccgaagcatcagcagccgcaaggtcaggtctacaacattgtcgtcacaggagccaatgcggtgccagttgtgtcttcaagtgttacaactcagccaccagtttcaaagcggcagtagttttctttaaagccttagaataattatcggagttatggaataagatagactgcagtttacctattcccttttctttctagccgttccgaatctcgggacgagattctttgtaaggggggtagatttgtcacatcctgatttttgttttaggatttataaattatttaataaattattaatagaatttatattaaatgttctttaatttacaagtgaagttaaatgtgggaaataaaatttcctaaatctaaagcatggatggatttaatttttattaaattctccatgattaagtcaactctctgaaaatttctcggatttttcagagctcaattcctaaatgatacaaagaacagttcagtaattatttgatcaataatgatctaattataattgttaagagcttttcttgtttaaaaatccttaaattataaattgttggttaaaaggatttattagaaatgatcttaaaagcctaaaagagaagatctaattttaatttgctaaatctcaatataaaattgggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctccctcggcccaagtcggcccagtccgcagtcgcagccgcccgcgcgagcgccctcggtcgctgacaggtgggtcccacctgtcaggttcgtcgtcttcctcgcgtcggtcgccgctcgaaaccctagcgccgcgccgccgtcgtctccttccaaatctggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcctccaaaccccgatctttccttcgtgtcaccggtcgccgtgggccttcgtcaccgcctccttgcccctttaaaaggacccccggtgtctcctctacccgtcgccacccttgccttcgtctctagccatcggaagcgccctagtgccgtgtgacctcgagccgccgtcgtcgccgccgctccagccgtgcttcgccgtcgctccagtcgtcgccgtcgctcggggaggtcgccatcatggtcgccaagtcgtcgccgtccccgtccaccgcttcaccgccgccgaagaccgccggagcaccgtcgtcaccgtcgacccgaagaccgtcgccgcttcttcctcgtcgccggcgccgtccgttgcttttccgccgttgttttggtcaccggtgagttcgccgcgtcgccctctacccgttggtgccctccgtttgcgtcgtcgtgccgtcgttcgccggcgagcatgcgttgccgagccgccgccggtgctgacgtcatcgctgacgtagtcgctgacgtcatcgtcgccgttccccgtggctcggtcgtggaccgtttgatctcggccgtccgttttggataggatcgacctcggccgtctgttcccgtgaaccgttgccgtgcacccggtccaccgcaaaccctagccgctgacgcaataattcccttttccttttcaaaaataattcaatattgcgtcataattcaattaaaatccatataagtgttttaacccgatttaatctttaaaaattcataactaattcattgtaactcagtttaatgtggttcaagttgcaaaagttgtgtaaaataaagatctacatattaaaattatccataaattgaattaaatttatttaattctttttaaatgggctttaattatatttaatctagtaaaattcataataaattcatttgaagtcagaatgaggcccttcaagtctcataattcatctaaaattatgatctacatgtttgtttactttttatgtattgtttatttagtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgactactttattccttgataccttgggttattataacttgactagttgggctttatatatattggttcagctagatattagttatgattgcttagccatgcttagaaacattagcacactattgggataacttatgactcactattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagctagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtaccttccagtatcgcgacgcatggtagacatgatgttgaggctgtgtcttgtgggtacagtggtacacctctggccagagtaaaactattcgaatagccgtgcccgcagttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaattcctaattaattactccactgttttacttctcttaaatgttttgctaaaagctgcttttgcaaatgagcctatattatgccatcctttggtatccttgtgcacttgcatatttgctgtgtggcttgctgagtatgtcatatgctcactttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttattgttttagttaatttgatgaatctgtatattaaattgtcagtttgtgtacctcggctgattcctggacgaggattttatgcacagataagttcggaaattactagtgaatttccgggcgtgacacatttgccacctccagctgccgctcgtcgccacttccgaccaccccaagtcatgccacgaccaccattagctccaccaccgctccactggctccaatcaccgctccagccttcttctccctgttgacgtcgtcccggtcgctgtccgtcacctcacgcccgcagtacaccgtcagaccgccgccatcgtcctcaccctgaggagctcaccgccacctccctccgtcggccatctccctccgttgccgtgtcgctcggtaagcatccccctctcctcctcccatcccttccatcgcttcccgcgccaccgctcgccgtcgattgctggtggctgtgcgccgccgcctcttagctgtccggccgtgagccaccgccgtcccctttggccgtgcaccgccaccatggactcggtccatggtggagcaactcctttgacccgctgacgagtgggccccccgctttgtggacgtggtccgcgctcctcctcttgctgacgtcagcgagcacctattttcctttgagaaaataattattaattgcgtcataaattggtaataattatagaaatttattaaaatggctcaaaacttctaaaattcatatctaattcatacgaactctaaattgggccattcaagttgcaaaattcatctaaaattgagctctacatgtttgtttactttttatgtactgtttccttggtttttattagggtttttcctcgttttgcatgccaacgtgtagtttccgcagtttcggaagtccgcggtcgcgaggaaaagagttcggaagatcaaagtgaagaagcaaggcaagtcacacattacccttgagcatattgatgctactttataaatgttttgtcgtttgcaaataaatatacatgttttgctaattacatgggatccgggtattacctatgctcgcttgtgccatgtttacttgttacccgacctttgtcaacctcgggtgataatttatctagctcgtgatacttatgttgtcctagctagaattatatatgcttagccatgcttaattaccactagctcacaaaatgggataattacattattagacatctagtattctgacgagctgtgtgctcgatgtcacgcccggaaattcactagtaatttctgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctagatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggctagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctgaaaaaccagaggcatggactccccagcgacccccgtggacttctcgccacttctcagtctggcgcactataatgaatcacgctat

SEQ ID NO: 41627 - DNA, 6705 bp, Oryza sativa
  unsure (1)..(6705): unsure at all n locations
taggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgatccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcaacaaaattggaaaaaaagagcaacggggaggcaagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaataatttataaatcctgaaacgaaaatcaggatgtgacactcgagacatctggccatgtttcatggtcgtaattatccaactaaaatatgactgaatggtgggctatgggtgcatggttttgtgagtcgcacccatggcaattaaggaccagttcacgggaaaccctagaagacatacagtgcttgccacaagcgggagtgggtaactgcttgatctgaagtatagctcaaccctttcctaggcatcggtggcaagggtgggcgtgatggagttaggtcggccggggtgtccggttgtctagctgccggattcaccgcagcgcacaaggggactgcccacctccggggtagggggtgggggtgaaaccttagagtggtgtggatggttaggggagggttatatgaagggtcttgtcacaatcactcgacatggtgatgtgtcaggcctggcgcggtgacatgacgatggattgtgtcttgtgggaacaattgtgcacctctggccagagtaaaactattcgaatagccgtccccgcggttatgggcgatcgaccagattcaccgtgattagtcccaccttaataaattgactcaatgcactgtagttcaggtgggttggttggacctgttcaacgtggtgtagcgttgatcagtggagatttaatgttactttaattactcaacagttttaccgttttgctcaataaaatgttttacaaccgcctttatgcaaattgccacaaaccgtccttgtatccccttgcacgtttgcatcgttagtgtggcttgctgagtacggtggttgtactcagccttgctattgttcccccttttcagaagtgtagtgcttctgagctgaagatgaagttagaggatcaaggctcataccccagttgagttttgcctgtggagtggagctaaagcccagctaggatcgcctttttccgctgctactggttttgtttcggtgtgaggactaagtgctcttctgtaagtattttacgctttatttacgtttggaactatatattacttgtcgttttgtgtaccctaactggtcctagatagggatttaatacacaaaatagtttgaaaatttgggttaaatttctgggcgtgacatttgttgacgactattaaataccaaatttacgtcgtcaatacctgcataaatatgaaaatatagaacatccaacatagtggtagggtttatttctaacaaattccacgagtgttggtatatatttggatgcatgtgataaattacaaaagttgagatgaaatgtacataaaggagggaaagaattacattcgtatcgaagcccatagactcttgggcccataaacccaacgaaatacctgcaactaggccaaactaccatgccaatgaaataaggacccacatgccatggcctaggaggaaggagtgggccaggggagccagccaggggtcagtcgaccacgcgccgatctccaatggccgcgtgccgtgcggctccgaaacagccacgcagctgctcgtaagtcgtagccatccctcctttgttttccctcctcgtccagtccttatctccttcaaagtgattgagccgaagttcgctattcctctgtagacatcaagagctaatctcgttttcatcccaaaacttctcctgccagatccaagtccggctgtgcagccgtttcgccggcgtcaatcttctgccactgcaccacggcaccgcaggaacacctctcatcggtgagaacatccccaacctttctccccttctttccttgcttgtgtcgagctcccatcgtgctcctgtccaccaccatggctaccaccgtggtcagtttttccggcgcctcatctatatcaactaaccacaaaaatggaaccttctcatcccggaacgcattttgacacgctcactcgccccgttcgccaccggagctgccacttccatgcccggtgtggcggtgtcaccatagctccagatctggaactcgcgttccggctagcttcgttgtcttccagcccagcgtccacgtcctgtgggggtgtcagcctgtggaacacgtcatgctatcgtatccgtcgccgttccctcactggagctctagagcttttctctcacctctgttactcacgtgaaaagccaccggaagaagatgaatggcagcactgtttcctattggtaccatcaaaaccacctaaatagtgcctaaccacagtaaaaccagtccaaacaattctattatgatgtttttctcatgttcgagctctaaaacaccaaatcaatttcagttttcacccttgtcatctatagcattaattgcaaattgcaatcgctactacatataccatgaatcataaccctagaataaatcttttgtcatccaaatcaagttaactcttgatttatcattttcttttgttcgggctccgattcacaatatttattttatcgtttatttataatatttttattataggcttatttggtcgtttcttcgtgtgcgcatgttagatcgtgttgaagattccaccggattcacaggaactgaagtggacctagaaggctacgctcaagcttcagaaggccacgttccacaaggcaagccacagttccaatctttgatcatattgaaatatagtagagaaccacttagttattttctgcattgagtatttataaaattattttgcgtatgaattattttttaataaacttgttagtttagttattacccattattacattgttattattggccaaatccatgaattgctatatcacgtcctttgataacctaggtgtagatttatatacttcacaataatattctagtggataagaccaccaaatatctatactcatatacatggtttacccgtcgtcacgtggtagcgtgtcgggtgatataaaatgtgttatttgatatgactcactcgcctggagtgatatggaagaacaattccgggggaagatggatgctgtggtatgtgaggccgtgcatattgttataatattttgtggaaagtgtatattacacttgaagtatgcacggacctatgctagttttggtggctttccccggatataaggactaccctcttatgccatggaaaatgatgtaatttgcgcccatccacaggactgagtaattagacttagcctagtacattgtcccactatatgaaagactgtagggtggctctatgagcaggtttggggtggacatgtggaaggggcttcggccaggttgacatgatccgcaacggtggaacccgtgaaagcagcaaccgtctagccttgcttaggcccagcaagtgcccgactgctaggacggatcaatatcccattgggcagtaactagtagtaagtgggactctcgagtggctatgttgtcctcagtctagctagctgttgacatcaggtgggtaaagctaggcagtctctacagagatgagtcttaaatcatttgaatgtgctgtgcttccggttcagaagctatgtcattgggtgattcctatttatcatggtatgagtagatttttaaattaaaatatagaatatgacgaagatgaggatgaatggtgattaatattgctgctattttaacatgatgatttacaactgtttgcaaatgaaatgttttacaaagtagggaaaaactatttataataggcttgttatcaaacctccttgatgagttcggacgatcaatccttcccggaggaggtgcaggcaggggaagaattctatggtgctgatgagttcttgttctaggtcgatctgctctcaggcgttgcctgtggtgtttttatcctattttgtgtatgggtcttttgtttgtagggagtgtttttggcctgtcggcccctaaagcctgtcttagttaaagatcgctaccaatccgggactaaagatcgctatcattagtcccgggtgaaataaccgggactaaagatcgatctttagtcccggttggtaacaccaacgggactaaagatggctcagccacgtggccggatgagccatatttactcccggttggtggagctgaccatttttttttttcatggccctgttgctgcatggtttatatatattttatatatatatataaaccatgcatatatatgtttctatacatatatatgcatatataatatatgcatatatatatatataatattatcattgatatatgttacaaaacatatgtacacgcataaaataaatgtatttataaatatatatgttatgcacatacatatgtatatatatatatatatatatatatatatatatatatatatatatatatatatatatatatatatatatatatatatatatatatatatatatgaccaaaatatatttacattatagaaaatgtgtacacatgcatatagaaacatatgtagtcatgtattaatatatatgtatttatacatatatatgttatgcaaatgcatatgtatatatatatatatatatatatatatatatatatatgaccaaaatatatttacattatagaaaatgtgtacacatgcatatagaaatatatgtagtcataaattccttgtgtgtggtctggttatccctcatgcgaataaaatatatgaatgtatgaaattgattagtaattaaacaacaaatcgatacgtaatgaaattttgaatttatttgtacgtacatcgagctctcttgtggtgatgatttggtctgcaaggcagtggcaatactcgcacacgtagtagccgcacaagttagttccctgcttttgctttgcgcagtacaaataaatgacaaacgacgagagatctaattaatatacacttgtatgtatttgaatcggagaaatataaatgtagagcatgtgtactcacaggaaatttgaacttccgcctaagtctttctctccagttgccgcggaccaaatgacggaaccgataccaagccctacatggagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41628 - DNA, 713 bp, Oryza sativa
gggacacattcacatcaaaagaatggagccctttcagggttcgcttgcttgcaaggccttttacgcagctttgtattggcaattggacgtttctgattggcatctgatgcttggttccgtgaacgagaaactcgagttgaagcttcagaccctgagaagtcatttggtgatatacctgcctttttctatcagaattggagaagagagatattagaaaaaaaaagttaacaatagctagtagtctagctacgtagggtgaaatctagtaaagcacaacaaacaaccttatccatcaatatatagcacatagcttgcccactaaacaaaatcaattgagtcaacatgatcatgataaataacagtacttgtgcatatatgatgaaaataaccttgcagctaagtgaacaggtgaggctgggtgcattgtggagccagcactggcaagtcgtgcagcgaggtgtcccagccttaggtctgtgatgtttggacctcttcatgggccttaggtgcactactttgtgcccattgcatttgaatgtctgcaaatagaaacataaagggactggtgtaaatacaagtgatgaatgatttttagtgactcggaatataataaaaggtggtagcctgaatagtgctttagaaatcatttgaagcccatatatagctaggaagaaatgtcgaattcttaaacagtattcaatcccatacagtgc

SEQ ID NO: 41629 - DNA, 8999 bp, Oryza sativa
ggccggtctgaccgctgcttcaccgccggtctgaccggtgtctggtctgaccgaggctcttcagtcggtctgaccgcgggacccactgcggtctggccggtttcctcgaggggaaacccgatttttgccactttaattttgcaaaagcaatctctctctcctttttctgtttatgagctaatctgaaacaaaaatcaacaatatgtccatctttgccacaaaaagaacaagtatatttttcacgatgattagacacattggtagaattagaagacttagcaacacaagcaacaataggaggttttgcatgcacaatattggattttgtagaagatgcactcaaggtagacataataccagcagatttaaacacagttttgttagtatcaggtttaaccaaaatctcaccacttatagcaccaacccctaacacaacaggaggatgtctagaattatgaacataatgattaaaacctaaaccacgattatttgtgctaaccttagattgatctaaaatcatgttgaggttctttttaccatcagaaaatctaagcaaagaatttttcaaataagaaacctctttttccaaattagcacaattttcacaatttaccatgacacctttgcttttatgacacttggggcaagaaagcacttcattgtttttcataacattttccatgtactcaacacgacctaaagcatcttttaaattcatcttattcaaattacatgttgagcaatccaaaacatcatgaggttgttttaactttttagcagaaatcatgttgaacatcaaactagcatgaaaagcaatttgatatttttgcaacaactttttagttaaaaacaactcatccaaagtgcgtgtgtgcaaagcaaaactaagagcaagagaatatttatttttcaaatcatgtgcagcattaacctctctaatttttgaaatttcattcattaaaacctcacaacttttgcaatcatcatcattaggaataagagattttaatctagcaatttcagaattaagagattcaatgataaattcctgttttctatacatcttctcatacttcttattttttgcactcaaaatattaatagcttcctcaaaagcacttacctcatcgttctcacactctgaatcagattcaccacatgccatgaagcaaacaccggagatgttctttcccttagcttcatctccactatcaccatctacgtcgcttagtggctcgaacgcggcgcagacttgatcaaaagccttcttgagattctccttgatcttccttcctttatatgtacccttcgacttgttgtcgttggtcttctcaccatctttgtcttctcttttgcctctcccaagcttaggacaatgcgaatgaagatgatcaaatgaaccacattcaaagcaacgatttggaccacctcttttcctgttcctggcattattcatagctcgagcaattctgttagcaaccaaagccaaatcctcctcctcgatctgttcgagttgatcatcgaatgtggcattaaaaatagcaagaaaagaagacttagatgaagaagcatcaacatccaaagaagaagaagaagaaaccaaagcactcgacttagaatcaactttacgagaaagaacgttcatctcatgtgttttcaattttgtgtaaagcgaatccaaagtcaaagtagacatgttaacagacttctgagtagatgtaactttcatctcccaaatagacatatcaagaccattcaaaaagtggcgagaaatctcagattgtggataattagcatcataagaagaatcaacagatctaagatcactcaaaattttattaaacctagaaagatagtcatccaaggcttctccaggtttcatctcaaatttaatgtactcctttttgaaaagatctcgacgtagttatttaatgttatttgtaccttgatgaaaattactcaaagaattccaaatctcatgcgcagtttgaagatgagcaacacgatcataatccgaacgagaaatctcactcaaaagaatattacgagctttgcaattttgttcaaactcagtttttgcagcaacagtattaataacttcaggaatcacataaggatgataaacttttctccaaatatcataatcttcagccataatgtaagattgcatcctactacaccaatgagaaaaatccgttccatcgaaaacatgaggcttagttgaaaacctagcaggagtagccatggcaaaaactctagatcgataaaagtccaaagaagaaaacaaggctctgataccacttgtaggatcgaatcacaataactaagccaaccagaggggggtgaatggttggtatacccaaaaactgaaacttttagcggaaataaaagttaccttcgaatttgacggatcgcggtctgaccgaagttgtcctgccggtctgaccgcctggttgccgtcggtctgacagagattagatctccggtctgaccgccgagatcagctgccgcttgctgtcaccgctgccggtctgaccgcctcgccaccgccggtctgaccgccgcttgccgccggtctgaccaccagtatatcgccggttagaccgccgaaacccggtgaaatacaaaatgaagaactcttaaagtggatgatgactttattgattctctccgtgtttacaaagtgcaccaacagcactccttacaaaaaaatttgactaaactcgaaaccctaactcaaaactcaactcaattgctctcaaaagcgataccatgaagcctcacgctccccctctatttatacccgagataggcagcctaacgccacgaaccaaactcatactagaagtcctaaacaccttaggaaaccctctagtataagaaacaaactttacaaaaccaatcataccaaatttggactccttccaaattcgactccgcatcccatacgcacacaatgcctccatcgtatgccatatggaatctccatcaaccacgtgcatcaactctagcctaagtatcccgcatgatctctgaccaccacggacgtagtcttatccccaagccgacgcccggtccatcaccgcaaatactctcccgagacatcgagtcacctacagatgaaataaacaaagaaaccatattccgagaccaagctatctccaacttgactcattagtagcaaacaacagtattacatacgtattgtattcatttagaagtcataatcatgaaataatcacagatatctaaacaaacaacccgaaaccaaaaccgacacagagtcggccggtcagaccgcgggctggccggtctgaccgcgcgcataccaccggtttgaccggcacacactacccggtctgaccggtcacatgaaataacagcagtacctgtagattcacctgtaaatccaatcatctccaaaaccacttcgtgaataaatttcaaataacaaaaccaataatctccgatgccaattgttcatcacagaataataatcaaaaacacctttgattttacagatgtggccatggagcagggcggcggcggttgcggatagtcatcggagttcccctgtcacatcgagtgagtccgtcgacatccccggcagccacgcatcgggccgtcgatggcagctacagccacgcagaggaccgccttgagcacttctccgccacagccccaagcaatccggcgcgtatttgttttgtctagcaacgaggtttgtctttactgtcccgtgtgtggcacggggcttcctaatgggcgcgggcgcagccgcacacgcccctatcacgcctctccttagggctaataacgctaattagcagtgatgatgttaattagcggtgatgataattgttagtattagtttttttaaaaaataatacataaatagaacttttaacttagatttagaaaactttcaaccagatttaaaaacttctgactcagatttgaaaactttcaactcagatttaaaaactttcgactcagatttgaaaacattcaaattaagattttttaaaaacttttaactcagatttgaaaattttcaattcaagatttgaatattttcaactcagatttaaaaactttcatctgaaaattcaaaacatttaactcaattttgaaaactttttctcaaaattcaaaaattcaactcaaattgaaaactttcaactaaagttgaagacgaaagattcaacttctaaaataaaaaaatcatgaaaaaaagcaaaaagaaacaaaaaacgcggacgttagcttttccggaaaaaataaaatacggacgtgacttcatccgcacgcatacgcgccagcgccgtgggccttatgggcctaaaatgcacgccgccaacgcgcgcgcgaattagctatcgcgttgtggcaccgtattaatgcagagaattgaatcttggtctgtgtgaattttgaatctcagtattgttcctgaaaacaatcttcatctgtatgagtacttcactagaaattgcaatcttggagtagtttccactggaaaattgcaatctccgtattgttcctgaaaatgatattggtttgactcttaaccaggtctgtgaattctgcgatgatcaaactgggactaaattcagagagaatttggtcaagctcaaaccaaattcagagataagtatagaccaaattatgagagaaatttagaccaaatccagcactatactaccatgtggacatgtggatgattacacatagcatctcttcaataatttggtgttattttttcatgcaacatgattgatggcctctgcatcttttcttcagacactttggcagttctactgcatgtacatgcattttttctttaattaactctaaaactgcaaccaccagatgacaataaattaattaaccacagtgaggagaggaccaacatgaatttagtgcttgcattgacattatctaaaagaagcagaagctaatggagtacaggtttagatcagagtaatcacttaaattcagtgctctgcatatgcagcagatgaatactcacaattcacaagaaacctggaagaactcagtatcctttattgcggcacatttatatcttgttaactttacaagagtattgatgttaactttaaaagaaattgcagactaacgttacaaacaattctgtcaagctagcttgcagatcagaacactctcaaaacaaacatgctacacataggtacagtgaacatgccacacatgtggagtcaagcattttgtcaaaacttgttgtcgcatatacagtgaacaaaattcaactgtgaagaaaatgattcatcaggatctttggcttggatgaatgcagcagattgtggtctgatgctgcatgcaaagttcatggacagttcagttctgtttcaattcaccattgcacatccgcaacgaattgcaggcatatgcaggaccagctgatctgcaatggttggagacacctagtctagtaaacagatcctgatatgttaaccatgaacattttttttaaaggaatattaaccatgaacattaggccaatgtcaaatcgtcattcatggttcctagataaatttcagcagggtcgatttacatcttgcccaaacgattgagcaaatcagacaacagtaggttgggattattgtgacctcgtagcactgaaaattgcagttgcagttatccaggtgacccaaaatgaactgctatcagaaattaagaacaagttcctggaaaaagaagagaaaaaatcgtctgaaaaggatttgggggaagttgacaatttatcgacgaacaataacaaagaacataaaccacgccagggcaccaggagcatatcttcttctccttgttggttgagcatatttctatccatgcatgtgataatgatcggctgagttgtgataagataggattagattttatctctttctgttacatccgttgtcgctgctgttttcctcctgagatggcgtggttgttgctgatctcgtaggcttctgtaaacgccacggtgagggcttttctgccaaattctttcacatggtatcagagcctgatccaatctaatctagcgacgttacttgatggcgtcgtcctcctccactaccagtagtgctaatcctctccagggaagttcggtgagtgagaagcttgggaaaaccaaccatgcactatggaacgtgcaggtttgtgctgcaattcgcggcgcgcatctacagggacacctgactggcgcagcggagaagccagacgctgagatcactgtcacagctgacggcaagacggagaagaaggcgaatccggcgtttgaagattgggaagccgtggattagcaggtcctaggcttccttctcgcatctctatcaagggatgtgctcatgcaagtcgcaacgtgcacaacggctgctgaagcatggacaacgattgagcaaatgtactccacccacactagagcgcgagccatcaacactcgctttgcggtcaccaataccaagaagggaaatatgtcccttgctgagttcttcggcgagatgaaatcgctcggtgacgagatggcagctagcaccgggtgaccggttgaagaagaggacatgatcatgcacatcattgcctgaagtctatctgccgtgattttggtgatgaatttgagaatggaattctacaaagctataggcatgtaatcattgggacatgattaaaccattcatttctacaaagctagtgttgagaggatgtccagtccctctaccgatgtgattaaactttgtaagttaataagcgtcctatgtccatctgaactgtccattctatttttgtattagtgtaaaaggctagagatttttaatcatgtgatgtaactagtcttccatcatgtagacccccgtttttataacaggaatcaatcgtgtaaacagtaccatttccctggatcaagtagtctggtatacacgagttcatagctgaaatatcaaatgcacatacacgagagtctagtgcgaattattacatcataagcctgcaggcgtagtcttaaatcatcggactgtgcggtccggaatacattccaaaagcagaaatagataaagcagcggaattaaggcagcggcatgccattgccacaggcaacgaccgtaactaagacctattgagcgccattgtcttcatcaccctcctggtaataggcatagggatcctccgaagctttatctccggcctctgattaagtttatatttgcaagggtgagtaccaaccgtactcagcaagccaccacatcaacaatgcatatgacaagggtatttcaaaggatggctatggttgttttgcgcaaagcaagtttttgtaattcttttcataagcctaagacctagtattgactgatcaaattttagtaccaatgtttacatttaaacaacgacggttctgtccaccatccattgtgatcccaaggatagcttcccgccattgagtcgtcatagttttctgagaacgtccaccttccctcctctctggaagtggctccaacagcataaaaatcatcatgcaataacccatcccacacaagttaagaatttagagtctagccaagtgtaatacatgtcccggtgctcaataaccgcgagcacggctattcgaatagatttgttttactcacactgcagtggatgtacactttacccacactccgcgactgcccaacacatgagccttatcccaacacatgagacgtgtcacggcaaagcttttcgataacctcgcattggcagtacccgctccatgaacttttcatcctcatgcactctaggcgtacacggtttctagcagtgagaggacttctggcgcacccgggaagggaagactcacacaaatgcattaagttataattatgtttaaattatcacatggcagtcctaccaatggcgacaccactatagagcccctgccttacacatcaagaagccactatgcatggatactgcctccgctcagctatttactccgctaggtctatccccatacgagaagtgtggttgtacggggtcgtttcatgcttaacttcatggctcggtccttaattgaccggggacgatactagtctttcccagataccacccaaatccaccgtccgccccagtctaaaatatgtatttaatttcattcctacttcctcaaatcatgtcattattatcatggcaatgtggagctcatgtctccacatgccgcatctcaattatcttcccaaagataattgccccaagcatatagcatttgataaaatatgagtatgcataaatctagagtagcatttctaagcaagtgtcataattgactaagtactcatacgtatttatggttacaaagatttaaaagtaaacaatattcaaggcatggcataatcacaagtagaatgttcatcattgcatgcaatcttatttgtaaacaaaataatttcgcaattgggatcaatatgttcaaagaatagtgatgacttgccttgctcaaagtcttgcgggtcttgaccttcgcttggatccgcaactccctcgggctctataattacgtgcgaaggaacaatttgaattctattagaattcaaataaaatccaaataattcacacaaaagtcgaacgcgaatcaatctttctaaattgacaacaaagtttgcggaaccactttattcgaattgttgggtcatttaacctaaattaattatttcctagggtctcaacataattatttatttcctaattaaatctaaattcctaccgcgaatcgacctcttattgagattaccggaaataatctataatcatatcaacgttttacgattctaggttataattaacctataattaaattctaattactctaaattttctaaacttcttaatctccctaatttatttcccctttctctttcttttcctctcattccttttctttccttctttttctctcttttctctccttttctctctttatctctctttttctctcttta

SEQ ID NO: 41630 - DNA, 3186 bp, Oryza sativa
tgacggcggcggcgcgtggagaaggagaagaggggggagaaaatggaggggatgggtgtggggtggagaagaggaggggccgggttttataagggcatgggggaggggcgggcggcctcgtggcgacgcgacgggcggcgcggctggcggtgatggcgacggtcgggcggcgcggcgcggggctcggcgcggctcggcacggggctcggcgcgacggtgacggcgatgcgacgacgacgcggcgcggggcgcgaggcggcgacgcgacgggcggccgaaggcgacggcgcggcagcggcgacgcgacgggcgggcggccgacggcgacggcgcggcagcggcgacgcgacggactggcggcgatgggacggccgatggcgacggcgacggcgatgacgatgatgcgcggcgacgggacggcggcgcggggctcagggcggccacgcgcggggcagaggggaggggttagggctagtgacctcaatcgaacacctatggggcaatgaacagtgacttttcctatttttccaatttggttgattttcctattcaaatcttgtcccaatatttctaatttttgcacaaatcaagtttacacaatatttgtgttgctctaacctagattatcactacccatattttatttttatcattatttttatatttaatttattcgaatttaattagggttaattcttattccatcgcacccaaatttaattgttaccaatatggtcgtgataatattttatttatttccaacctcacctaatctttattttaattagttattttgccaatttaattttagtgtttattcctaattaattattccttattcacgatcggtaaactttgaaaccaaattccaataaaataggccaataaaatcggcatgatgcaatttattaaaaagttttttgaaggcccatattttcagagtgttacacattattaagctaaatgtgtgagattttatttcttctggggtaaattaatagtccaaaaggtggaggcaaggcactagtcgaattgttgtatcaaaggttgatcttgcagattgctccatgtatatatatatgctcttccttttaagagtagtttaactagaccaacattgctaataatctcaataaaatattatatcattcatatctcccctatgcaaaattttgttctcttttgacctgataaaattaaaatcttccaagaaaattcaattttggtcatcatccacctcaatatcgttcagcttggtgacgaagtcatcccttagctcgccagcacatgtacataaatgtttgtcaaattccaggtttctgataagtttgaatttgaggtaaactgaattaggattgcataagtaaactcgtaagaacgttgcaacgtaactaataatggaactattccaaatcactatcagagctccttattttacccttgggaagaaggaagggtagtttgcaaacttatcaaatcttctaggacaaaattttcttaagaatgatgaaattctctctctctttaatttacctgcagacacatgattacacaagagctatccgctatcttttcagacagtgccagaattaattcctctcgcattctaacagagagaatattacactcacgttattttgacttatattcattataatcatcacacaagtccagacaaaggagagtgaaaacgtgtaggcatgtatatcacgaggtgtattcatgggcggcgcacacccaggtgtgcatgggcatctctcgatctcaagattcttaacctggagattgccctagagatatcctactcgatggacataaattgggtgtcaggtagttgtaatcaatcttccaagccgtagattgagacgtacggcgtatgaaggagacgagaaaaacatggggataatgcagaggtgacacgcgattggagaagacgagtcggcagtgcaatgcaaacacaattagcttcatccaattcatcacaaatcaatcagtagcccagctagttcagtccacatcgaaaaataatagtgactccatttgctgagcttccgtaaaaaaattaggtttctcagcttcttgctttaatttttttttttgggaaagcaatagtaaaagtttagttttttcagcctttttattgtctaaattttataactgtcaagtctctcgatgagaatattaaatctgaagtatttagcaagctaagatttttaaaaagagctagctactataggctcttcaaacagaactagaatcacctgtggttcctaacaaaatgcttcaccacatacaccaagaaccatattggaggatcacaattttgagcttccaattctatgtatgtaccttgttgattatcccgaagatcatttctagcacacatgtctatgtagtattttagaatttatgtgcggtggaattgtggattataatagaggcctatgtttggtggtgttcttttctcttgaagataaagatgaagatgaagattaagttttttacgtaaaacgaggtagtattaacataagattgattgagttttaattattacaaaattcaaaaacagattaatatatatgatattttagagcaactttcatataaaaagtttttacacgaaacgcaccgtttaacagtttgaaaagcatgccataaaaatcttaatcttcatcaaactcttgttcgagaaaagaacgggaccttagccctgctttaaaagatatttgatcaaggtaaattcttaaaattgatgctgaaatcattctagtggaatgatgcattaagaccatcactttctcttaattagggctaagctataactaaattttgtgatgttacaatattggcatgttctgccatgtcgtgccctctctttacgagagaatcccttatatgccactgaaaatttgtctgatcccttgaatgccactgaaaattggctcttcccttatatgccattggtttaaattttcgctccctctcatcattgccgtccgttgactagtagttgactgttgataggatgtaatcacttgtcatttttttacagaaatgacaaaaataccctttggcccaaacatgagaatatggcccaatcgtccaagtgggccaagcccaacatccctctgatgcaccatgtcagatgtcagtaagcctgaacatgtattttggtactgtgtcagt

SEQ ID NO: 41631 - DNA, 2529 bp, Oryza sativa
ctgctcctgatgtgtgttatattccagaaaaaaaaagtaattatttgggatgtggtgtccactcgtgtagatggggagaagtaacttgcttaatcttatccgttgaaatcaaacaattgcttggatcacctgaaatacatcgggtggatttggaacgtactccaggggatctgcacccctccaatcatatcacgacaaattaggtgaatggagcagactcaacgacgtgatgctttcaatctttggttcttcctttctgttttgacagcggtgcatttttcttatctaccaaggtcctatctgtaaaaaaggcgatcccaggtatttctcaccaatggacttccaggtttgttggtggatgatattttaagaaataaacaattaaaaatcaaatttaacaaaacaacatatatttggagaaaatatcacattactacccccaccgttaaaaaaattacactcacagttcaacaacttaacgggtgggtgagatgtagtacatggacttaaaaattcttagcacagtaagtgtgtagtataataacttgacaattcagtattttttttcaagcaacttagctaagtatgtgatgttttggttaacgattgctaggtgacttcttttcacgatgtcaatatatatgccatcacatagcagttctacggatattaccttatagtattaaatttaatctttaagaattacattgcacattcaatttgcactactagtttggattttttttctctgacttctcaaatgtagacaaaaatataatattttatacatagtaaagtttaatcaacttttagttatcagaacaaaaattgaaatatacttacacaaatctgcgctagtatattgtcaaaataagtacttaaaaattgaatatgtataaaaaaatactcgaagaattaaattgtcgcatcacttcttaacatagggtgtgtttggtttatggcgaaggaggctagggctgagatgggaaacacaccagtgagaaaaaaaaaagaaaggatgggaaatgagaggaattgagagatggaagaggtgaacgtatgctctttttatttatcacgtgtgtcgcctgtcgcagggccagttcatccgaccgattcaatcggatgcaaaccatcccgcttctatagagaatattctctatgtggtgaccatatcccactcccacccttcaaccaaacacgtctaaaaaataggcgaccatatcctatccagacaaatcctattgtataaaaattagcacccaccttacgaatcattatactcatacactcacttataaagtttttacacttaaattgcaccttcagttgtccaaatgggacgggcccaaccatgtcggcctagacaggaaggaactgtggggactacctatgcatttatcgacaaatttttcctcaaaaatttgacagatgtaattatagtacaatcgtagtgtaattacactgtaacttacatataactacactgtaacttatatgtaagtttcacataattttgaatcgttagatctattacaagatttgttttggtgaggaagaaaacaaatcatagcacacacatgtgaaagaatttgttcccatgaccttcattttaccgaaataacatgttacggagagatttttgaaagttacatacaagttaaactatagttgcagtataattacatgtaagttacagtgtaattacactgcgattgtactgtaattacatctgtcaaatttttgagggaaaatttgtcgacaaatatatagcaaaatcggaacggtgggagcccatggcccggccgggccgtgccgtggttgggcctccaccccggcacggcgtggtagcacggcacagcaaagctgcacctgcgcagcgcagccttcctctcagccctgacgccgggagtagccacgaccgccgccagtgaacctagtagttttagtccgttgggatgaagtaggcagcacggcagcaacctcgtttttgtgggccaaacgtgccacttctagccccatgggccaatttttgcccggcccggcccggcccagcacagcatggcctgccaaagaattgggccatgcttgggctcttagctcagcacgtgggctggcactgcacgcccgttggaataagttcactttaggtccttctatttgtcgcccagtcctatttttgtcccttagaccgcaaaaccgggtataacccgtccccaacttatgaacaccgggtaaacgtggtccctcggtggttttgaatgcggttttggctgacgtggtgcctacgtggcttgtttgactaggtctccgtcccacgtggtattgatgtggcgcttacgtggcaattatatctcggaaaaataataaaaagcgtggccccacatgttagctgaaaaaaaagtaattttaaaatggtggggcccaccacatgtcagcctcactcctctcttattccctctcccttctctctcttctttcctttcccctttctctctctccttgccgggcagcagacggcgcgggtcg

SEQ ID NO: 41632 - DNA, 53886 bp, Oryza sativa
  unsure (1)..(53886): unsure at all n locations
ccgcgatggcggtggcagccgtcgcgccgccaccttcttctctggcgtagtgctcgctgctggggaggccccccggaatccgacgccgccatctgtgtcgccgccgccgaccacccggacgccctcctctcgccgccgctccctcctctctcgccgccggcgccgccgcgcgccgctccctcctgtcccgccgccgcacgctgctccctcttctcccgctggcggccatcggggagaagggcgacggatggctaggcgagcggcgcaagagagagatagccgtcgccgccccacgcgcctcgcgcgccgtcgcccaccgccggtgatgcgctgtccgtcgctatgccgcccgccgctgccacgctgtccgccgccgcccgctgtgctggacgccgcccggcgagaggaggaagcagagagatggggagaggcggagagaggaggaagaagaggattggatttggtcattttgagaatgacatttggggtccacgtgggcctcaccattttttttttagctaacatgtgagacgcaccattttaaaattatttttggtgtgcagctgacatgtgggatgacgatttttattatttttccgagatatattaccacatcaacgccacatcaataccccgtgggatggagaactagtcaaacaagccatgtaagcgtcacgttagccaaaccggccttcaaacccgccaagggacctcgtttgcctggttttcgaaagttgggggacgggtcgtacccggttttgtagtcaagggacgaaaatcggactggacgacaaatagagagacccaaagtgaacttattccacgcccgtttcattgggatttaagtgcactttaggtccctcgtcttaacgttgagtttgaatttcgacctcgaacaaccatactagaaatatcgcgtctatcaacttgcaaatctggtgtacccaacctccaaatcaatatactatctggttttttttttacgtgactagtgggccccacatatcaggcctatttcttcttcctccaacctcccctctctcttcatctccgattccccatctcccgaactactactccattgctactgcctgttcctcccagtcagcggaagtgtactagtggatattacatttgcgagttccttaggatcaataggagataatgtatggtttatggagctgtaagtacaaatcatcaatacgttaattaaattaattgctaacaatattcattgctatgattgtgatgcaccttccaaaatttctcaagagtgaaagggagctggatgatgaagccattcagaacatacaacgagacatgtggtatttcatacaccatgaggcaaacttgttgtcaccagcttgggagaaattttttatataaaggagagtctttgaacttcccaaaaaacgagtgtcttactaactgcagtaagagtataatttcaatttcacatacgcgtcatcggtcgagctataagacattgaagtactcggatatgatcgtccaatatctatgaacatataagtgcttcacaattatgtgggttaattaattaataccttccattaattatcgtgtcttgatttatatattgcgcatgtatattaattgcaagcaataataagaaaacatttatcatcgattgctcgatcgataaatatatcctctaagtgtgattcccaaatatgcgaacaaactaaatagattatcaaattttgcaaaaaaaaaaaaatcttcgcaggcgggtcctgtatcatctaagcaactggcgaagtgcatttttactagcgggccatgtagcttaagtgcgctagcgaaggtcattttcgctggtggtcgttataaagcagccgccaacaataacggtctttgctggcggctgcattatgatgcccgcctgcgaaaatgcatcttatgctcgcggtctgttgtcaccagcgaagatgacgcatcttcactgccctttgatctctgacgaagcagtagaccgccagcaaaaaatctgttttggccgccataaaaaatgtttttcatagtagcagtgtagggagcatggtgtggcgcgatgcagctctaagggtgcgtttggttcccgatcaaggttggatgggatatggcggtccatattttgctggatatgacgatccagttttttatttggtggagtggatatggcgatccagttttttgtttggttataaggaagaagatggatttggtgatctttttttttatggttggaggagtaggatggatgagtggttgcaatcaccctttcattagaggtggtgagtatacccccttgaaattcacctaacccaaaaaatatatcaatcactacaaacaaaaaatatctaaataaaataaaaaatcagaaagaaatagaaggagaatggagaagaaggaaaaaaagaaaattggtcctcttcgccgaccgctgtcgcgcctactctcccacccgccggccgccaccgcacctcctctcccgccgcctcctccaggtccagtcgtcatccctagctatcccactcctgcccacaaactaaacacccataaaaaatgggcctccatgtgttctatccacccaaaaccctccatccaaacacacagtgagtgcaatgatcgtgcgtatcataatatgcgcacgcgatgatcgcgcgcgtcataatatgggcacggaacagcacaatgtaggcaacagatatatgatttcgtcaagcctgggaccaagatttattatgaaaaggagaaatatttaaattgaaattttataactgcatatttctccatttcatattatacgtccataatatttccctgcttcatatcataagatttttggcttttttttttctagtcaagcttccttaaatttgatcaaatttatagaaaatatgatagtattttagcacaaaacaaacatattatcaaaatatattcaatgatagattaatgaaactaatttaatatttatatgttactaaatttttctataaaattggtcaaacataaataataaattttgacaaaaaaaagtcaaacgagttatataatatgaacctgggaggttactatttatcaagtattcccatacatgtatatatagtcatcgtcaccaaagagaaaaggatttaaacattttaaagaaagacatatatgcaagattaagaactgaacaacaactaaaaaatgtacaaagtatatatataactacatatctgcctggtaaaaattacagtacacgaagaaaatgtaatgcaaaaaatacaaatcaacattataaacattaaaggaatcaatctctcaagaattcatccatctcctcgatggaaggcatgacgtccaggaaaccgccgtcgtcgacgttccgccttagccaccgtctcggcgccggcggcggcacgacgtggcgatgatggcctgttcgccgccgccggcttccctcctcctccggcgaggccgtcgccgccgtggagtccttcccggtgaggctctgcacgacggacttgaactccgcggcgtcggcctcgacgaacctggtcacgatgtacttcaccgtcatgggcttcacctcctccattctcaaactaggattagctagcaacacttaatttgcaacagatgaaatgctactaatccgaacgtacgttcttaactctcacttcatccctgacttatatagagctggcttactctttcccggtcagatttgtggttggtgcatgcatgtacagagagagagagacagtgacagagggagataattttgactttgtgacgataaagtagaagactgggcaaggacgcagtcatgttcatgtatgctgagctcggtcagggatagggattgggtgcagaccaaagatcaaccccctagtccatgctgcaaaagtatcataaatggcttagcacaatttgacttgaacagcagtacaagtggtcgattggaccttttcctctcacttttgggatttgaccatgttgagagaaaggtattacctgtgttcttatattttatatatgtatgatgatgattgtcaactgtaaagaaatttgatattgaaacagttttcaaagtacctttttatataatttctttcaaattaaatatatatatagtgttgtcaacttttggacataagaccatacatcttattttaaaaactatgtaaatattatttagtttgttctgacttattttactagtcaaggtactttaatttaaggataaattatacttctacttatctgtattaaaatttcgaattagatgaattgtcaaactttatgtcctaaagacaacagtgtcatttatttaaaattgaagtataatcataataactagtaaattaaatctacagtattatggaattaccttttgagcccggtgtgtacacgtagattttgatccattccataaaaatagttcaaaagatcaatatagttaatttgatgcatcatcaaaactatagtccaaatcaaaattttcgtaacttgtttttgtaaatatattagtactatgacattacgattatatttttatgacaacactaggaacatatttcttgatgtataggcaaactttaagcatatcgattatatattcttgaatattaagtttaataacacatgaaaatggtatgagccatagaaactaaactgttgtaaaattatttactatcattcataatccgaagctctagtcgtcgttttttatgcatcaccactactacttttgatgcttgtatatatgatagatataataatttggatgtagtatggtttaattcggtcaaaaatctatatagatcgttatttgtgacgtcactttctttaaatatgattaatctcctagctcgtgttgacttttgtaatcttgtgttttgactggagatgttatatatgcagcgccgtttacgacagtgcgactcgacgccgttcatgcatggacaattcttgcatgcgaagcagcgaaagcctttcttgcatactcctacggaaaaagtacaccaaagatctctcaacttgtcatcgaattacaaaatcgtctcccccaaccgtaaaaccaaatatataacatcccttaacttacaaaactgtttgttttacatctttcgatggttttgaccattgttttgtccgacgtgacggacgagccagcgtaggacccacatgagccctaaatgttaggacgccacgtcatcaggctctctctttcccctcctctcccttcctcctctctccctctctcgaaaacgctttgcatctgccgtccgacggaacgaaaagtatcggacgcttccgtcctaccgcgccacgcagtcaacgctgaaacatatcggcgtccatccatccaaacttatccatccatgtaataattcctctctcctctagccttctcgtattctcctttttctctttgcttcaactaccaacgctgcgccacttttctcaaataaagatgctattagatggcaggatgaggagctagatggagtaagagtcaggccgggcatggatgccaggggagtcgcgagagatggcgacgcatcgccgacggccacaccgcagcatcggcggccgggcaaggcggcgcggggtagggaggaggtgctggatcttggcggcggccacacggcagtggcagaggtggcatggcaggggcatagggtgatgtgggatagggtggaggtggtggacctcgccgctggctgcgacggcggctaggcacagcgacgtgggatggggaggaggtgttggatctaggtgctgatgcggctagcctaggccctggccggagtccgcctacctcgcgctgtcacctccctccgccgcattggtggttgtggtggccggagtagaagaagaagatagaggtcggttcattttgccagagtttttagcgaggttgcaccatattatttttcctgttgcactttattgcattaaagcgtttcattttattttgattcgatgttgcatgtattgattcttcgtgtttgccattggtatgtgtttgaatattgtatttgcccttgtcctcgtctaacaccatcaccttatttgtctctcccatgccgatcgcttgtttccggtggccggattagaagaagatagaggtaggttttgtttgagaattttttggtaatgttgcagcttatttattattttttttactttattgtattaaggtgtttcattttgttttgactggatgttgcatgaattgatttcttggtattgcaatcagtattgttgaatgttgcatttggttgaaacaattttgctcaagcgtttgaaacatttttctctgatagtgaaacatctgaaacattttcattgaaacaatttttaccgagcggtgaaacatgtgaaacattcttcaataatacggtgcaacaccgtccgatctgtagcagcctcctctttcactcactcatctccctctgggcaggccggccggcgaggggtagatgttgtgtgctgggcgtggcgacagtgctgcacggacccacggttgaccgctgcttccaccctcgccactggaccatgctccgggagaacgcccccacagcatccacccctcgccgccgcttccgcaacgtctgcactagcaaatccgtagaggtagacctccccgagctcgatggacactacgtcttcgtccccaaaggcgagggcctcctcctcctcgtcgacaagcgcacgtccgtcgtccgcctgctcaacccgctcacgcgcgcgccacctcgcggagctcccgccgctcatcccgttgcttgaccacggcaccagcaatggtatcttgattctgatggtaataatctccggtaggacacttacatggatatattcatgggtttaagtgccggcctcgccgacgacgctacaatcgccttgcatgccttcaagcccaagatcatgctcggcgtcggccgttgccaagctgcgcgacgaacgatggacgttgccccataagggcaaatcgttcatgtcaaccatatcattcgatggctgcttctactgcgccacaagccgagctgtcttggtagtggagaccggggctgacaaagaagaaaaccacggaccggcgccgtggctggtggtggcagctcccggcgacctcctccccaccacctcaccggccttctccgcccgacgccgcctcaccggcttcgcgccgtgctgctccacatcgccatcgtcccactccgcccgccgccgtgctcgatctccccgtgctcccgccgccgcctcccttcccttctcttgtgtcgccgccgctgcatcaccggctagccatcggacctcctcgtccagacgacctcccccccaatgccggccgacctgcctaaggggagatgagtgagagagagagagaggaggaagggagaggagaggaaagagatagcctaatgacgtggcgttctgacatgtgggcccatgtgggtcccacgttgactcaccgtcacgtcggacaaactgggccaaaaccacccaagcatgtaaaacgaatggttttgtaagttaagagatggtatatatatgattttatggttggggcatgattttgtaattcgatgacaagttgaggtaccgaaggtgtattttttcctactcctatttgtgttcatacttcggagttcaactcgtcatatggcctccccgcaccggaatatgggcttgatgccgattgggctagcatatggaatatactcccgacagattattgggctgggtatcaaattttacatcctagcactctccacaggaacccaatttccaaaggggcaattgagttattgccctacttcgatatccaaaattgattttgcccatgttttttattttttcgattttacccctaattttttgaaatgaaacagtcgtttgcccatgttccgttaattcttactaaccgtgttaaatgtaggggtaaaaagacaagtatatccttagatattttcctgtacttttgacataatcaaaatacaaatctatttgatgccatactatagcagtaaatttatcaaaattttgtgaaagtttgccaaaatttgggacaaatttgaaagtggtgtacaaaagtaccggaaattatccaagggtatacttgtcctttttaccccacatttaacaccattagcaagaattaatggaatatgggcaaacggctattgcgtttaaaaaagtagggggaaaaacgaaaaccctaaaaaggcaaaatcaatattggacctcgaagtaggggccagaatgaaattgccccatttctaaaaggctattttaaatcggaaaaggtctgatcattcctcaaaaataaactgtgtatagagcgtctcacaactatcaaaaccaaatcaagtccctcggttgttttagcggtgattttctcctacgtggcatctacattgatctattttttatttgatgcaacacttatgtgtgattaccgctaaaaatgtgatgggatctatatgtcagtgcaaaaaaaactcaaaataatctgtcacacaaatgttagccacatgtaaaaattatttttttttaaaaaaaatctctattccctctccctcctccttggtcctcccctctccattcttgccccgtccacagtgcaccaacaacaccactgtgcgagaccgcgcgccccagcgagtctacctctgtgtgggaccaatacgacctcagcatcgcgccagcaccattctacgctacaagattgtcatgcgtgtaactaatgcggttgcgtctgcttacacccccttactctttttgtgcgagttcggcatgcccagctctgctcgaataactttttcttcctagatgcccagttcgccttcatgtaacccaatgcgtcagcctccttctaccgccggccccgaccggggtaccaaggagagaggtagagatactttttttctcatgtgagtgatatgggttccataaattcattcaatttttacgatataattaccactcacgtgtgggtctttttttattttcttatttttctcaatgacaataaatacatgtaagcgctacgtcagacgaaaactaggtcaacttctcacatagataccatgtagaatgaaaccgtcaaacgactggatttacacttgtgttttgatagtttgtgggcgctatatacacgtaggggtgggcatatttagaccgaaccgaaaaaccaaaccgaaaagaccgagaccgaaaagaccgagaccgagaaattcggttatctattcggtcccagccctcaaaagaccgaatttatttcggtcatttcggttattaggctcgatcggttaaccgaattaaccgaaatgaccgaaattttggcccaatagacctaggaagcccaataagcccactaaaataaaccctagaagtgatactagccctactactagtgcagcctcctcctccagcccccaccacgccgccgcctcctcctccagcccccaccgcgccgccgccgccggctccaccctccaccgcgccgccgccgcctccaccctcccctgcgccgcggcccgcctccgccctccaccgcgcggtcgccgccgccgtcctccaccgcacgaccggcgccgccgtcctccaccgcgccgcggccgatgccgccgtcctcgactgtgcggcggcagccgccgtcctccaccgcgcggcggccgacaccgtcctccaccgcaccgcggccggcgccgtcctccaccgcgccgtggccgacgccgacgccgccgtcctccactgcgccatggccgctttttcgttccaaactctcctcaaaaatttcggtcagaccgagaccgagaccgaatttgccggtcctgagtttttttggatgaaattcggtcctgagtttgcgaagaccgaactgaccaaaaaaccgaagaccgagaccgaatttttcggtctgaccaaacgcccacccctatatacacggatttacggtgagaaacacgcataaaaacatggactttttcattttaaatgcatttctaaaaagacaagtatatgacgtcatccaattatcatcatagtactctttaactaattttctatgacaaattaaacttcaaagcagtttacctcacatatcctccaacttctaaactagacctcttaattaattagcaggccccttatccatagtggtaacacatacaaaatgtgaagaatatgggtaccaggtatctacatggcctgtctaaacaactagggataggaggtggaccatatccatatactatgtaataaagtcctcaattgccatgttgccttatatcacacggcaaggtatagatactggctaaataataccttgaaacagaagtcgaagtcgtatctaaataggttttccatttttataaccgccaatctatgtaaggtgggcaggtgggcagggagccccttaagggcaacccagacataacattcagaaactggcagatacaatccaacaaacatgagtagggctaaaccttgagagggccaaaacctatataaatctttatttcctgcatccatccacttttagatcccgtacactatctcctttattattaccaataaaaacactggcacaaaacggtattgttaaaaaactgtcacatgttttttgggcaaaaaaactttcaaatgtaactgtagtatagttgtagtataactacaatgtaattacactatagttacattgtaactacagtgtaattgcactgtaactatattgtaatctctatataatttagatataaagttgcatatattattttaatacttacatacaagatattatagttatagtttaattatattacaattatattatagttagatttgaaagttttccttaaaaacttacagcagttttttagatagtcccacacaaaattccaataatcattatactggagtagaaatgtacctactcctcactgttgccttatataatcacaccacagtccacactgccatcacaactcacaagtgaccatctctctaacaagcaaacccatgcacacagctgatgggcaacatgctaacatgcttggccaattattccacagccacttcaaccatgaacaccaccatccggccacagaattctcactgctccatcgagcttcttctcacaaaaaccatccacatcatgaagcggcggcgccgacgacggcgccgcaataacaacaaggagacaccaccggtaggagatcgccggagagcgccgccgcagagcgccatggccaccccaagagctctgtttcttcagaggaagattcgtgatggcagcgagaagaagcaattacctgcagcagcaggcgtcgtcagggtcaaggtcgtcctgacgaggaaacaagcggcgcggctcgtctccctcgccggcgaggggaggaggaggaggaccgccgcgcagcttgtccgcgagctgaggaggatggaggacggcgccggccgtgtcgatggctcgccggcgacggcgacggcgacggcgtggaggccagtgctcgagaccatctccgaggagtggtaataatgtcaaatgtattatgtataaataatgtgtgtttgtgcatgcttgtacagtgtgcatgcctgcatgttagttatgtagtaagattcttttttctttgtatggtttggtcgtcaatttaggttgggttcagaggtgaggtaaacagcacaatatctactatccctcccatatgtatgtacccagattcgtgagacatattacatggtaaattggtcatggacaggtggatataatgttcatcatgctgggagacggaaaaaataagaaacaagaggatatgttgtctacttgtctcgaagaatgaaaacactttcccatcacgctgtggtgctagctacggagtactaactagatactgtatttcccttctttctgtccttgaacttctgatttgttcttcatatgtcatcactactggagaaactatcttttttcgtgggttggccaaaaatcacaataatcctggtccaaaaatcgagactaaaaaccatttttagtcccgattcaaaagcccggggatacgttttatctttagtgtcccggttgtttataccaacggggaccaaaattgaaataaaacggattgaaaaaaaaggcagccgcactcccttggcaaccgcgcgtctcgagtcttcttatcccttcgctactactcatcctcttctatccgatttctttctctccttctcactcctctcctcctcctctcgatttctctcctctagagtgcagggcggcggcaggccgtggcgggtggtggtgcacggcgggtgggcgggcggaggggacgacggcggcaggcggaggggagggcggtggcaagcggtgggcgggcggaggggaggatggtggcaggtgcagggtgggagggcagaggggtgcgcagcggcaggcggcggcctggcgggcgtagggaagggcggcgatggcccggaggggtcattggcaaccaccgaatgctgcgccggatatgacgatgtgttgtttttgtgatatacttttaaatgtgtggtgctgttgtagatttattttattgatgtttttgtgaatttgtgaatgattaatttttgttgttgagtatgtgaatctgtgataccaattatctgtgaatgtttatttaatctgtgagtttggtgcgaaatcaatatgcaaacaaaaaaacaatgaaaaaaaaacctttagtagatggtagtgtcacgtgggggtgctaacatctttagtcctggttgatgttatcaatcgagactaaagatctatttttagtcccgattattttaaacgtttcgaattggtagtcccagataagtacccaggagtaaaagaggttctgaattggaagtaaagatgggttttccgaaatgttagtgttgtttggtgagcacaatacggtttgtactacagatcgatctagagaattatttgcattatttaatgaaacggataaaacttctgccatgcatctttgttccaaaatatatgtttcaaatacaaaaaaaaaacaattactctattataaattgagcgtgcaaaatgtatcttgttttgtttatgggttagctagcctaacttactaattctcttgtatatatgcacgctttggcttcttcgtagcatcaacactttgcagggttggtggactgatcgaaaccataacaaatgcttacatttttaatggtgaagaagcgtaacttatggaattggtttataattgattaatttaattttgtaggagcatgtacgcataatttttgtttaatttgctttggaagaagacagaaacggcgttgtatagtagtacgtgtgttggtagtagtgggctaagaggaatctctcgttaattttgtccttgctgagtgttgtggttgttggttgattgagttggtacgtagcgcatggacagacaggggtcaacagcgaaacttaacattaattgtttaattaattagcaaaagatttgtttaatctttcacatttactactagtatgtagcaagtggtggcaggaagttgtgcatacgtacgtgcagattctttccctgtagaatgggggataatgttaggttatatgatgtattttttgtgatgtttagtttctaagaaaatgatagcttatattatattggattcgatcagggcgtagttagctatagagtaaattccctgtgtatccctgaaaactcacttaatccctttcatgcccctgaaatttacccgtcccttcaatacctctaaaatttcaacctcatctctttcatgcccttaccgttacatttttattcatttcactattacgtttggtgcaaatgtcttttttacccttgatgctttaagtttaaatataagcttgaaaaatgattgaaaattttatttgagtgcacagtatgtgcattttataaaactaatgggactaaataattagtgcagaaaattttgacataaattttgaaaataaaacaaatgtaataaattaaattttttatttgaaattttaataagacaatggattttttttatcgggagcattcatacaacaattattgtgagcacgggtagtcctatctttctaggaatgcttctcttttttatgactttttttaaaaaataaatacatatttttttatttcattatctaaaaataaattttaggataaataatgcaccgcacaacaaactcataactataatagtctcatgcgacaaacttttatatttttgataatgtaattaataaatttctatgtttatctaaagagtaaaatagttatttttatagaaattagacagccaactaacggttaaatgacggcatgggtatggaagggatcaaaatcaaattttgagggtacataaggaagtaaataaaattcaggggcataaaagggattaactaaaaattcaggggtatacaagaattttctcattatagagtatacaagggattttctcttaattatagcggggttaggagcaattagaaacagttatgtaataagaaaaacagtgcttgcgtattagtgaaccaaaaacagtgattgcgtattaccctgccagggtatacataccctgcttcatcagaagggagataagaaattaagaaataatgatagatgaacgaaacagatgacgtatagtccatagccatcaatcccattattaattagcaaaagtgcaaaacaactgcacaagtgacgtattgtagtaccatagtcgtccacgtcggcaaaaatttcgggtatcacggtcaatttactattcgtttggcaagtttgacaccgcaaatttgtggaattagttacgagattatggtgaaacttagttttggctttgctctcagaagtcacgaggcagaaagttgctgagatttggcagttttctcaatttttttaagcattaatcttggctaacaggcaacatgatcgagttacgtacactactaagcatacgtccactgtccacaaaacacaaggatatatgcttcactgtgtacttacactgtagggttttctttaagaaaaaaaaaaggcgataagaacgagaaatttgtctccttatctgttggacctattattttcaatgaaagatagccaatgataactaaacgaatggatgattcataattggtggcgatgacgatggtaatgataattatatatcacatttaataataggagttcatggttaactcaatgtgtatacagtagcattagcatctctagccactagcagccagtttgaggtcgtgtttttcattttgtgtttttggactatagcatgcagttatatattgtgcttacctgctcaaagataggtcctcgttttgaaaatatgttgcgatactttttcaataaatttggttaaagttaaatgaagtttgatttataaaaaattcaatgcattttatgttatgaaacaagtagagaagcgactaaagctggcattacaagctgattacatagattgaggacatacagaatcagaaacataactcggtaatgccaacattttaagagaaaaaggaataaagttaagtcaccaaatgtgctaacagcccggcactatagctacttcaattttgtgagataaaggaatgggacaaatttaaacgagcatgcctgttatttgttgggatgaggaaataggtagagaaattaaaaaaatgattgtgattagctgaaacgatgaaataggtggagaagtagttatattataagataaaatttggatgctataagtaactacataaggacggaggtacgtagtagtattgtttatgggaaaattgctttaacgttgctcactaataatttttggattatcagatttattgtacgagaattgcatggttatgattagtatgtaacatacttggataatatgttacattgttacatatattcaaatacttacatatttgttgctaaaataagtgatcagattttgaatacgagcagtagtgtttggtggaacaaatagttactattcacaagccatccaccaacaactatggtttcactttcaaaatcgcaaaactacttaagaaagcaaatgaacaatctcgagccaaaatgtatagatagtgtttctttttagcacatacaaagatgaagataaatttcactgtatgtcgagtgtgcgtaccttttcaaaatttgccattatgttcgtccattttcagaatttgtcactgaggatataaatttcttcgtaccattcattttgcttgtcagccgcaagcaccatccgtgcacaccagcaccatcatgacaccccacggcaaggagccattccacacgctactgttgtaatattaacaacgccatgaacagcgacaagaggcccaaccactactcacaaccggcggcaccacccatggcatccagaaccactggagagacagaaggacgacatacaagatctaatcgaataggccttccatcatagactcgcagcgcgtgtaaagcgaggcggtgccaaggatatatgtggtggccggtaagtggcaggttgaatgatgtcgtccccatccaccaccaacttgtgtgtctctgtacatgtattcaccaaccaaccatagcggtatgacaactgtgtagcctagtcatcgtagtagccaatgcttgccatgcctgcacctcctcctcctcctcctgcttctttatcacaggatctagaagaggggtgcttggagtgcggggtgtgctatcaatgatggtggggcaactaggatgtgatgctgatggattggaattgaaagagagggtgcaccttcagggctcgtgcagcggtggtgcatgagtggggtgctttcttcaccttaggcaactaggatgccgtcggggatgagagtgatggtggacggacgacgctggtgctgatgctagcgaacaaacgaagtgactgatgaacatgatgttggatgtatgggatggcacggggcgaatgaattcgcattcctagtggaaaatttttttaaaaaaaacacgtgaattaggtggcaaaaaatattgaaagacgtggatattcggtggcaaatagtgaggctcctctgatttgtaggaaaacctgggaaacttggaggaatcaaatcctatatgaaaaaaatcctaacaagttggatcaaatcatatccttttctttaaatttcctatggaaggaatcatcctataaaaattttggatcaaaataagcttgatgttctccttgacgttttcttctttctataaccccaaatttttggaactatcaagtgatttttgttccgtaggaattcaattggcatgatattctatttctactttttttttctattcatgtgttttaaaggggcaggaaattccttcaaagatgaatgggaaatgctctatctgttttcgtcgttggaaagcgtaatcgagaatgccgttagctatccgaaggcatcgccgtcgtctccactctttcccgccacgccatggctgccgccgtcgccgccctccccggcaagctcccacggcagccgccgccgccgccgcctccaccttcacctcccaattcgaccttcccgcgctacccgaagtccttggccgcacaccccgcgctctcctcgagccacccctccgacgtgtcggcgctgctcgccgccgccgcgcgcgccggcgacctccgcctcgggcgcgcgctccaccgtaggctcctccgcggggacctcctcgacagagacgccgtcgtcgcaaactccctcctcaccctctactccaggtgcggcgccgtggcctccgcgcgcaacgtgttcgacggaatgcgcggcctgcgggacatcgtctcctggacggccatggcgtcctgcctcgcgcgcaatggcgcggagcgggagtccctgctgctgatcggcgagatgctcgagtcggggctacttccaaatgcttacacactgtgcgccgtggcacacgcatgcttcccccatgagctctactgcttggtcggaggtgtggtccttgggttagtacataagatgggactctggggcacagacatagcagtgggcagcgcattgattgatatgcttgcaaggaatggggatctggcatcggcacgcaaggtgtttgatggattaatcgagaagacggtagtcgtctggacgcttctgatttcgcgctatgttcagggcgagtgtgcagaggaggctgttgagatttttctagatttcttggaagatggctttgagcccgataggtacaccatgagcagtatgatttcggcatgtacagagctgggatcagtcaggttggggctgcaactgcactctctcgcactccgaatggggtttgcatctgatgcttgtgtgagctgtgggcttgtggacatgtatgcaaagtcaaatatagaacaggcaatggactatgctaacaaggtattcgaaaggatgcggaagaatgatgtcatatcatggactgcactaatatcaggatatgtgcaatctggggttcaggaaaacaaggttatggtgctgtttggagagatgttgaatgaaagtatcaaaccaaaccatataacatattccagtattcttaaggcctgtgccaatatttctgaccacgattcaggcagacaggttcatgctcatgttatcaaatccaaccaagctgctgcacatactgttgggaatgctctagtcagcatgtacgctgaatcaggctgcatggaggaggctagaagggtattcaatcaactctatgaaaggagcatgatttcctgcataactgagggaagagatgctcctctagatcatcggattggaaggatggacatgggcatcagcagttccacatttgctagtctaatcagtgctgctgccagtgtaggtatgctaaccaaaggtcagcaattgcatgccatgacactgaaggcaggatttggatctgatagattcgtaagcaactcccttgtttccatgtattctaggtgtggttacttggaggatgcttgccgatccttcaatgaactgaaggatcggaatgtgatctcatggacttcaatgatcagtggcttagcaaagcatggctatgcagaacgagcactttcattgtttcatgacatgatattaactggtgtgaaaccaaacgatgtcacttacattgcagtgttgtctgcctgtagtcatgttggtctagtgagagaagggaaagagtacttcagatcaatgcagagggatcatggactcataccaagaatggagcattatgcttgcatggttgatctgcttgcaagatcaggccttgttaaagaagcccttgaattcattaacgaaatgccactgaaagctgatgcattggtttggaaaactcttctcggcgcttgtaggagccatgacaatattgaggtaggtgaaatcgctgctaagaatgtcatagagcttgagccacgagatccagctccatatgtccttctctcaaacttgtacgctgatgctggtttatgggatgaagttgcaagaataaggagtgcaatgagggacaacaacttgaacaaagaaactggcttgagctggatggaagttgagaacaccactcatgagtttcgagctggtgacaccagccatccgcgagcacaagacatctatggtaagttggacacattggtcggagaaatcaaaggaatgggctatgtgccggacacaagcattgtgctccatgacatgtcggatgagctgaaggagcagtatctgcttcagcacagcgagaagattgccgtggcatttggtttgattactacttcagcaccaaaaccaatcagaatatttaagaacctccgtgtttgtgctgattgtcattctgcaatcaaatatatgtccaaggccaccagaagagagataatattgagagatagcaacaggtttcacaggatgaaagatggggaatgctcgtgcggagaatactggtgagctgcacagcgcaggtttgtctttgctaatgatcctgatccaggcttaacacagtgaagcttttcttagatagttgtagttcataatttttgtagttgctttgtatagttcataattttttagttgctttctgttttgtacaatcacatgttggctacagacttgttgtgttggtttgtcagactgctacatgatttgtacagttacatgaataaataatttttatttcggcagaattctctactcatcatgtagtacttatttctgtagcttaatatttttctgaaatagtcgcctgattcataaatgctgacggctttaagaacacagggcaacttttttgtttttaaaatgaatatcgctaatatgtccacagccaaacagttcaacgttagagggaaatctaatctcagcattcccctttattgtgtaccgtagaaaacgtccagagataatttagtagataaagagttttgatatgatttatattgcatataacatcctaggaaatacagacaagcggacatgtaaaacaatacaagatgaaagtaaccaagaaaattgctggaaaaactgctggttcgatcagctaccgtcttcaaacccaaaaaggaacaggatgaacatatccagaaatatgttctaggacctcgcttcaccagagcaaattcatttgatttggccaacgggccagaaccaacttcatacaaaggtggaagatgatcaaacatcaaacagcaccacagatcccaaagcatcaatagtttagatccatgttttcagccatcaaccagatggaaatgcctcaggaatggatggaagacctgaccgaaaacattcttccattcatattttctaacaggtcgtcagactgatcttcgcagttctggtggaagttgcgcaacatgcattgaagaatttgatttagcttggtgttgaagctccatcatttcttccttgctgtactttattctttcatctgtcatagaatttatacaaacttacagtcaatatactcttaattgcatggcttcatctgagatgtattcctaatcaaaagagaaaatcccttacctacaaagcagatttcagcaagtctacttgggccagccgaactttttgccacttttgcttttacctgttgaggttgtctagaggacttgtgaagatgcgaagtaccaccataatttgcctgaagttcctgtataagctcatgtctcacttcaatcacagggtgacacgtacagaatgctgaaattgcatctcctgttaagatccaacagccgcttaaatccaacatacgcagcgtggcagggggaacaaactttctaagcccagtggtggacaatatattcccacagaacccaagatgtatcaaatttgaggcagaagacagtgcatgcaaggcaggatcagacaagaaatcactttttaggaacaaatatttcagtgctctaagggatgctaagggaggtataacatcatccatcagctgtgtattattcaaatttaggctttccaggtatttgagttcttcaagcgcagagagagacagtactttcacagagttttccatcatgaaacctgcaacatgattaaaatgagttactcgaagatgaggtacactgatattatcatataaaatgctgggcaagagaatcacaacctttgatacatgtgcgactcaggtttaaaattctcagtgaaggcatcatgcttatgtataataaagcagaatcatcaatttttgtatgagctaaagacagtgttgtcagacttggaactgttcctgccagaacacacagtgcttgagaagttacttcagaattactcaggctcaaaaacttaaggttcattccaatatttgcaatatattcaattgcatcgctaattattctgctgtagctaaggtccaagtgctctagattcctcatatttcccaagaaatacaagttgcttgaagagcaacttgacatatccaagtatgtcagtgaacttggtaggatgcttgaaaaaacttcatcaatgttgccaaatgatgctgcggagataatcaacttttccagatgaataagaacttggaattccccattgcaaatagaatgaattgtgcagttgctcatatttagacacctcaaggtcggaagaattggtaagcatgtcacacgtgtccaagaaatattcaagaagctcaaagatgtaaatgcaataaggacagaagctccctcattggtaatttcactgccccatatatcaaggtgctcgagctgtgtcaatacctagagaaaaattcaactaggaaaagtttatacccaatagatatcattaaaaacaaatcaccaattactagcatgctgacagcctaacatgaacataccaaattaaaaagaaaaaaaataaagaccatatgatgatgttgaaattttgttcctgaaacaaaatggctgtgcaccatgagtatacatacctgtaaagaccgtagtgctttgtctgtgaaacgaactccccccaaatctaataaacgtaagtttatcagcgacgaaatggccataactccattgtcagtcaacccggtttgcgaaacatgtagcttctccaagctttcaatggaagcgatatgtttgatgccagcatcagagatcttggagcaccttgacaaatccaactctttcaacgtacgcatacctacattatcatcacaagagtatcgcgaaagctagttcgatcgaggtctccatgatagatacaatcgtgattgagaaaagcttcaagtattgtaccggagagcgcccagaccgcagaactgttgacgttcttgcaatccgcaagcttcagaaccctcagataccggaatgctcctaggtaagccagccactccgcgtcgacggcgatgtgaccgctcagatcgatctcctccaccgagtgctggaaaaccctgcacacacacggatcaagaattcatccacgcgcgaaaccaaacggagattgatccatccatttcggccctgtaagtgccgggggggggggggaggaggaggaggaggaatcggggggttactcgaggagggaagggaagaggaggcggcgggcggcgaggcggcggaggagcgcgtcggcgagctgcgcggggaggcgctccagggagcggcgctggcggcgccacgcctccacggtggcggccccgcccgccgccgcgtcgatgcagcggtcgaccagcggcgtctcgccgccgccgccgccgccaccggcggaggcggaggcggacgccatgggcaagacggcgtcgccgcggcgcgagctcaacgggagaagtggggggagagagagagagaggattggatccgaattgactcgtcgccggtggcgagaggttggaggagggtggaagcggatgctctgacgtggcgtgtatcccgcggcgttggctttcatctcagccgtccgtgtcctttcctcctggagaatgaaaatgcatttaggacagcgagatacggtcttcaaaacacaattttgacttcttgtttctataaaaatatttattaaaaagttatatatgtatacttttatgaaagcctttttcaagacaaatctatacatataatttttacattttcaaactcaataacttgatagttattcatgatttatattttaaggtttaacttaaatattgtcataaacgaggagtatgttagtgagaaattccctggagtgctcctcgcaacacacacgggaaaatgtgaaactttcttgtgtgatcgagttttgctcaatccttcacgtgtaaaaaaaacaaaaaactgaagggagagacatatcttcttttaagaagatattgaacgggttagggattaaacataagacctcagagccaaaaccacatacccctttccactatactatcaagtgtacaactccaattcttcacatatcacaacttatttggataatgaaaaataattctgcccttcagcttgaaatctcaatccacaacttattatattataaagttgagcatttaagttgtagcgaaaagtcatgcataacagaaaaccaacattgtttaagatgaagaagataaacaagcaaaagtcttttgctaaatatccgtctatggctgacgaaattttgtatcactaatatcaagaatacggtatgtcacatgtttgcatagatttatctttatcacactattgacacctaaatttagtaccattatgaaatttgattggatttagaaagatcatatctttccgttgaatgtcaatctaaccgtccatgtatggtaggtctacccggtctatcatacatgggcagttagaatgtgaatttctcataataacatttgatactttcttaggataatcaaagatataccattgacaaacgttcaaatttaagaaatgcgcgccatcgataaatatgagttctaagaaatgtcatcatacaaacgattttatcctaaaattgtcattgccgccgttagggctccatcaatttcacactgttaaatacactattttaggacaaagaaaatatcaattattactattgtatttttatattccttaaaaaggaaggtaattttagtgtcacgtacctcatagaagaaaggtaataatagtgttatgtatctccactatgaacaccgagttttaactccaagtcaaccattagataataacaaactcaggaattaatacaagtgaaagcatagactgtgaagaagcaaggaatttgggaatagggagaagcactaatggtgttcatgcatgactccatccaccagggtttaaatcctaatgcccagaaatattacgcacatataactggactttcaaccagattatactgagatcagagatgtgctgctagttttcatctcttagggcacccacaatggttatctataagctctctacaagagatacatgtcggcatattttcctacttggaagagattaaatgaagagagagagcaaagctatctactaacctggagatagtctatagagaaaaacgaggcaatggattagagagctatagatacccatgtagacatactattgatgtgatttactattaatctagtctattgctgagatgtatatgttttatagagagcaccttactttaccattgcgggtgctcttagagcatgtgttaggagacgcattctttagggtgtgagtgtgatgttgtgtgtgtagtggtgtgtgcgcgtttgttgtgaaattaaaaaaagaggattttaggaattagggaatggataatagagtttagggtggagactggatagagcactgctacactggcccactggggaaggaagacgagaacccaattctgttgctgctgctgcctctttttcatagcttcgacgttgcttgtttgggccccagcccaaagaccgtgacaaagggcgtatgttatcagaatttatcgcaattaaatgaagatagtagctcagtcgcatattaatagttacttaattaaacttgatagggcaaaaggaggacgatgaacaactaaatctcatctctccaaacccctaaaatcatagtattcgaggaggaagaggatgagtatacgtactcgcgttccttggactcttctctacttcctccaaataaccacactctactctctctctaccacaaattaccatttcagaatagttgagtacttgagttcatttcagaccagtttgtagccggtgacccagatgttcgccggcgccggcgccggctgcacgtacacgaacctgaggctcctccccggccgcagcgccggcagccacctcggcggcacgtacccgtacctcgcctcctccagcccccacagccgcccccggagccccgacacgcccaggtgcagctccctcaccgtcttcccccgcgacctgttcgtcaccgtcaccgcgtaccggtagtacgtcctccgcctcctcgcccacgtccccgtcacgttctgctcgatcccgatcgccgtcgccgtcgccggcagcgacgacgacgacgacgtccggttcacgaccggagtcgccgtttcttgttcgtattcctcctccttgaggccgccgcaggaggcggcgaggcgggcgaggacgccgagcagcggcgcgttgttgtaggtggcggcctccgtctgctcgtagttgtcgcgctcgtcggcgaagtcgtcgtactcgtcgggcccgccgacgacggcgccgtcgagcaggttcgggttgccggcttccctcccgtaccacgacgagtacccctcctggcagctcacgaacgacgggtccctcttgatggacacgatggacgcgccgcggtggtgcacctgccgcgggtagctcgcgccgtacccgaccatgtagctcgtccccctcggattatcacccaaaatataattcacctgaaatcaattcgacaaaatttgagtaattcgtcaaccacatttgacaatgttttttttttctcgtgaagtggaagcggtgagagtattgccgaatatattagaaggacagagttgaccctgtttataaggaaaaccggctcaaaaaccatacaattgcacggcctttgacaatgtttttgtttgttttttacctgagatttgacgaatttgaggatgtcgaatggttgggcggcgccggcggggcagtggacggcgccgcggccggagatggcggcgaagtcggcgtagacggtgaggaggaaggaggcgctggtgacgaactggaggttgttccacctctggtggtacatcatgccgccgggggtcctggcgacgttgacggcgcccttgccgacgcaggagcacacaaagaactccgcgttctgcctgtacctctgcagcgcggcggcgtggtcgccggcgcggccctggaggaggaacttggcggcgaggacctgcacgccggggtacttgacgtcccacccgaactggttgatggaccaccccgtcccgcccagcgcctcgccgttgccggcgaggtactccaggtaggacctgtcctccgtcgcctcgaacagccacgccgccgcccagagcagctcgtcctgcagcaagatcaggtcatgtcagcaaggtgttcgtccgaatcctacggcgccgccgccacgccacttaccccgtatccgctgaaggagccgtagtagtttcgcgccaccgtgatgctggcgtcgtacttgccccggtacttgtcggcgaactcgaacagctgaacgcgccacaaaattttcagaggaaatttcgtttgatttcgagctcatttgcgagagttcttggagtgtttggatgaccgacctgcttggagtgcacaaggaggaggttggcgtagccagggtacgtgccgcggaagacgatggacgcggcggccatggcggcggcggtctcggcggcgaggtctgacccggggtgctgggggtcgacgcggaacgcctggcggctcgtcgtcatgtcctccggccgctgccagcagctgtggtcggtgtcgccgtcgccgacctcgccgtagagcacgtcgggctccgggtgcgccttgatgaagtagtcggtgccccacttgacggcgtccatggcgttccggagctcgccggccgccgccatctgcttgccgtactctaatatgctccacgacatcatggtcaccgtgaacgccattggcaacccaaacttgacattgtcccctgcatcataataacctccaacaagatcaacctgaaagacaaacaaaaacacaaacatttgcattgcactccattagaacccaactcatcatatctcctgaacaaattgaacacaatgccattgatggcatcatggttttgatcaaagatttgaaggtagaatggtgcatactccattggcctttccatcaaagaggccagagctggctctccaggagaccctctggttaggagggagaacgccggaccgctgcgcctggaagtagaggatgctcttcctcaatgccatggcatagtcatggccacccccagcaacaaatcccagcttcaccattgatgcaagtgccaagagaccaaacaatgtggctgcaccgtgagcaccaccattcttggccattgcaaaattgcaatgtaccaagaaggtgagtgagtgagagtgaagcagagtgaaggagcaggggagcagaggactttggttggcttggcttggagggagctcaaaagagtgcttcttatataccactggagtggagggaagatcagataaagcaggagattcaaagcatgagaaatagtttactgaactccagggcccctttctcactttagcaagttgttgatggcaaatattattccaaatgcatgcaactgatgaactcctaggtaggttacatcctcctacaaaatggcaagttttgtccatctctttttagtaaactactgactaatatagccacttctatgattgattatattattcatcgatggtcaccatctgttgtgagatatacactgaaatgcgataagcaacattagacagtggccacataatcagggcatgtattttagaaagctttcatgaactccacaaaagtaaacatttggtgaaaaactgaaaatgaacataaatcggactaaagttgctagattgccgatataaaatcatgatatgatagttgtaattttacagttattgtcactgagaaaaattttgtgatgttatggatagttaataaatgggataaagataattcaattccattgaaaaataaataagaaagctacatattacagaagttaactttgcatgcatatgcttgagaaacaagcgattcctcgtgcaaaagaacaccataggaactaccaactttaaaaaggaaataatgcaggcaattgtcttgcaattttgggagtatctgtaaaagccaaagaaaaggaaaaggttaaagaacgtcgtttctctatagaatgatcgtaccagcgctatcactattgataatactcttgttcttgcaatatacatgttttttttattatcatttgttttctagcagtttactgaaactaatgctccatttgaaatccaagtataatatgcgaatttcattagaaacagtctcccacgtagcctagctagggagtagggactagaaaatttcccaacttcatattcttacaaaagtatatttccatcccttaattccatcggtatctttgatgatagctgacaaaattcgctctatttgaggaaattagatcccgatctttcgataggtattgataactctcgtggaaacttcacacacacgatccagcttctgatcaacatgatccaaactctggttatcagccgtgccctactcagttgacctcgccgagaagactaatccttgtatgcaaatcgaaaaacacaagcaagaacaagatagattgcaacacaattggatatgaatgactaagcactcgaatttggggttccacaaaccaaagtagcggcgaaactgcaatggcaaaataatctaagcaaaacccgattctaaactttaacgactactgaataaatatgatttaggacgtcctagggttgccctagggcgcacaccccttaggcatagcccacaacacaaaagtgacatagtgagggtagaagtggacttggaaaaggtcttggtttggtccccagtgaacttctttgattatctatgcatttcttacacttggtctcttttccttcatccaaacaagtacatttgcaaacgataacatacgaaactcattgtgtagtaacatttatttaaatatataacaagtaaatctaatataaaacatatgcacctttggttgatgaatacataaggtagtcatggtcatatctaagctagttgtgtcctcatcactattaatgtgtggttgctttgaaatattgttacttggattattagtatttgtttttacgttttaccaactatagttcatattctatgccatatgttaaagaccaaaattattgtccataaacgaacatgaacaatgaataatgagtttattgtaacacaattcatccttaatgcttaatgaaaaaatatctgtattgtttgcatcctttaaattttgaactaattagtagggatgaaaacggctagaaatggttggaaacaatatcattattttattatatttatgcaaatggtttaaagtagtcatgaaatttctatattcatgaatttaagtaactaatgtcaactataatgtgacaccgacagaaataaaaaaactaaaatttaaaactgtaatggttgataaagatattattattttattagttttttgaaaacggtatcagtatagcctggacattttcactcgtactaattaggattactttagaacaaaagaattaagaaacacataaatatgataaattatacattcacatttcctctccaatcttacagaactgacaaaattaggaaacaattaattttctatggttgaaagaaaaaaaaatagatgatgtaaaaatagagagaaggaaggagataaccttaaggccccttttaaaatgtgtgaagatgataacatatgaatagaaaaagatgaagatttttcaaaagaaaaaatggaacaacaaaactgaggattgtaaatggtgaaaaacttacgaatttaagtagtgctataataaatcaatgcactgggcctggtcgggctcagtttgaacatgccaatagaggagattcccaactcatcctcctagtttttcataggcacgctttctaaaccactgaacggtgtgtgtttttttaagaaaaaactctataacaaagtttgtttaaaaaattatattaatctattttttaaaaaaatagctaataattaatcaatcatgcgctaataagttgctccgttttacgcgcgcgaggcatgagtttccaacttcaaacatcggaacacagcctcaaggaccttgccaaaaaacaacaaacaaaatccaatgattttttgttgtgggggtttctgaagaacttgtttgggttgaaatccaatgaatatgagatgttcgttacggtaaaccagcaaattgacctgctgtctgctgcagcgcgttcgatggatcgatcgatcgacatggcgccgttagagcaagtataatagatggctatacgaaggctaaatgctgaggtggatgaggaaggagagaagagagatgagaagcgggttgtaagtttacagccggcttaggcataggaaccaagaaaatctatgagacagacatgtggactatatatttatagtgaagagttaaccactatatgagtaagctggtagataggctataagtaagcagttggctttattattatgcttgctcttagtccagccgcaccaccccaattttcaattccgccactttcgcgtcgtttgatgcaggtggtggccgcgcgcgtgaacgccgtgcgcgcgtagcgtctggtcgtcgtctcacccctcccccaaccccgtcccaaagtgtgcttttctgacttgggtagcggccggtttgacagaaatcagggcacgatcttaggagcaccagcgacagcgattgcggctgccgcccggataatacatgagctaattccacgctgtgcccctcaacttttctgtgcactcgccgtgtcctgcgccagaaatggggacataccctcttgtctagtgtctagtgttaagattgttagtacgtacaccctagatttcaactttggcaaatgaacatcttagatggtttggattattactccatcattaacatggtcagttatatgacaatgttgatgatgagtaacaatccaaataaaatgttcttgcttataattaggatgacatacgatatttcaataatatagcatccttttgagtatttgcaaatttattttctgtagaaaagacaagtagtcaaagtttaaaaacgaatagtgttggcagttatttaagaaaatggagggagtatataccaatttccttttataaacagatataccattgtttttagattacgtgaaatcaaaccataaaagttttcataatgctttctctcatgcaaccgaaacccgagagaaatatagaaatataagatgctcaaacccgctcgccaatcctcttccaccggttcctacaaacaacggcgtggtggtccacctcgagacaacgatgccacttcttccatggtgcctccccatccttctcctccgaatcttgtttctcctattgccctctccctcccctagtaactgcccttctccctaatctccctttgtcacgtttcttggagcagacctggctgcccccaatcttaaggtgccaaatctgattgagggtcacctaaaagaaaaagagtgaggtggggcgatggctttacgtagaggcttttccttagccttcattttccttgccaccacgagaggcggcgacgaaagtgaagctagtcgtaagcaatgaatgtgtgagacataccagaggctagtgtaggtggttgccagacacatagaggaagcagtgctcatggtgctattgtcggcaccaaaagttgttggaaatatggtcacaattcagcatattttaaactaaattattaagacaataagcatggcattttcagggaataaactagtgcgaatgctaatcaagagcaacatacaaatcatgcttaatatagaataagcataaacattcatcacatgtcaatgtaaaaaaacattgcggttaacaatagtatattagaaatgagcgcgttgatgatagatatataccctgagaatggctctccgctggaatatgaggtagagttgcctctgttgatggagctgttccctgcaccgcctcctccatcgccattgtcgacatctccctcagcagcaccgttgatgttgtcgtctgtcgacatgttggcgttgatgacgaacaggaacaggaacttgcagtaggagtagtcatgttgaagaacgctccctaaaaaccttattgcccacctacccgtgcaggaactcagacgaacagagtttcggaggcccgactcgtcccaatctcttgtgcatgcaagagatcagagaccggggagaacagaagcagcacaagaacagagaaactggggtggaaggagaagtgcgccgagagagaggaaagaacagaagacactcgatctgttcgtccctttggcagagtgtttctcatgagagtaatgtttgcgcaattaatcctcaaattaacagcgaatgaatcgctctccgttaatacagaatcaattcccatatattttccgcctatccgtgcaggaactcagacggacagagtttcggaggccctactcgtcccaatctcttgtgcgcacaagagatcaaagacccgggaggacggatagagtttcggaggccctactcgtcccaatctcttgtgcgcacaagagatcagagaccggggagaatagaagcactggaaggagaagaagtgcgctgagagaagaaagaacagaagacacccgagcccttttggcagagtgtttctcgtgagagtaacattcgcgcaatcaatcctcgaattaacagtgaatgaatagctctaaattaatacaaaatcaattcccgtccattacaaaacaagagagagagagccgccatggccacggccggagcgtgtgtggtagtccgcccacctttctcaactggtcaattgggagccttaattgtctcactatttaaggtgagatctctccacttaagtttccaatgaggtattattgcctctaacattaattgtagtcctatgaaatttaattgaattaaatcgagcctagcccatttattcaacagaagtgccatagaggatgcatattttttcttcattttgcaactcgccgtttgtttgaatgttccatatattagttataagaagatgctgtcgggttcttggatgttccacacattgttttctttttttggcaaattctgctacatacccaaattttatgtaatttactgatttacatcgtaaaaacgtgtcacggctgaaagacaccttaaaaatggtaatttgttagaggacactctcggcttaattaaagagataaattcttaagaaacacgagaatatccctaggattatatgcttcaaacatagcgctaaagtaaaaaattaagaaattatgtaaatctaaatttaccatcatcccaagtatatcactaacataaatcgtattctacctttcactttagtctcaactcaaaaacttttgtccttagggacattatcatctttctaaagaatttctttctcagttgagtaaaaagtgttcttcagtaaattactagtttttatagtgtattttagccatgacatgtttttgcaatgtcaactagcaaattatacaatttaagtgtcatgtagtgaattttgccttattttttattgcaattaatattttaaatgttgcatctatttaaaatatttttaatcaagtgataaaatattttttacaaagtgacgaaatattgatcaacatgttggccaggagttcctagtcactttcttaaaaatttggccccaagtatcaagatgtctcgcggagaagatgacagcagtatgttgtgacggaaaataatttcatatcacttacacgaaaagtgattgtaaatggtatttttttttctgagtggactagctgctagctaaacggtaaatgttagaggtttccaatgtcctcacaaaggattcgacgaggtagaggaagcgggtaaacggaggtcccactatcaccatcgccgttgccgccgtcgagtcactgccgccttcgcctcccgaggccagatccggcgagccctaggctagatctggttatgaggggggcggtgccagcgccccgacgaggaaggtggagggaaagccacgcgtgacgagtgacggttggggggagggagagcaccggacactggtagagaagtactttttagtcccggttcgtaacccccctatagtcccggtttttcaaccggactacgaatccgggactaaagatcgctatctttagtcccggttagctatctttagtcccggttcaaataaccgggactaaagattttttttttattttttttctttttcattattttttaatatacaatattgatttcacaccatcctcaaatcataccaagaaatcccaaatccaaatcatcagatatcatataatatctccaaatcctcaaatagatcatctccaaatacatcacaaactcttaaaaaaattacatcacaagttaaaaaaatgcttagattcagatgtaatatgaccaaacgaggacaacaatctcacgagttaggagacacaattcgtttggtgggcaggcatacagcagagaccacacaatactatatagagatgtgttgatttacatatgcagaaggaggatcggagaacggggcgggcgttctggctggtgcagttcgccggctggccgccgccgccgcgcaggccgcgcggcctcccgcgccgccgcgccggccgtcgccgagcggctgcaggccgcctccgcgcggccccacacgccgcggcaccggccaccgccgccgctgcgccacccccacgccgccgcgcaggcagccgcctggccagcccgctctcctcgtgccagtcgtcttcttcgctgtgaattgaaggaaagaaaggaaagagaagacagtgagacaaggtaaggtataagaagttattgaggaaaaaagagatacagggcaggagtttgttgtatggacgggaaaagaagatagatactattgtgtttttttatttttaatcccggtcagtaacatcaaccctatttttagtcccggttggtgttactaaccgggactaaatatcctaaggccctgacacggcctgacatgtaatcaaccgggactaaagtttatgtttagtcctgttggagttaccaatgggactaaagatgatgttacaacaaccgggactaaagatcttcctcttataaaccgggattaaaaatcatttttagtcctggtttttaatggaaccaagactattgttgatttgggtcaaccgactaaagatggtttctctaccagtgggaggaggagaggggaatcaacgatgggtggtagggagagaggggcgttatcgtcgttgctcgagccatcctgccgcagccacctcgtcgccatcgtcggcgattggaccacctcgcgcagccaccgctgctcagctctggcggctcttctggcctcagcttcctccgatggggaccgagagaagagagagagttgttggggaaagaccaagaagatagagatgaaaagtaaaaaaaatggtataggtaggacctactacaagcaacttgcactgtaaaacatgtagctcaaaacgtttttggtcaacgtggcatctgaggaacacccactgtgaatggccttaatggctctgtttttgttctttgatttgtagtgaaaatgaagacttataatagtgaagtttgttttgtagcgcaataatttgattatctcgcacctgcggctgcattgtgtttcgtaaaattatttaatacttttaaaatattttaatattattgtttgcaacacagatctaaaaataaaagtggtccaccaaacaccgaaatatccaaaagtcgttgcaccaaatgagattatcataattcaccgtaatggagcataatgataatgagtataaacacgatttactgtcaaaacttcggcttcttgggaattaacatgatgcaatataggagtataaactcttatgcttatacttatcggccaaaattgaattttcaactttaaatttggagctgattgaggtttttttatcgaagtttattttttagtctttgcttttagatcactaagaacacttatataaaagttttattcacaaacaatatttcgtttataaatatgccatttagcttattctgcaaataagcgaaccaatgggtcagatagaggtgtactaaaaatatctagataaaaaaaccaggaatttcaaatccaaaatcccgtactctttttatgttagtttggtctcatcctctttgttcccagaggtacatgcaggcattattaagtaggcaatgatgattaacctaggtataaaatgggagagcactaaagcgaaagcagttggaataatttgtacgtagacggtgaagggacagagtagtgagtgtgtgaaaaaggcaaaggcaaaggcaaacaaacaaagctaaggccgtttctcccgggaggaagccgtaatctacggtttcaatttccaataatccgaccaacataatccgagctgcataaacccttgtgagttgtgtaagcgcgctgatcaatctaactttgtcaatttgtcgcatatatactcactttgacccatgcagatctccagtgtaataagggtctgtttggcacagctccagctccagctctactcctcctggagctggagctcagccaaacaatttcagctccgccaaaactgggagtagagttggatggagctctctcacaaaatgaactagagttgtggagctgggtttaggcaactccacaactccactccagacccaactcctggagctaaattctacttcctccactgtctagatcagctcgttctatatgaatatagctttaattatttgaaatttttttgggaggaaacaaattaaagtaaggagtaataaactgctgtaaggtagcaacggcggcagcagtgtagttcgcgaaaataaaatttttggatgtcacctcagatgtttaaccggatgttggaaagtgtttctggacacgaatgaaaaaaccaatttcataactcgcttggaaaccgcgagatgaatcttttgagcctaattaagccgtcactagcacatgcggattactgtagcacttatggctaatcatggactaattaggctcaaaagattcgtctcgcgtttttcatgcaaactgtgtaattagttttatttttatctatatttagtactatatgcatgtgttcaaaaattcgatgtaacgtttttggaaaaaaaattaggaactaaaccaggcctcatccgatgacccgggacggcgttcagcccttgatcggcttagatggacatctccttggtggtagtgtccttagatgtggacaaacgactggtttacggttcagttaattaatcttcgatattattggttacacctaaacttagcacctagtattaaattaaaaaaaattaccaaagtttgaaagtctaccggttttcctctgagagggccggtcggaccgccgtatgtcggctggtcagaccggtagtttatggccggtctgaccggcagagtccgagcccgagtctatttcgtcaggtctcgaagtttccttgcttgggaaggcatatttcgggttttatttggattctatcccgacagaaaaagttgccaacaattatctttcgttttggttcaatatcggttatcggcatcgatgtacaccaaattcgataggcacaatgaacattcgctgattttggaggttttgctttctggtttgacaaaggcaataaatacatacagcttgcaagttgcaatgcaaaaacaacggttatgtagattttcgtcaagatgtttagtaatatgtgttaagtgttatctttgcgtttaaattggtattaaagtaactttcttgtttttagtcaagctgtaactttgtaattcgtagtcgttcatcaagtgatctatagtagttttgtaaaagcctgaatgattcaattattttgaagaaatagtgcctggtggatttggatgataagatgaatgggataaacaaggagagagaggatgagctgctacttgtttaagagacttggacatgagcttaagaggaagagtagattagacaaacaaataaactattataactagttataactatgttgctcatttttccagttctaaaaatgacacatacaaagggattggaacgtagggatataaaccataggaatataaaacgtaggaattactgtaaaatatattggaatgcgagcgttaaacggacgaatgaaaaaacatgaaaaatctagatttttaaagtggtgtctggaatagaggaattctagaatatgtattaattacctagcactaatgatctctgttttacctgtgatgactgtccagtccaattaaacgttatcatgagataattgcttctgaaattatgttttatgtcctgtgttttgcttctgaaatggaggaaaggaaacctttcatctgttttggttttgcttcaattccttcgaaccaaacgcagctacatacattagttttcccttcaaggaactaataaatcctttgaaagcagctgctacggcagtttttcttccttttggagctctgcggtgccggagtgtcggtcagatcgatgaagccgtagcccgtaaagactgtacttggcagactgacaatgctccttcagttcgctgctttttgtttgctgctttcgctcaaccatccacagcttcatatcccgagagagaaaagccacaaacatagatccactttcccttttcttttcttttgtggggggatcatttgaggggagcatggatgtcttttttttctctctttttcttcccaaaagaaatgcatgtttttattaagtaaagatacaaatagaatactcaagaaatataaatgtaattatcatattctctatattcattatgtaataaaactgaagtctagaataaataaataaatatcaagttgtgctcaaacatggaatctcaattttttttcctttgatttaactattatagtgttttcttgatttaataattttaaacttcagaaatagcaaatagtaataatattttcctaattcaaccccgtatcactattacaacttttcagtccaaccataaaatatcaggactactattgtatttgacacctattctacctattctagtagaatgtctgtaaaacttatgttcgaaagacacataaaaaaagatatgttgttttgaacgtaggaatcgagaaaacacgcgattctcgctaacttactataaaaatatctttttggttaatatatgtttaaatggtcatatgcattaattagtcttaagacttctcaaagaaaaaatataaggaggtcgtaatggatgttcaaataatctatggattttctataaaatcaatggctaacaaaaaattcctccgattttctgatgtccttttcgccattcagaaggggtgaacgataccaaatcctgtaagaattaaaatctgccaatttttcttcaaaaatacctagctccttctgaatgcaggaattttactacagtttcacataaatgagttcatttctataaataaatcccttccaaagaaggcctgaaaagtattaagtccagtcaaatatattttaccttggctgaacagagtttggtaaatataaatgaaaggagggagcagtaagccagtctataaatcctagtgttaaacttcttgtgaaattacaagataacatacaaccaaaaatagtattagctagcagccgatctttgagttgggtgccaatgtaaacaaggagcactttctgccgtccctggcaacaaattttgaactttacagaaaaatatgtaagctcgaatccgtacacacaaaacaagaacccagttctggcagcgatttgtgtctaaaacagacaaaaggaagtcaaaatacaaaaggcatgtccccacgaagaactgactcaatctattatctaccagactaccacgacccaaattcacgtgtcaacaacgattgcaattgtcaacagtttgcatttccggttagcaaatattttgcgatgtttggaatttcaatataccttccctataagcgcaatttgaagctggcattgccaccgtgataagttgaaaaacccaaaaaattcaaggcgatataaagagctatatacaacatcaatataatttcccttatattagctttgaagatgccaagccaccaaaaaacatgtccaggtaataagtagagtagtatagctttcacaattttgctacttggaacagataaaagtcacctcaagtgtttattataaaaaataagattagtcagcacaaaattttagttctacttgatggaaggctgcttactgcctaaagaaggcagtttaaataagaaagccaacaaataagtttagattgcatacatcattgcgaagaacattacaagtagcagcctgacctgagtttctcgagactcttgtctttgaatctacgactatttctcttcgtctgactgagaaggcccattgatggcatcagcaaaatactcaactggaatcatgtcaacatacaaatcatcaaacttttatagtagtgaatataggtttttcaaaattcactgtactgcatatattttaaatagacaagtacaaaattacctatgtcatcatccggggattcaaaaatatcagagtctgaaggcaggaatgggttgcctgaatagttttcaagggctgccaggtctgaaagtcaatgccaacagtagttagatgtaagcagtagcaaaagctgaaaataagttcatttagcaaagtggtgaacgtttttgtttcccgtctacaggtcaattctagatgaaatatgattgtcccagaaaaatattaagtagaaatatattcttttaagcactgacaaaaagtgaaaagcacattcaggagcttgttttcaaatactacactgctagaatactgtctataagtcaggtaattcagtatgtgggggagaacagaagcagcactactcaaacattttagccaagcgaagatcttgatttactccaacaaggggtaaacaaaattgaggagagaaatacaacactatatatggcataagttcaactaattaaccaagatatcaaacaagcaatgagaatcccagagaattaattaaaaatgcaagtgttatacaagataatatctcacaacataggacattacctcccagatttgtcaaatctgctgataaatcagaaagactgaaatcccagatctgctgccccaaggaagagctatcaccaccatttggtcctatttgcagaggtcctccattccctaaatcatctccaaaggtggcatttacagtagatgcatccacatccatccctgatatatcaggagtgaaagaaacatgattgcttgacattgcagatgatggactcacagccatctctgatgacatggctccagcatgtgcagttccaggaacttcattctctgtcatgcttcagaaacataatgcaaaaatcaaacgaattgtataggtgctgacagcaagattttaactgtagctacctgataggtacatatgtatgccattgtcttacaagacacaagaaaataattagtataagaaaaatgtattcaatttttacagtcaaaatgaacatttgctgaaataaagagggcaatttggtaattttgaaactacaacatattgcatgacttgggagagctaatgcatcagaaatttactctaaattaaataagcattcaaatttacaacatggctatcaagtggtttgatactgcaccaagaacaaattattatcattatgtatgttgtccaaatctgtataaatggtttcattctttgatttctttccaaacacctgatttggagggtttccagtaaacaacaaaagagaaaatatatgagataatctcaatagtagcaatagtcagtgtgatgataattctttctaagactaaaaaggaaagagggagggctgtattcaagacaaaacagagtttacattgtccatcttatcataatgccgtttatagagcgataaaacaacaagacaagcattagaacaaaacataagaaaaatattctttacccatttcctgagctcatgcgaatcggattataaccacctggtgcaggaattccatttaccacatggcaaccaggtggaccacaagatatcgaattaacatgaggctgaacaggagcaggtattccaggttgttggagtactggatatcccataggcaaattgttaactgcaatggtaccaagtaaattgtaaggaaaacaaatgggacttcataaagcaggccagccaacaaaattagccagctaagcatccagaccaaacagaggtgatatcagcaatgttatgatgaaaacacacgaattaacacgatttagcatgaactatatagaactgagacacaagtaacccacttcagtgtcatgtgggcctcaagaactcccagagcagcaggcactgatacacctatctttcaaaaatgtgctcatttagcatcttttctcgaagttatctagaagatacatatttatcaattagctaagctacaaatcttttaagaaaaccatgcacatcgcaaatagcccgtgacatttcaacacagtttatcaaacatctgtggctaggacataaacaaatgaaaattccacaaaatgatgaaatgagtcttccaaagtgcaatagtcattctccatatcaagacagttttgtaagagcagaaatgcaagtgtttaggaattcttccaatgttatggcatcgatatgaaagaaatttgtggacaaaggcgaaagcaatgtattcatacatattttacttcataaatcagtgcttttgtatttatttttcattttgtcagtgctaagtggtccttgagtcctgtaataaatcagtgcttttgtatttatttttcattttgtcagtgctaagtggtccttgagtcctgtaatacactggcctacaagtacagggccatgcagcacatggtgttagataggtcagggccaacatacaaccctaaacattttaactataacacctattgtttaaccctctaacacgaaatgatcatgaaatacaaggggacgctatgtgtaagtgggtctgctcctccaaagatctaggctaatacggattttggacgctgatagaggcctgtgtggtccatgttgcggcgctggttggattagtctcacatggagaacttagattggttggaactagcatataaacccacgttacaattatacctcaaggttaactcttctatacaaagcaaggccagaagtgtaagtagggtgctatctgtacatggccgctccttggaaaagttgggctaatgcggaattttgaagttggggtgttacaccttgtacaactattggtatctataagaccatgtaggggcatgagagtatgggggagaagggagaaaccaacttagaaatccaagtgccaaacatattccaatcccaagttaatccttttacatgaattggtggtttgtttgtgctccagattttgccatattcttataacggtccctaaagtacttgtctagttgaactccaaaaatccatgattgtgatcaagcgcggatgactacagactaccttatgtgaatgcatggagacaaaaaagcaaagggcttactttccaaattaagggttgaacgtagcatagtgccttgaactagttaagttcatatctgtttgataaaatctatgaagaaatttctttatgacagctctggactgaaactatgtgtgtcggatgttcaagattagcattgaccttactatgatttccaaaattttactatgaaccaagcattgcaggatcagagtgaattaatttgtctctttctatactctggttcagtgccaagctgtacacagcagagccagtaatatcaatgaaagtacattgccttagatgcacatcggtctatcaggtgataaactgatgacctaacagagaatagggcatcaattaagggcagtgctatgtatgtagtagtagtaggcaccaccaactggcaaatggcacataaaagtagcatggaaactagtaaaacaacaacattctgaacttacaataatgaacaatgatacatgagtgggtaacactgaaacaaacaaaaaaggctaaatgatggcaagaaactctgaagcatggaatcttaaaaggaatgtgtaacattataagtacaataaattttgtaaattatgattataagtgaaatcaggttttcaattaattttcacacaagtcaaatatgcacattatcacagttatggcagaatagcacatatcctacatggataatttgatttttgtgaaatcacactatagagttagatattaatactatagagatagacattaccaggcataggacgaataccgttctgtgttggggtcaacggaacctgctgtggtactgggtacttcataagatggtattggtgctccaataagtggttaaacaagttaatctgttttttcaatttcaaccttatgtagtaagcccgaaagaactcagaattttcttcttcgagtttctgccatactgaaaaaaaaacaaaagggaaggctttagagctatactagatacatcaaaatgctgaactgtctccaagcatcatagaagtcactcaagtattcaatagatctttttcattaataaacaatgttaatatatgtacgacgtaaaaaaacagctttcaagttttcactataacttccatattcaggaacagaatactaaacgaaaggaattagtggattatttcagtatccatacatatttatagtactacacgatcgatcttggctataataaaatgcaaataagcagagttgtagatgcacagctgatgttcacaaaacagattaaggagaatcttattactcaactcaataaggtgaccaaaattgtcctgactgaagaagaaagaactactcctatattatatccaggtgagctctcttcttaaaatagcataccctgagcagattataagaaacaggtgttacgaaccaactcaacataagaaccttacctaaagtagtgaaaccaggttcaattcttgcacgagtagaaagagtcctaacaacttctcctctattcatatatagctgtagacagcgttctattaaattctggacctacaacagcgcaaaatatttggttagttaataatggaaggtattatactttgtatacaaaaattatacacttttcaacattgcctccataatagaaaagactagccatcttacaagttcaatatcttcacgagaaacccttttattatcattacttgcagcggataaggaatcagaatcccctaaaggtgcatcagtatttggctgttcacccttgatttcatcatcaccttgcaccaatggatgcacctttgccttgctctcaacatcctgtagaaatatgctcattaggatatagttcacttgaaatgtggtataaatgtaaagatgtagtaacaaaaggtgaaagcaagggcaatcaatggtcatgacatcagcaaaaaagtgagaggtgccaatacaaagaatatataaccttgaatgaactagtttttatgtcagagatccacaagagtttacctcatgagcacttggtatcttgaacggttgctcttatatttaccaagtgactctactgactaatacagagttaacaggccggttactagagatgttctttattttgcctttcatagacattcttacacctctccagtcttcattgaagtccatcaactacaccatccaagttctccttactagaattgtgcagctgctacatttcacactggggacctcacagtgcatggcactaggctactggaggctatctttgccaaatcgatcattgcggtagattcatcatgttcaaaactgattagaaatcagttgcatggccaacactgttcttggagccaatagttggcaagctccgacttgttgttcctggaggctatctttgccaaatcgatcattgcggtagattcatcatgttcaaaactgattagaaatcagttgcatggccaacactgttcttggagccaatagttggcaagctccgacttgttgttcctcaaagtcgaagggggagaagattacaagggacatgattttcattttacagttcagtacaaacaaattctcaaaaaaaaaagagactggaaaaaatatattgctcttgtctaagagttgcataaaaattaaattaccatattagcctggatggtaaatcttctagcattttacactccaaaagtcatctaagtacattgcatatagattctaagaagtaaaatccaatcttccgagttggcaagctatctatttccgaattaatttatatgaaaggttctctcacagtgtgactgacatcagcactttaaacaaaagacagtgcatcgaatttatttttttttcaagaaagattcttacagtacgaggtactacgacatcagcactccaaacaaaaagaaacacagcgcaacaaacaagctcacctgggaaccctccttcattgcggctcaagcccccacgtgttcgtcagattaacacttctcctgaaaagagctattaggatattattaagaattcaagattttggcaaaaattgagagaaaaagcctcgaattagtctaaagagaaacgagggttaacgcgaattggaggaagagagtgcgtgggtgggtagagtgggacgaatgctcaccaggatggatgcggccgaagcagcagctggacgaacgacggcgcacctgctcgctcgccgggatggatggggacgcgcaggcggcgggcgagctcacgaggagtcgacgacgaggtgggaatggacggggaaaaatatcctcggcagccggcaccgcaccaggatttctcctctttcttcttcttgggcacaattacgcctggaaatatgagtactaacttttttgttattgttttttttgcttattgtatatgttaatttaaactaatatttttgaatcaaatagatataattaatgatttcctagttcctacagttaaaaattacgttctaagatttaaaaattatagtggaatttacattgtaagatatggaattataatatttaaacttttttcttgaaaaatggggcactataaaatgcgtaaatatttatagctaatcctgaaaaatattggttatccagcatgtaaaaagactgcaatgtaaaataatttagttaaatgtttctcaactcaattcaaagtgagacgtttgtcaattgaacgaactttgagataataaggtgaaaagtagaggaggctaagtcaccaagacaccaaccacacacaagggaagatttgttcacatcccttataggatactagagcgggagcacgctttgcgcactgcaccagcttatctggatcaaaatgcgtttgttcttttttgggaaattagctgtgttttttcttttttgggaaattggctgtgttttttttgctgttttaggtggtgaaaaagaatgaattagtttgaagcattgaattgtgagcatttgtgaagaagggtgtcaaaatgtcgcttgttaatgtaacggcaggcattttactggaactatttagatagtataaaggcaagtcattcagctagaatgcatgcatatatgtactatgttctatagcattggtagcagatgcagtagcatcttggatcatacaatgctaaggaaggtaggtaaggcaatacttatatacaatgataatcatgacaaaaagccatgaacaaaagatcttggttctttagtcctaggtaatttcacaactgccatctgtcttctagctgggacatagctttgtacatatatataagcaaaagtcttgagatggattgcacgtcgacaactcattcactgtgtagatgaaattaagagttgtgagattaggaaatgcctttaaattgctaattagttatgtgtagataggtgagtttatgtttgaggagtaacctgtcattgcctttttgctgggcaccatccttgaacaatttcttagcaaccggaggtgttgttgtaggtgtaggcattcctctgtttattgaaatgatgtgttagttacaatggaagaaagctttattattggaatgcacctaggagtgatcaaagcaccttttttggcttgggtatctgtagggaatgatggggttgcttgtttggcttcttcggcagtttgtccctttcccttgtaaaagaagtggtggttaagtcttaatgaatgagctgaaaggaaagagatatagtagtaccttattttcagtagtatcaggcaggacaacaattgaagatttatcatgtgaggtgttttcttcagcttttgtgtcagttttgggcttgcaaaattaggaaagaagtgagagtggatgtaattcagtatgagtgacaacaagtttaagggtggctataaagtggttaccttatcatcagttttaggtttggtcctgctagactgcatgcgagacactgagacaacaatgtttttcttggtaggtgttgaagaatttgatttgctagttggggtgccctgtgttccttgagtgatagtgaacttggttggtgttgagatggtttgtcttggttgaatgggctgctgtgattcattgcttgtttcacttggtgttggtgctatttggacagagctgcttgagcttactgagacagtagctgatgtcacttgtgaagcatctggggacataaggagtagtggctggtttgaagcaccagaggatataatgctattaacttgtaggcactcttgactcatcatgacagtatcccgcgtaaagctaacattccatgcaaaattgctgccaataagtgacgtgatttcacttggaatgtattcactgtttggtggattttcttcaatgagagattctattggcctgcgtagtaggcgttgtgcgatccttccgaaaaggataaatgtagcattagcatcatcatcgccggcaattaatactactttgtacctacatgaaaaatggatatggctatagcaatgtgtggatgataattgctaaagatgtaagaagacagagcgtgttctattatgaaccttggatctggtattccgatgttagaacagctggagcatctgtagctagagccatatggttctgaagttttatagcatattcgacatgaattgtaccatcaagaatattcattgcatatccttctgacagtcacatttactataaaacatgttccctgcataagaggacagtgaaaatatcatattggtaattttattatcaaaaagtggatagatatagttaagatgtgttttagagatagtgtcaaccttgtgtttgtgagggtagatattaaggatttctgcaatactcttttcttctggtacatcttggttgtatcctgtagcaggctcatcaacccacttgattggctgaaagtttgtgctaaagctacatagaagaattgcatcttagattaatggatactgtgaaaaccttgaagaatacagtggtgcacatagattgtaagaataactgtaagtaaattaaattacctctcgtttaattctgctactttaggaatatttagattaatataccatttgcatggtgagcttccagttagtgtaaggcctatatatgtggaggaaaatattagatattgttagttacatgcagtcaatactacagtaattgaaagtttagaaagaaatgtacctaatcctctgtaatctttcataagtgttccaacaaacacaacaacttgagcttgagtttgactagcattgtatatctcatcaacatcaaaagaggttgctctttctccccagagtgtgacaggaagagtcgaattgctagttttgtggatttggaggggaaaaagtgatttaattgtaattggaagagatgaaatatgtgagatagtttgtgtgaatgctagcgaaaaagattaagtaaataataaaaatgtaaatatttagctgtactaaactaaccttgcatcgcggatctgtaatgtcctttttaagctctcagcgtttctggacttaggacgtatagtagtgactgcaccaacttcagtgatcacacccataatgtctgtttgcattgcataaaaatttaataaaatgatatggcattgcaaaatatgcatataacaatagttgtaacacaataaaagtatgttattactaacgtagaatgaattcttctcgacaagggaaggaacatcttcgaatggtgtcagtgaaaatgtaataccagtgaaatgaggagggacattaatgtgttcttcaagtgttgtccatttactgaagaggatcattaggttgtttgcaactggcctgtatgttctgtttgcagccttaacagtgaatgagtcaatgtagtaaaccttttcttcctttaaggagaggtttcatattttttgttatagggggataaatttgggcatgtatgctagtcccctgcagattataaatacaaatcatgttatcaagagaattattggtatagtaaggcaaatatagaaaatggatttggcaggtaaattattaccatttcatcgagtaagacaagatcagtgtggaaaatttttgtatcatcgttgagatcagcaaagttccatagcctggagacccttgcaaggattcttttgtttgaatctccaaatgataactgtgaaatcagtacatgcgccatatggaatctgcaataagcagaaaatacttttagtatagacaaaacaataatgctatatatgtacaagaaaatattactaagaagaacaatacataaactgcagcggacaaatcgtatactatgtatatagtatatggtatatgtgaaggaggtatatttattccaaaatatatgtacaaaattgtttcttttttagggtaaaagaggttaagtatggagcggcaaagcctgcaacagaaagctatttccatattacattatagatgttcctgatattaaataagcatagctgcaatcttgtagaagggtctatatggatttaagtacgcacacataggacaataaaaaaactacgatgatatgaatccaagcttactatcgtcaataaaataactaaactatattgaacaacatgcgtgagtaatatagtgatggtctgtatgatcagcataatttaaatcgttgaatacaacctaaaagcaacttaaatggtagatcatcctaattttctgtgcactaccattgagtgaaaactataatcatgcactacaaaatcatatagtcagtagctacaggctcgtgcgtagtttcaatgagatcagtcgttgcacccaaaaaaaaaatactggctgcaactcaactgggacaacaatggatggaacaagtagttctatggctgcaagcaacctatcatcataatgaaattcccaaagaaaagaaggggttggaagcatgagctgtcgtacatcaatattcagtagggaaatatgagagacatctatggctaactacaaaggaagaaagatgaccatggaaagttggaaacagaagctttgaccacatatctaacgacgaaatactgaggagaaggtaagaatatgtatatataagaaggcgacatactatcatcgcaagataaagtcgagaagaaagctatgcacacccatcgacttacagatagtaaaaggaattgttataacaattggtcgttataacagttgtgaccattgtaacttgtaacgtctctcttttcctactaatacccaaaattatagggggaaggagggatcactttcactatatgcacacagcacagaaccatctaattatataaaaaaatgacaaagctagggaggaattgcagttgcacacacataaacttacaggggcacacatataccatataatatcatgcaaagaattaaactaccagagaaaaataggaatgcataaaaacaagaagaagaaaataccttcagcacaaagggagaccgaattgacagggaggggaaaaagcagggaaatcagagcaatatcnactcctaattaaacaataaactgaaacaccaagcttcgcagcaaggaaagagagccaacactgtcgtgcgcaaataaacaaccagagctgcatggtacaaacatcatggttagacactaacaagtttaaatctaacgcataacagtagaagaactcctcagagaaatgccagactgaacagaaggatgaactgaaattacctgccaagtatttccagcagctcttgcacatctgactaaaaataattaagaacctttgaagctccgatgcaacccatgcagatcttctcccctaacaaaataggaaagattaaaacaaatcaataagcaattaagattgaacaccattgaaaggaagagcagcaatgaatcttaatttttgaggattttactttaaaaaaatatgctccaatagacttccaagtctccactgctagcatggagcctcatctcgtcggccctctcttccacgtccactgggcctgcgccgatctggacccgcctttttccctaacatcactctagcctcctgatccgcctcgtctcttgattttcgccgtcgcctgggctgctactaccttcgtctgcaggccttcaccccgccgccgaggggacggcgcctcctcgccgtcggccggggaacgcgccttcttctcgtcgctactggtcgagacccaccgcatataggcgtcaccatcaaatcgactccgccgccagcaaccatgtccccttctctgcctcactcctagtggcaagcacttcaggccagacacctcgagcgaacaggtctcctgccgtcctgcctcattggttcctatgctataagatcttttctttctctgtttatctggtaagaataaggaggaagagagggtctagcagcctagcacggtgagaactgagaaggggttgacctgtttgtgtggttatgctagcttggaacctgctatgcgttggacatatatcaaagtattgctactgtatcagctttttttcttgctcagagagcgttaagggggtgtttggg

SEQ ID NO: 41633 - DNA, 11667 bp, Oryza sativa
  unsure (1)..(11667): unsure at all n locations
tgtttttgattattattctgtgatgaacaattggcatcggagataattggttttgttatttggaattaattcacgaagtagttttggagatgattggatttacaggtgaatctacaggtactgctgttatttcatgtgaccggtcagaccgggtagtgtgtgccggtcagaccggcggtatgcgcgcggtcagaccggccagcccgcggtctgaccggccgactctgtgtcggtttcggtttccgattgtttgtttagatatccgtgattatttcaggattatgacttctagatggatactatacatatgtaattctgttgtttgctactaatgagacaagttggagatagcttggtctcggaatatggtttctttgtttatttcatgagtaggtgactcgatgtctcgggagagtatttgcggtgatggaccgggagtcggcttggggataagacgacgtcggtggtggtcagagatcatgcgggatacttaggctagagttgatgcacgtggttgatggagattccatatggcatacgatggaggtattgtgtgcgtatgggatgcggagtcgaatttggaaggagtccaaatttggtatgattggttttgtaaagtttgtttcttgtactatagggtttactaaggtgtttaggacttctagtatgagtttggttcgtggctttaggctgtctatctcgagtataaatagagggggagcgtgaggcttcccggtatcgctgttgagagcaattgagttgaattttgagttagggtttcgagtttagtcgaaatttttgtaaggagagctgttggtgcagtaaacacagagagaatcaataaagtcgtcatctactttaagagttcttcgatttgtgtttcaccgggtttcggcggtctaaccggcgatataccggtggtcagaccggcggcaagcggcggtcagaccggtggtggcgagacggtcagtccggcggcggcgacagcaagcggcaactgatctcggcggtcagaccggagatctaatctcgatcagatcgacggcaatcaagcggtcagaccggcaggacaacttcggtcagaccgcgatccgtcgaattcgagggtagcttttatttccgctaaaagttttcagtttttgggtataccaaccattcaccctctctggtttgattagttattgtgatttgattctacgacatcgctccacacggcgctaccgtcgctggccctccacgtggccgctggggagtgctggtctcgttgtcgcggactcatcagagatggcggcgtggattatttattggtcgcgccgacggaatgcagccatcacagcgaagggcaaaagcgtcagttcacagcttccttaatttctataaagctatcggaaacatcaagtaaaaaggaggacggagtatttacattgtatatcctgatcgacacctaaaccagcaagattaaccatccagtgtcctacgacctccgtcctagaatgtaattatttttagagttagacacggttattaagaaagtaggtagaaatggatgatgtaggattgcattggttgagtagtggagtaggtgggaaaattgaatggtggagggttctgattggttgggaagagaatgttggtggggaagttgttatattttgggacaaatcttaagagctaaaagttgttatattttaggacagatggagtatttattaatcatatgggtacaatcaatacctaaatatttaatattttataagttcgtacgattgtacccacatgataaataaataagtttatgtatcgtcaatgcagtttatacgtaaataaataatattttaattttatcgtaatactttgtaatactttaagttattttttaaaaaaaattatcagtggccaaagttataaaagttcgacggttcgaaacattaagaaattataaaatccaatccatctcttgttttcttgggtgatgcaagctgcaagcatggcacgtgtcagctgtgaaccggtggtgcttctggttgattggctcgctttcactggccgagaccattggagcagagcacagcaccagttcgtttgtaggtgacctgcacctttcttgttttaaatgccttagccagctggccaaccaatgagtccgagtggtagcctattcatgcatgtgtcctggcacgaggttacggtggacggctggtgacgtgggcaaatgtggtacggtggacgccacggagtataacggaagcatatatttcctccgtttcacaatgtaaatcattctagcatttctcacattcatattgatgttaatgtatttagacatatacattgtgaaacggagggagtatctgacttgtcttgcatcaattgaggcagtcgtgtgagggcctacgtcggctccgacatgtccttgtagatcgacgtattcattggtgtgtaaggctgtgtttgaggaaaaggagatagagaagattgggaagatacgcaaaacgaggtgagccattagcgcatgattaattgagtattaactattttaaacttcaaaaatggattaatatgattttttaaagcaactttcctatagaaactttttgcaaaaaatacaccgtttaatagcttgggaagcgtgcgcgcggaaaacgaaacaaacaaactccctgtcaccccagaacgaacgcagcctaagacactacttggccacgatgggtatgatctagtcggattttttgtggaggatatattagttcgagagtggtcattttatgataaggtgctcggggtggtggataatactaagctgttattttttacgatgtctttgatgaacattgtggaaatactcctgcttgaacgctcgataaaagatagaaatatcaggcgctcctcaattctcaccactcatttcataccttgctctcgctctccctctcttctctcgctccctcatcttcccctcttctatggccatacggtgactgcaggcaggcataggaggcaaggcccctctccctctcttctgccactccctcctctccccctcctccattattagatggtgagcacaagcagacatggaggtgatctcacaacgttgggatgagcccgaggtcactgtggagcttgtaacttgggatggttagattcatttatgtgaagcatgagtgaaggaggtagttgggggagaggatctagcggtgagggtggcgcgcgacaatggcatggtcactggtactggggaagatgatgttgaggcggcgccatgtaatgatttgtcttgaggtcccagatctaggcggcggcggctcttcttctattctcacgttcgagaaggttggcgtgctcgaggatgacgttgtcgctccaccggcaggagcgcacaagggaggtgcattagaaaattggatgggtgcattgtgaattttaaatgtttcagtgcatgcatatggatgtttcaatagttcgagaaaattgttgcagtggctttagctggtttggttgggccatagatgagcagtagacaacaaggagattcacaaattagttgacaaacacttgtatattatatactacacttgttaacaaatatataaatgttaattcaaacacatttcaaaataatcacatctatttcaaatgatcacacgtacgttgatgcaaacacgagagcataagggtgtgttttgttcacaccaaaattagcacaattttcacaatctaccatgacacctttgcttttactacatttggggaaaaaagcacttcattgattttcacaatatcttccatttactcaacacgacctaaagcatcttttagtttcatcttgtttagtgtgcatgttgagcaatccaaaacatcatgttgttgttttaactttttggcacaaatcatgttaaacatcaaactagcatgaaaagcaatttgatatttttgcaacaactttttagtcaaaaacaactcatccaaagtgcgtgcgtgcaaagcaaatccaagagctagagaagatctatttttcaaatcatgtgcagctttgacatatctaattttagaaatctcattcattaaaacctcacaacttttgcaatcatcatcattgggaataagagattttaatctagcaacttcaaagttaagagattcaataataaactcctattttctatacatcttctcacacttcttattttttgcactcaaaataagaatagcttcctcaaaagaacggacctcattgtcttcacactctgaatccgattcaccaggtgccatgaagcaaacaccagagatgttctttcccttatcttcatctccactttcaccatctacatcgcttaatggctcaaaagcagcatagacttgagtcaaaagccttcttgagagtctctttgatcttcttccctttgaatgtgctcttcggcttgttatcattggtcttctcaccaccattttcttccttcttatctctcccaagcttaggacaatgcgaacgaaggtgatcagacgaaccacattcaaagcaacgatttggtccacctcttttcctgtacctaacattattcatagctcgagaaaatttgttagtaaccaaaaccaaatcctcctcctcgaactgttcgagttgctcatcggagatggcattaattaaaacaagaatagaagacttcgatgaaggagcaccaacatccaaaaaagtcgaggaagaaaccaaagcactaaacttagaatcaactttacgagaaaagaatattcatctcatgtgttttgagttttgtgtaaagcgaatccaaagtcaaagtagacatgtcaacggactcctgaatagctgtaactttcatctcccaaataggcatgtcaagaccattcaaaaagtagcgagaaacctcagattgtgtataattaacatcataagaagaatcaacagatctaagatcactcaaaattttgttaaacctagaaagatcgtcatccaaagcttctccaggtttcatcccaaatttaatgtactcctttttgaaaagatcccgacgaagttctttaatattggtagttccttgatgaaaattactcaaagcaatccaaatctcattggcggtttgaagatgagaaacacgatcatcatccgaacgagaaatcccactcaaaagaatattgggagctttgcaattgttcaaattcagtttttaaagtagcagtattaatttgttcaggaatcacataaggattagaaacttttctccaaatatcaagatcctcagccataatataagattgcattttactacaccaataagaaaaatccgttccatcgaaaacatggggcttagttgtaaacttattagccatggcaaaaactctaaatcggttaaaatccaaagaagaaaacaaggctctgataccacttataggatcgaaatacaagaactaagccaaccagagggggggtgaatggttggtatgccaaaaaacccaaactttttgcggaattaaaagttaccctcaaattcgatggatcgcggtctgaccgaagtggatgcgccggtctgaccgcctggaagctgtcggtctgactagagttgatcgcccggccaaaccgctccaaagtcgcctctgcctcctgttgccgttgccggtttgaccacaggtatgccgccggtctgaccgccgcgatgctgccggtttgttgtcggttagaccaccgaacccgatgaaacacaaatcgaagaactctcaaagtagatgacaactttattgcttctctctgtgtttacaaagtgcaacaacagcactctttacaaaaatttcgactaaactcgaaactctaactaaactatcaactcaattgctctcaaaagcgataccgggaagcctcacactctctctctatttatacatgaggtaggcagtctaaagctacgaaccaaactcatactagaagtcctaaaccatctacgaaaccttctcgtacaagaaacaaactttacaaactccaatcataccaaatttggactccttgtaaattttgtaaatattgtccccttttttattattatattattaatatagcgcagtaggagcctctcctgctgtttcacatcaaaaaaaatttggactcattccaaattcgactccgcatcccatacgcacacaatacctccatcgtatgccatatggaatcttcaccaaccacgtgcattgaactctagcctaagtatcccgcacaatatctgaccgtcacggacatcgtcttatccccaagctgactcccgatccatcaccagcaatactctcccgaagcatcaagtcacctacacatgaaacaaacaaagaaaccatatttcgagaccaagctatctccaacttgactcattagtagcaaataacagtattacatacgcatagtatccatctagaagccataaatatgaaacaatcatggatatccaaataaacaacccaaaaccgaaaccaacacagagtcggccggtcagaccgcgggctggccggtctgaacgctcgatcaccactggtctgaccggcacacactgcccggtctgaccgaacccaaatcacagacatcagttcctattcacctgcaaatttcaatcatctccaaaaccacttcgtaaataaattccaaatatcaaaactaataatctcatatgcaaattgttcataacagaataacaatcaaaaacactttgattttacagaagtttgattaaaattgaaacgatgtgatgtaaaagttgaaagttgaagaaaaagttgggaactaaaccagggccctgagggtggcgtgcgacaatggcgtggtcactggcactggggaagatgatgttgaggtggcgccatgcaatgatttgtcttgaggtcccaaatttaggcggcagcggctcttcttctattctcacgttcgagaaggctggcgtgctcgaggatgacgttgtcgcttcactggaaggagcgacaagggaggtgcatcaaaaaattggatgggtgcattatgaattttaaatgtttcagtgcatgcatctggatattttaatagttcgagaaaattgttgtattagctttagcttgtttggttgggacatggatgagcagtagacaacaaagagattcacaaattagttgagaaatacatgtaaattatatagtacacttgttaacaaatatataaatgtaaattcaaacccatgtcaaaataatcacatctattccagatgatcacacgtactttgcaaacacgagagcataacgaacaacacatggtccaggtgataacgcgttcgatccgtcatatccagatgtcaatagatagcaggcaatattaaatgacatggcaggcaatattaatttcgtgaaatcgacagacaattttgcccttctggcatgttgttagcaaccaatcagaaaagggccatgtttttcatatgttagacacatgttgagtgaaagttcagctataaatacccctgctagatagcgtctgcctccacgcatcatccatcttcacgagctaaaaacctcactaccacaacaagcatcttggtttctgctaaaacaaaggtccctctctcgctctctgacacacacacattccttcttcttttcttttttttttgtctctcacatatacacttttttcactctctagagtgaattttctttgcatgtatataacagtcgaagtgatatcatgttttcattgataatacctttagtattgccgtatgagatggtttagtaaagagaaaatgctaattagattctagcaatatgttcggatctacataccacgtatatataacgtattgattgctcaaaaaacgtactacttataaaggtggagatcagatatacatatgctgaaaggctttaactaattagcagttcctttttcattgtaatttatttgtcgcgtgaaagattttcaaagtttcatttccaatgcattcttaatttagaggaaggataatagtgagctactccataagcttatatggagataaagataactaaaaataaaaataaaggacgttggatctcaagcaagaactaattctacacatgctccaagataaacacattagacgtataagtgtgcgagaggaagaaaaactaaataactttatagctaatatattttgtttttgtctctaatataggtttataactagcagtgagcttatattattaaacttgctcataagaattataaccatgagtattaatgagggggcccaaaaatatctttaatttatttttactgcaatttttaaatgcatttgttttacttaatcttatcttacttcgtataattttatatgttagtttagtaaatctttattgattgtaaatttagcttatgtattggttaaaacaatttattatttaaccttttggctaaacaaagattgtgtttaaattagtgaaagatggaagcgatgagagttgttagattttcgtctcaagggcgagaaaaatgactaaaacttaaattaaatatttctctctatgcgttttcatacacatattctgatatatcattgtgtatttctatcttttgctgttgtaatagaactaacacactctttcatcgtcccttgctgtcagcagacttcattatatttcaacaatggatttaacaacaggagccatatggttgttcctggctcaactgttcgtcgctgcaacaatgttgagtaagattgcaacaagagaaagaacaagaaccactggcacaaaattctctagaccaccgcctccacccttggcccgtggagctcctcttgtaggggttttaccatcgcttctcgccaatggcccggtggaattcatccgccaccattatgagaagatgggaagcgttttcactgttagcttgctccaacagaaggtgactttcttggttgggtcagaggcgtcaagccatttttacaaagggttagattcagagatcagccaggatgaggtctcgcaattcaccataccaacctttggtcccggggtcgcttttgatgtggattatgccactcgacacgagcagttccggttctttggtgatatcatgaagccggcgaagctgaggacttacgttgatctcatggttgctgaagtggaggtaagcaaacgagtttttggcatgcacatttagtgttgacatgttgctttagtgaataaaagcaaattcactacggtaataaattaaaattatatccatattaaattttaccgtccttaaaagttagcggtatatgcatcaaattttaccataatagtttaagtaccttgagatacatggagttactaaattttataatacaaaatgtggtaaatttcgatgcaatctcaagggttgatcgtagagttagggtatatttggtagagctccaattcctaaatttagcttcaggagttgagtctggagttaagttgtggagttatctaacccagctccatatctctacttcattttgtgagtagctccactcccattttacgtggagctgaaactgtttagctgagctctagctccagaagaggtggatctggagctgtgccaaacaggcccaagatattaattaacgtggtatgtgtctatatacgcattgtgcagggttactttgcaagatggggacagtccggcactgtgaacatgaagcaagagtttgaacaactcgtcaccctcatcgctagccgttgtctactaggggaggaggtcagggacaagatgttcgacgaggtctcgacgctcctccgcgagctcaacgacggcatgcgcctcgtcaccatcctgttcccgcgcctccccatcccggcgcaccgccggcgagacagggcgcgcgccaggctcggcgagatattctccgacatcgtgaggtcccgcaggggcagctccggcggcggcggcggcggcggcggagcccggcacgacgacatgctgcagtgcctgatcgacgcgaggtacaaggacggccgcgccacgacggagacggaggtcgccgggatgctcgtcgcggcgctcttcgccgggcagcacacgagctccagcaccagcacctgggccggcgcgcgcctcctcaccaaccccgaccacctccgcgccgccgtggaggagcaggcgcggctactccgtcggcacggcggcgaccgcgtcgaccacgccgccctagcggcgatggacaccctgcagcgctgcgtgaaggagaccctgcggctccacccgccggccctgatgctgctgcgccacgcgcggcggagcttcgtcgtgcgcggcggcagcggcgagcgcgagtacgaggtgcccgagggccacacggtggcgagcccgctgctgctccacaacgcgctgccgcgggtgtaccgggaccccggcgagttcgacccgggcaggttcggcgccgggagggaggagggtgcaggtgggctggcgtacacggcgttcggcggcgggcggcacgcgtgcgtgggcgaggcgttcgcgtacatgcagatcaaggtgatatggagccacctgctgcgcaacttcgagctgcagctggtgtcgccgttcccggagacggactggaccgtcgtcatgccggggcccaaggggaaggtcatggtcacttacaacaggaggaaacttacctagttattatcagttaaaactggaggtataatcatcgtatgtgtttaagcatgtgtaaaacatctcatcatgtattctcaactagtacataactcatatctatctctatcttttctctactattataaaaattgaagatgtgtttttaccggtgctttggtacgtcatatgtgtatgagtcagtttttaattaagtttgttcgcttttggaaatacatatccgtatttgagtcagtttttaagttcgtttgtttttaaaaatacagaaggagtcgtataaaaaatctatttaaaaaaaactcgcatgttaacttgagatgatcggactcttaattgtagctcatgattttctaaaatacttcttatatttgggacggatggagtatatccaagcaaattctgactgtgaatttcaccttaactaaactatataaccctaataagatttaaatagacttcatcaacgcacgggcaatttttgtagtaataagaaaaaaaaataggggaattgctaactggctgcctgctgatttatttttgtttgccggccgtttttttggcccgttggattttgttcacgatttgtgcacccttcacgcaacccaaataccaaattatgtttcacgcaacccatcccaggtaacacagccccgcgccatgtgtcacgcggtcaagcattgcttcaagcaaggagaaaggagaggcagaagcagcgtaatcggcgacgacgccgtagctccagcacagctccaccatgaagtctgccccccggtggatggctctgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 41634 - DNA, 29545 bp, Oryza sativa
  unsure (1)..(29545): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctacaccttttgtttcacattataaattatcttcaagccagtgttctattaatgaagatgacaaagattacaaatcgcatgttccatatgccagtgctgttggcaatcttatgcatggtatgatttccatttgcgcagatttagctcatgaagttagtgtggttagcacattcatgcataatcctggcaaagaacattgaaatgttgttaagtggattcttcgttatttaaaaggtacttctaattttggcttaatgtttgatatgaataaggtgaagatagatgatgttgtttggtttgttcttaataaaaggtctatttccggatattctctttgtgtggttctgctgtaagttggaaagcttcaattcagtctgttactgctctttccaccatagaagcagaatatatttctactactgaaggtgtctaggaagctatttggttgtgaggtcttattcctgaagttggtattcagtaggatgttaatattgtttattatgatagacagggtgctatttgtttgaccaagaatcatatgtttcatgccaagaccaagcacattgatattaagcaccattttattcgtgatattgttgctcaagggcaagtttttatgaggaagatacatactgatgacaatcccgtagatatgcttacaaagttactctcagtaactaagttcaattattgcctatacttagtaggtatttgtggtacttagcagcccttcagggttttggagacattttcttctacaacatatcctatatacctatacaaatcatccccaccactagaaattctctgcttcctggtgcttccacgtcatcattttttcctcatcattttttcctaaccgttggatctaatctaattgatccacaccccatcccggcatcccgcatccgcgtacgtcttccttcccccgcgtctcgctccgccggccccaccgcattgctactctctcacgcgagcgcacccacatcggctccctctcccgcatctctctccgccgcccccactgcatctccctcccagcgattccttgcccaatcactcctccctgtctccttggctcggccccgcctcccttggactcccgcagctgccatggaatccaaatcgatccactacgatgcagtgtctttatcacttttcatccccacggcacaccatgcagtgtcattgtgtcgcttcttctcctaacccctgcaacaaatcgatggggccatggtggcgactcgagttcggcctagcgcggcgcggctcagggatttgggtcgcttcttttctttcatccgccgtaaaagccacctggaagacgaactgcgaggaaaaaaccgtcaccaccatcaataatgggcttaattccatttattccctccctacaattcatcctccgtttagatgaacctcaagcaccatcccctccagctcagaaggcagcgtcaacagtcgggaaatcctctttctgtattttcatattttgctaatttcaatttgtgcttgcctgcaacgcagggggttccgggctactggtctctcttgcctcgcctctttggagtaggttacagcatcgacgattggacggcataattaacgaagcaagagacgagcaggtggtggagagcggaggaggcatgcatgctatggtcgatgggcttcttgcgcgagacagacgaagcaaagtgcgaggtatgaagcgggttttctttgctacgctcttacggctattgaagcttaggcaaacttagcaggctttcaacgaaattatgactatcagacagtcaggctgtaaaatatatatattctcttttgccctacactcctactgtacaacacacatccttctccacatcgattatgtttggattttactattggtaaggtaagcaacccaacatatcgatctactgagggatagcaaaccgtaaagataatcaaactatgttttcattaaacatgcgcttggcattttgccttgctgtaggtttctgtcatttgattttctactgtattgacacctgaaatgtgctgctctccttctttcaggtcatgttactaccgtgcaaacaactactttgttgcctaaataggtgtgttttctttttttggataaatatagcattcatatatttctatgtgaagttaattagttttattcaactaaaataggatagctaaatgtacattcaaagagatcatcatggttgtctctgaaggtagagagaatcccttatatgccactctaaattaaccagctcccttatatgccacttcaaattggcttctctcttttatgccaccggttcaagtttctcctcccttttatgccattgccgtcagtccaccgtcagttgaccgttaacttcattgtaaaaagacgcatttgccctttagaattagtatacaaccaataataggtattttagtactaatatagctactagatacaacatatgaaaattgatttttttctgcatcacatgcaattttagccattaccatcacaaataaattttcaatgtaagcatgaaacatgcagttttccaataatatttttaatataaagagcatttttcactgattctgacaaaattttcttcactcaaaaaggatttaaaataaattagttatgaatttttgaagtttacacattttttagttgagagggcatattggtcatttacgaaaaaaactaacctttgactaacagtcaactaacactatagtggtgggagtggcataaaatgttggaaaaacttgaactagtggtatataagggggaagccaatttttagtggcatacaagggaactggtcaaattctagtggcatataagggattctctccaaaaaagaaggtaactcgaacaattttttattctagttatcgatttactttcgctgagcattgtgaatccatccctctttgttgcaccattttgttttgtagctaggtgcttttacataatcaaccatgccaggatgtatacatgtgtgttttgcttcctttcttctttcttttagttaacaatcttatgttacattcctagaaattattttgtcatttagaaagttctgctgcaacgcgcagggtatcatctagtttatagggtttttgagtcaaggaaaggttgttggataatgactcaaatatatttagtcctagggtcttgttcaatatgtgtctaaatatatgggccacccttctacatgtaaccctgaaccatcatagttgattttgtcttctatggttattttctctctatattagagggatgttttcacataaaattatgtatctcttttgcatctattttccctatcaataacattggagcgattggagaggataatggtgtggagatgtatatgaatcgaactaggacatttaattatttgccacttttaagatgtgccaattaatgatttgccactcgctgtgtatgatgtgtgggccctcatgtatctatctcatgtgtctatgatatgttggtcaagtggcaaatcctatataaccactcgtaagagtggaaaatatttaattattttgaatccaccgagcataattccacgaacaagagtaaaattccaattttcatttgcttggtaaatcaactaatatgcaagaggataaattggacaaagtggctgaactaaaagaaggataggaggataagaaaagggagagggagtggacgtggtgtgggtggagggtgcgatgcagtgcagtacaaagggcgatgtgatgtggtgtgcatggttgatcacccgattgagatccaatggctaggataaaatgaggtgacgtggaagcacgagaaagtagaaagttgctattaactacactaagtgcgaatgacttgtatacccgcatatcatctcccatcaacttaatttttctccatgcgttttataggttgtattacaaatccatcaaacttatgcatgctgatctataacaaaaagacaaaatttgctacaggacattgaaaaaccatggcctttgctgagggatatcgtaagaacatgaatttgcttagggacactcaaaaaatgtggtaatttattggtagacaacatacacattattttatgactttttgctattttggagggagaattttcacaacatgggagatttgcccctaggaccaattagtacaaagagttttgttttctttacaaatcaagtccctggtgctttgatggagtggagcccgtgtgtcattgtctcgaggagggagagagcagtagctgaggcagagccttgccggctggcactccttcacggcgacgctgacagtgaatggcagctccttggacgatgcggccaaatagagaaagatgtgcaggcttcttgcgaacccgacggtggtcgtcttttagccggaggtggccagaattgacgacggtgctagtccggtcgagccaaggagcttatagttcgatgctaccaagatgtttgtagagacgtagagacgctacattcatgaggaattgagagacggaatcgaagatggcagcggttggccagagtttgggaagacgatgacgatctcatgattcacgacatctcatgtcaattgcttgggtcggagggctcctagggtctcggcgatgacgatggcgcgatggatggcccgaccatgcgccatggtgcccagaatgtggagatggtcttgactgtgacacagagagctcgctccggagtcacgtcggcatgacggctttcttgtcgatccgctgcatgacagagggtgaggtcaaaagttaaaacattcgacatgatgaggtgaataaggaacagggaagagatgatggagagcacggcttgacgactagcggcaacacctccttctgggcggccgacttgggaagaagaaatacgagggtaaaatagacaatttacgtggtttctccctcctcacataagtaaatattatattttaatgcttattgtgtcctttagcaaattaccgtgttttatgagtattctcggacaaattcacgttcttacgatgtccctcagcaaatatcacatttttggagtgttctgtcgtaaatttttcctaactaaaatatatccgctttcatctccaacgtttttgtataagtatttttactgcatgtatttttgtgagggttatattaataacacagtatgaactgttcactctgaagtgggattatcacctactggtggagtaatgaagtttcatgtgttgtagaactctttattactatgtcttcttattagtatgctgtaaaacttttagagcaattggtttggacattggttggactggcggtgtgcggcggcaatgggcaggtagcaaggcagtgggggcaccaccggagctgtgaggatggaggccgacaatgggcagggttggcagcaacctgagcgagggaggccatatggtaactgtgcggtcggtgacaacaattccgacagcatacgggaatgacactaccgctggattatggagaaagagacggaggatggcagggatgaggaaaaggctgaggattatatggttttgtgggcctcacctgcgccgttgactccttttggcaagccgacaagccaagagtagcatcgtcgtgcagggaggagtcagcagcaacccatcatacatgtgtgcataggtgaaacggggttgaggagggaagaagtgataaggggagagagaaagagtccacccaattcttgcaatcctaaatggtcaaaaaaaattgatttttttttggggggggggggcaactgagaattagacactcccaaaaattaattaggaaaactgagccacccctgtaggacgacccagccaaacttgccgctctccatgatcaccgttcctttgagatgcatggggccaccttaggaaggggatgtttaggtcatttaattgtcagagcatgatgattatgtgtcgatgtcctcctattctgcatttaaccactcaagatccagagtactgttgccagacttaacacatctcgggcgcgatttgatccatattccttaatttattgggtccttgattatcacgatcacttatggtcgatcatgagacgtgggtgattgtgcagcacaaataattattttaagggattgtatagattatattaattttggacttgttcggcgggaaggaggcggtggtgatgtatatcagcggttgtgatacatcatgcatgtgtgcgtgcttgaaacagggataagaagtgtagaagagatagggcgagatagaaatagtctacacgaacctcgatgcaattctaggcgtttaaaaagtgacagtcttttaggcaaaacttagacaatctaaaaagttaattaggaaaacagttactttttaaacgactctccacaatcgacattcctttgagatgcacgaggcccactatcgtaggttgaggaagtttaggccatttaattgtcagggcatgattatgtgttgatatcttcctattctgcatttaatcactgaagatccaaaacattatattaccagacttaagatttcttgggcgcgatttgatcaatattatttattaggtccttgattctcacgagtcacgaccacttacgaagttatgatcgatcaagagatgattgtgcagggaagattaatatttgagtgagtcaattttggactacatgtctacattaatagcttgacgatcaagaacgaaataagaaaaatatgctctatgatttgatcgatcgatctcgaattatacgttatgatatgtaaacaccagagaaaattgggatcgggatatgcaatctagtactagatattatttaattacatactctagtatgaaaactatcgtgcaaatcgggatactcttgagctggccggaatatttttcctggaatgcaaaaataattacgaattacagatcaatgccgtgcgcccgtgcagatgcaatggatatatatatcggccacgttgctgcttcttctaatataataaggcaatctcgttgcctactttgcacgatgtgagctaatcacacgaagtggacaacaagttcgtcatgtgatttgttgtctttctcctttgtgctttgtgcatcgaatggcatcccacaattatccaaaaaaatttacaaaaagcatttcactgagcttttgtacgtacgttatttatactacctccgtttttatgtaataaatacataagcctgttaacatttcgatattacatttgtcttcctaaataaaactaacatttatatttggtgttgaacttttttaataattaaatgtacttggaccattatatacttttgcacatttccattaaagtttttaataagataaatgatcaaatatcacgttaaaaattaacagcatcaaatatttaaaaaccgagagagtagtttggaacacatgtttaagttacagtcatttaaacttgaaatattggctattattattgaacctaggaacaagatagtagttccaaaatttaaggtgtgatatcatattttgtattatccattttacaatatattgttgatactatctttttatggaccgccacttcgaaaaagcaaataatacttatctcagtctccagaaagttaccaggaccaaataaataaattttcaaataagtaatcttatttttcagtaaagcaaagcaataatgaacttatgattttaaggcttgctattcactctataattatatattgccgataaaattcatcacaacaaaacaaaatagtgtcaggaggagtagatttgttgagaaaaaaaagaccgagaataacgtatttggcccaattaagtatatacatatgtaatgcgtaatatacctacatgtgttgaattattttcggacaacttttgagtattcactccaatacccaagagcctccctgtgtcccaccctgaagcaaacaaaccaggaagaacaataacaacagcatgggtagatatgttggcatccctgtaaactctataactcaaacttgaaatcggcagctctaaattatttaattagtaactggactaaaatatatatttctcgaaaaacgaagtggacaaattagaacttccataaatttagttttctcattaaaataagattttgttcagatttaagcatgatattctgctggtaagttatatgatattatatggagcatgtgatgatttttttaaatattcttttaagtcatttactaatgcaaacatagttgggggttaacttggaccaggttgtcgaaaaactagtataaagccacacagccacaagctagaatatccatcaataaacacatcatactgccatctccctcaactagttgcaaaagcacacgttcttccaatattccatcagccatgcctggagcagctgctgccgctgttgttgacagccgcctgtgcacacagcacgcggaaggccctgctgcggtcctcgccatcggcactgcaaacccggcaaatatcgtctatcaagatgggtttgccgactactactttggtctaaccaagagcgagcatcttattgagctgaaggacaaaatgaagaggatatgtaagtagaacaatcctttcatttcgatcgttgcattgatcatcattatcgttagttgtttttcataaactctaatgagaataaattatgcaagcgcttaaatttttaggacactcctgccataattcattataaaccatacaaatatttatactatactacgtagaaagaagagtgaaatgatgttggagttcagccaaattttctttatttcgcgtgtgggatgcaatgtggatgcatggggtgtggttgcatcccaaaatttttgaaaaaaaatctactatatacagtatatacttggtacatatacgcagtatgctcaatacgaggcccacttaaggtcatccaggactatatgctccatttgaatttctacattatttatgtcattgtatttgtactcgctatatttaagtgttttgctagtatatttttttcactttatctcttatcttgaatcataacagtaaagttttgcatctccatctctgaaatcctggatccaccactaatacctcgttaaatatgatagtttgtcatataatgtccctcctgctcatcaggctaccatctcgcacccatgccactgtactcgtatagatttaaagactacgcttttaacaaaaatacaagagatctacagagtagtcatagcaataaatccgtggatcttaataaatttgtactgaaaaatagcacttacttgtctatatgttggcaccgggaattgagtcttagtggatagagttatgcacccacaagtacatcattagaccatgtttgaacgaaacatatgtgctaatccaatctttcagaacattaaactcatgattatcttcctaaaaataggacatatataaaccatttttgttttattacggaaaatgcttgcataatatcatatattcttgttttgtaaatattcggcatcttaattgaaatgtctcatgttattcttataatctcttagtgctatgtactaattgtaagagatgtgggtgcatccttttccatttcaggtcacagatcgggaatagagaaacgctacatccaccttgatgacaagctcatctgtgagcacccggagatcatcgacaaacacatgccctcccttgaaactcgtgtagacatcgtctctactgaggtcccgaagctcgccgagtcagccacacggaaggccatcgccgagtggggccgtccggccattgacattacgcacctcatcttcagcacctactccgggtgcagtgctcctagcgctgacctcaagctggcatcactactcggcctcaacccttctgtttctcgcaccatccttagcctccacggttgctctggaggcggtagggcacttcaacttgccaaggagctcaccgagaacaaccgtgatgcacgcgttctcgtagcctgtgccgagctgacgctaatatgcttctcaaacccagatgaaagcaaaattgtcggccatggactgtttggggatggtgccggagcaatcattgtcggcgctggcccactggtcgatgaagagcgcccactattcgagatggtcctcgcctcgcaaacaacgataccaagtactgagcatgcacttggcatgcagaccaccgccagtggcatagatttccacctctctatccaggtgccaacactgatcaaggacaacatccggcagtgcttgcttgacacattccgatcggttggaaacatggatcctaattggaatgacctcttctgggcagtgcaccctggtggccgtgcgatccttgacaacatagaaggcgagcttcagctgcaaccagcaaagcttgcggcaagccgccatgtgttgaacgagtatgggaatatgagcggcacgacgatcgcgtttgttcttgatgacttgcgtcgccgtcgggagaaggaaggagatcagcatcaacaacttgagtggggagtaatgctagcctttggaccaggtatcacaatagaggcaatggtgctgcgtaacccactctcatgaagtcttaaggaaaattaattgccactatcttatgcttgtctggtatcttattacggtatatgttaattaatcaatgcatgacactaaatcaattctgcatgcttaagtggaattatgacctaccggtgatgtattgatgttgtggagttcctatctaatgtttattgctgttttttctgtatttgtaacaaaatttgtaataccctgtgtataattgaaaaagcatattgcttatatgagttgcttcaatccgagtttggatcaattgagatgtatctttcaagaaaacacttgaataagatcaagtcagtattttgcaagtgaaaaaatgttccaaaacaagataaaaagatgcaatcaatttcaacttaatctttagtaattaagattgtttttcttctcaaatatacatgagatgttgtgtatcattgcattaatggaagaacggaggcgtaagatgcaaatacaaataatcagaaaagacaaaaagtgagaaaacaaaacacgagcaaaagaagaacaaagtgcctaaccgaggctctcccaacaacctgaatcatgggccttcttaaccgggatctataatcaacgaaattcccctaggctcaataggtgagcctcgtcactcgctagaactagtcgagaagatgattggagcagcctcgttgaaaacacaggcgtttcgatgcttccaaatagaacatgccctaagaatgatcatattatttatacccttccttatagcccgttttaccaaattcttgtgtcttagctagggagatcgatctgctttcagaaccggcggcgcgttcatcttctcgtcgttcgatctgatcagcgagaacaattctgacaccggtgtgttcttcgatagatccatctgatcggcggcagcatacgcgcttcatcccacggcgagttctttgatgaatctggttggtggcggcaggcgtgcgtcctcctgtcgtctcatcgagttaatcggctcgacgtgattgagttttcggcgcagcaatccgaagcggagttcttttttgctaccacgcatccaccgaaaaagcagcagcgcatagctgcacggctctggaggaggaagaaaaatcaattgaagatactgctcgcttcgtgtttatgtgaagttccaaattcctgttggatttttgtacgtccacaaagactttatatcagggaatttcttttcttttggaatctattatatatattttttgatctggaattgtttctccaacatgtcatgtatcaaatttgacattgagaagtttgatggcaagattagtttttgcatatggcaggttcaaatgaaagttgttcctacacaagttgatgttcggaagcgaatatgattgatcaaggggaagataggctgtgttatctgtgtgaatggtaccgtatacaggttcttaagaaggaatcacaaataccgttccaaagcagcatatttcgacaacactgaatagcttgatgatccaccaggaccatgcaagggtgatagagtgttccaaatgacgaaaaatctcaaagtttttttttgagaaggcaaaaaagaaggaaaccaagcggaagcgaaatgcggaaggaccaagcgttctattcaatagatatatagatacatcattttatcggtgtcatgcacctagagaaaaatgtgttctatagaaccattgggactttagtagccataccaagcaagacaaatgatggactgaagtcacataatgtaacagcccgtcctccagaaccgcgtagcctagaccatccaatgggcgggcccacttacacataccactcccgtacacgtttatcctcgctttgtataaaagtgttaaccctggagtgatatggttggagggacaagcccactcttgctaaactagcaagatggtactaaatatacgcacacaggtcttattggccacacatgccatgtcctaattataccaggatgtcacacaccctcctcaaaggacccgacatccccgttggcccaatttacccatatagtcacacacaggcatataggtaaatgtctaggaacacaccccctcttaatgcttagtgcagtccgccttacatagagcccacatgtgccatatacccgcacactgacccatacaagcaaccgcgagggtcggaactgataccattttgtaatggcccgccctccagaatcgtgtagcccagctcgtccaacgggcggtcccacttacagataccactccacttacactttcgtcattgcttcgtgtaatagggttaaccagggagtgatatggttgaagggacaagcaaaactagcaaggtggtactaaacatgctcacacagctatcatgtactccttccaaaaatctgagacctatttcattctttggtttttctcaaaatctaagtcctatttgtagtcactatgtactaaattgaattgttgatcagaaaccaataagtcattctaataattattggttgcatgctcattggttttgccatatggtgagtgagttaattgcttcttggtattgatgcaaaaagaaataggtctcatatttttggaaggagggagtaccacataggccatatcttaattgggccaggttgtcacatgtaaggaccttgtgaatacgcagataacagaagagcttcacctgcggatgaaggtaatggaagagttgtaacatcccgcctctcctaggccaggcctacttacatctggtagcttatcttggacatagactaccctcacagaccaacacaagtcttttctgcatactttgtcctcactcgtgtgcacccgggaagaattttccggtcggtcacccatcccaaaattgctctacgccaagcacgcttaacctctgagttatttggagatcggttaaggaaaataagttgcaacctgatggtatgagtattctattaatcctattaagccctaggccaggatgtcacaagagtgcacctttcgctgacttattacaccttgacaaattatgagaaaatggcattgtacaaatccctacacgaggtgagagtccctaccggtttctcctcaaacataaagcggctagtgtcgatgaaggatttatagcttttgggctacatttctcatgactgtcatgtaatgctcataatattcattgctattgcaatcaaagtaatcaaactagtacacgtaaagatggttgtcacaaaactgtgttatttcttcaatgcaatctcacataaagtaattgaccttgaagagttaggtcatctccgtgttttcgctatagagaccttgtgcaagcttgagatgtgtttccctctgtcatttttcaatatgatgcaacacctcatggttcatatcgtgcctcagatacttgtgcttgggcccttgtaccttcatcagatgtggacattcgaacagtatatgtccaatctaaaaaggctatgtacggaaccgtgcccacccagagggttcgatgatagagggatacactaccaagaaagtcattgagtgttgcattggttacttgcaagatgggaaagcaattggtttactagtacctcgacataaaggtaggttatctggaagagggacaaaaaggaaaaaagaatcctcgacaatgactacaaagcagtgaaagatgctcatttcattgtcctgtaacagcttgtgatagtggagctgtacatagagcagcacctaaaggaattacaagcaagaaatgtcaggcgctctgaagcatggatcatgaaatggcacaaatctgactttaccgaatggttaaaggacctcggccgaccatatggtgatagcacgaaggaaaaaactatgaaaagtttggctgacgggcattcaagagtgtacacctcatggtgagcgtatatctgaatgggtacacattttataccaaagcaagagacaaaaggagtgcatctcaaaataatggcgttcaagtataggaaatcgacacaacaggtcaaaagagcacatactatgaattcatagaagaaatttgggaacgggactacgaacccaatatgcagattccaccgtttcggtgtcaatgagtgaaacacccagctggcgtgtttgtggacaaatttagacggacaattgctgaccttgacaacgtaagccacaagaataacccattggtacttgccgatcgagccacccaagttttttacgtgactaaccccatctcagttgaagaaacacatagttatttccggaaaacaaaggattttgggagttggtgatgttgaagatgttgaggcatacaatcaatacgagaacatgacactattcatggattttggaaactacattaagcttgtagaagaaacaattagtgaatcgccgaagccgtacatgaggaataaaggagtaaggaagaatgtgaacggctaataaatgtagtcgctgttcaatataaatatgaatcaatgaatatttacatatgaatgtgtgacatgatggacgatgaattttttatggatggtgaattttatattatttgttctcatggtttttggtgtttaaaaaaagagaaaagaactaaaatttataaaataagaaaataatgatatattagttactgatggtgacatcatggagactctgatagaaaaacctgtggtttacgttttggggtgagggttgggctgggtgggggcactactagagccacagggatggaggctggcagtcggcatggttggtagtaggggcgagggaggctgtgtagttaggaggaggcgattggcggtggtgattttgaaagctatggcagtgcgccactgctgttcaatcaagaaggaagagagggagggacgtgggattggggaacgggaaggaggcttgtctggtgggcctcgctggcaccgttgaccccttccggccatccggcgagccaggggtggtacgttcggcgggaaggtggcggcgatgatgtatatcagcggtaatccatcctgcatgtgtgcgtgcttgaaatagggacaagaagagcaaaagagatagggtgagatagaaatactctacacaaatgtcgatacaattctaggcgtttaaaaagtgactgtcttttaggcaaaaatcaattaggaaaactgttattttttaaatgactctccacgatcgccattccttcgagatgcacgaggcccactaccttaggaagaggaagtttatatcatttaattgtcagggcatgattatgtgtcaatatcttagtattctgcatttaatcaataaaggtctagaacattatattagcagacttaccacttcttgggcgcgatttgatcaaatattatttattgggaacttgattcgaccacttatgaagttatgatcggtcatgagatgctgtgtggattgtgcagagaagattaatatttgagtgactgaattttggactacatgtctacattaatagcttgacgatcaagaacgaaataagaaaaatatgctctatgatttgatcgatcgacctcgagttatacgttatgatatgcaaactccagagaaaattggaatcaggatatgcaatctagtattagatattatttaattacatactctagtatacaaactatcgtgcaaatcgggatactcttgagctggccggaatatttttcctgtaatgcaaaaataattacgaattacagatcaaaaatatatccgccacgttgctgcttcttctaatataataaggcaatctcgttgcctactttgcacgatgtgagctaatcacacgaagtgaagttcgtcatgtcatttttgttgtctttgtcctaatttgtgcatcgaatgactgatctcacaattatccaaaaatatttacaagaaacatttcacagagctatgtacgtaatttatactacctatgtttttaaatacataagcctgttgacatttccacattacattcgtcttcctaaataaaactaacatttatattggttgtgatttttttaataattaaatgtatttggaccatgatatacttttgcacatttccattaaaatttttaataatataaatgatcaaatatcaccttaaaaatcaacatcatcaaatattttaaaaccgagagagtagtttggaacgcacgtttaaattacagttcatttaaacctgaaatgttggcagttattattgaaccttgcaataaaatagtagttgcaaaacttaagacgtgattatccattttacagtacattgctgatacaatcgtttttatggacagccactttgaaaaggcaaataatacttatcccagtctcgagaaagttacccggactaaaaacatatcaattttcattttcaaataagtgttttttgtttcagtaaagcaaagcaacaatgaactcatgattttaaggctagctattcactcaataattattgccgataaagttcatcacaacaaaacaaaatagtgtcgggaggagtagatgtgttgagaaaagaagaccgagaataaagtattaggcccaaataagtatatacgtatgtaatatgtaatatgaaaaagtatatatacatccctaaactttatattgaagtctgtctagcacattgcactttaaaatcgaacatccaaccccctgaactttgccataccatccatattaccgttaaggtggttttggatgatggttttgcatattttagaagcttaaactgttgagttgtgatccaaatttatttacacttaataaaggctagattctgccgtagtgaagcggaggcccgtcgccggtaggcttggttcagagccttttagggttccaccttttacggtacggatcgtaataccttttagggttctacctcatatatatatatatatatctcttgtaagccgccgtgcggcattgtaacctcacccaatatagtgaagatattttactggctagcgcccgtggctttttctctcctgctttgggagggttttccacgttaaatctcatgtcttctgtgattgatctgtattgttctttatcgtttatttgcctatcgtttcctaacataaatgacaattttgaataactaatgtaacatatttacgtatcatcagttataaatcatcaatttatcattatatagtgatatcatgatattattatattggtgcttgtttgttagtgagagcaaataaaaggcaaaaagaatgatttaagtcaaaatttttgtatatatgtccaaagtatatgacatgtgatcaaactcatccaacttatatacaaattagattaaaaaaaccactatgcaaaaccatcttagggggttacatcaacggtattctaaagtttagggggttgaacgtccagttttaaagttcagggtgctagacggaattccatcagaagtatagggggttattaggattggaaaaagtttacatgtgttgaattattttcggacaacttttgagtattcacttgaatacccacgaatctccctgtgtccacccctgaagcaagcaaaccaggaagaacaataccaacagcatgggtacacattttggcctccctgtaaactctataactcaaacaagaaatcggcagttctaaattattaaattagaaactgacctaatatatatatttctccaaaaatgaattggacaaattaaaacttccataaatttaattttatcattaaaatgagattttgttcagatttaagcatgataatctgcttgtaagttatatgatgttatatggaccatgtgatgattttttaaatattcttttaagtgatttactaatgcaaacatagttgggggtttccttgggctaggttgtccaaaaactagtataaagccacacaaccagaagctagaatatccatccataaacgcatcatactgccacctccctcaactagttgcaaaagcacacgttcttccggtcatcagccatgcctggaacagctactgccgctgttgttgacagccgcctgtgcacacagcacgcagaaggccctgctgcggtcctcgccatcggcactgcaaaccccgcaaatatcgtctatcaagatgggtttgccgattactacttcggtctaaccaagagcgagtatcttactgagctgaaggataaaatgaagagaatatgtaagcagatcaatccttccactttgatcgttgcactgatcatcattatctctagttatttttcataaactctaatgagaataaattatgcatgcacttaaattttcaggacactcctgccatagttcattgtaatgatgttggagttcggtcaaattgaaatatgtcctgccattataacctcggagagctatgtactaaatgtaagagatgtgggtgcttccttttccatttcaggtcacagataaggaatagagaaacgctacatccaccttgatgaaaagctcatctgtgagcacccggagatcattgacaaacacatgccctcccttgaaactcgcgtagacatcgtcaccactgagatcccgaagcttgccgagtccgccgcacgtaaggccatcgccaagtggggccgtccagccactgacattacccacctcatcttcagcacctattccgggtgcaatgctccaagcgctgacctcaagctggcatcactactcggcctcaacccttcagtctcttgcaccatcctcagcctccacggttgctctggaggcggtagggcactccaacttgccaaggagctcgccgagaacaaccgtgaggcacgcgttcctgtagcctgcgccgagctgacgctaatatgcttctcaaacccagatgaaagaaaaatcgtcggtcatggactgtttggggatggtgccggagcaatcattgtcggcactggcccattggtcaatgcagagcgtccactattcgagatgatcgttgcctcgcaaacaacgataccaggttatgagcaagcacttggcatgcagaccaccggtagcggcatagatttccacctctctatccaggtgccaacactgatcaagaacaacatccgacagtgcttgcttgacacattccaatcggttggaaacgtggatcctaattgaaatgacctcttctgggcagtgcaccctggtggccgtgcgatccttgacaacatagaaggcgagcttcagctgcagccagcaaagcttgcggcaagccgccatgtgttgagtgagtatgggaatatgagtggcacgacgatagcgttcgttcttgatgacttgcgtcgccgtcgggagaaggaaggagatgagcatcaacaacctgagtggggagtaatgctagcctttggaccgggaatcacaatagaggcaatggtgctacgtaacccactctcatgaagtcttaaggagaattaattgtcactatcttatacttctccagtatcttattacagtatatggtaattaattaatgcatgacactaaatcaattgttcatgcttcagtgggattatgacctacttggtgatgtattgatgttgtggagttcctatataatgtttgtgaagatatttgagttgtcaattgctcaactctagtacatgttgtaattaaactctttatttctttcatatgccctctgattgttaagttttttttttgttttgtaataaaatttgtaataccttgtgtataattaaaacaccatattgcttatatggtttgcttcaatcattttgatcaattgagagtatttttaaagaaaacatttgaataagatgaagtcaacactgtaagaaaatgatattttacaagtgaaaaactgttcaaaaacaagataaaaagaggcaatcaatatcaacttaatatttactaattaagattatttttcttctcgaatatgcatgagagttatgtagcattgcattaatggaagaacggaggaatacgatgcaaatacaaagattcagaaaacacgaaaagagagaaaacataacacgagcaaaagaagaacaaagtgcctcaccaaggttctcctaccaacctgaatcacaggccttcttaactgggatccataatcaacggaagtccctatggccccgcctaaactccataggtgagcctcgtcactcgcaagaactactcaagccaaaatgcttgaggcagcctcgttgaaaacataattgttttgatgcttccaaatagtccatgcaccaagaatgatcagattatttatacccttccttatagccccttttaccaaattgttggccctgctccacctatcggagaagtgggaacaggggttccctttcccccaaggtgctcggggcgctatgcgccccaccaagccttacaagatctacatctttaaggtttcaagaagagtatggagacctacaatatctacatcttcaaggtgcagaagcaggcactggtgtgtactagtgtctcgtcgaaagtcatgcccatcatgaactccttatttatcaatatttttgagaagctcatctaatataccaacgaaatatactttcggcaatgcaaatgcgcccgaatatgtagggttgccccgaggacttggcctgccttgaggacaaggggtgacccaaacatggcggccaaccggtgacaagattgtaatccctcaagaacccgaggactccccgctcaatcaatggagaggttcaccacattaaggaaagctactcgggtccagaaatcacatttaaaccaccactttacattaattatgatggtcctattgatctaaagtgctgtcatccacaagcgacttatgagattgatctcatcgggagtggatcgggcaatatggaactcggattattggttctgtgagcttcaggaatatcacgaattcggctctggcttcctccagattgtttctcaatgtggatttgtctacggcttctcaatgtggccctccttgaacacagtggccatgtgacgggctatagtttaggcccgttagagatgagagtcatccgtgacgggcttttgtgttggcccaattgagatgcgtcatccgtgatggccggatgcctgattgagatattttctcacatcacggacctttgcttagtgacgagggccctgcccgaaagagatgatgatttaagcccgttagagatagccgatcccgttctagtgattttatgtggagtacaatgatgcaaataaatattaaaaataatatgtaatttaaaatatataagtcattaaagggttaaaaaagacatacaccatatgctaaagaggatttatatatgggatagagtggtctccggttagaactaaagcactatagtgcactatctagtcacgtcctatcctaaatggtaaaaaaaagtgacagaacttcttattttggggcatctgaattagacacttccaaaaaattaattaggaaaactagaggcacccctgaaggtcgtgccagccgaacttgccactctccatgatcaccgttcctttgagatgcatgaggccaccttaggaaagggatgtttagctcatttaattgtcatggcatgatgattatatgtgtctatgtcctcctattctgcatttaatcactcaagatccacaatgttaccagacttaacacatctcgggcgcgatttgatccatgttacttaatttatttattgggtcattgattctcatgatcacttatgatcgattatgagacgcggggtgattgtgcaaagcagataattattttaagaatgtataaattacattaattttggactaagtacattaatagcttcacgatcaaaaactaaatatgaaaatatgctctatgattcagtcgaccgatctcgcgttatacatagtgatatgtaatctccagagaaattggggtcggtatatgtattctagaattagatattatttaatggcatattctaatttaaaaactatcgtgcaaatcgggacacttttgagcaggctgggatattttcttgtaaaatccaaatacagaaaaataattagtacgaattacataccaatgccatgcgctgcaggtgcaattgaaatatcatgatatggcaatatcggccacgttgcagcgtcttctaatataataagtgtttattgcctactttgcacgatcttggagctaatcacacgaagtggacaacaagttcgtcgtccagataccacattagctgctttgttatctttctttgtgtgcatcgcatggcagatctcgagacaataatcgtcttcttaaataaatctatacgagtatcatgaaagtacattaaccattatattacttatatttttcatatttacattaaaacttttcataagacaaatgatcaagcataatattaaaaattaacagcattatattaacatttcaaaacagagtgagtgagtagtttggaacgcacataagtaactagtattaattttaaacaactattaattttaaactttgaaaattattatagaaccggcgaaacaagatagtattagtaaaattaaaggcatagtatcactttttgggttatccatcttacagtacattgctgatacaattgtttttttaccgccactttgaaaaggcaattaatatttatctaaatctttggagaattatcaaaactaaaaagatcaatattcaagtaagacattaatatgtttcggtaaagcaacgccagtaacagacacgggacttcaagactagatattcactcaacaaatactgataaaattcaatagaacagaacaaaataatgtcagaagtagattctgagaaaaaagactgagaataaaatattagacccaattaagcatacacatatataatgtaaatgcatatattgaattattttcagtgaacttttgagtgtctgctccagaagcaaaggaccaggaacaacaataccaacagcattttgaccataagatgggtagatatgttggcattcctacacatttatgtaaactctataattcaaatgaccaggaacaataccaggagcattttgactgtaagatagatatatatgttagcaatcttcacattttctgtaaactctacaacgcaaactagaaatgggtcgaggccagttcagaattacaaaattagtacctgcactaaaatatatatttctccaaaaacgatttggacaagtcatacaaaaatttaattttatgatcaaatgtgattttgttcagatttaagcatgatattctgcttgtaagttatatgatattatatggagcatgttttgattttttttaaatattcttttaagtcatttactaatgcaaacatagttgggggctagcttgcgccaggttgtcgaaaaactagtataaagccacacagccagaagctagaatatccatccataaacacatcatacagccatctccttcaactagttgcaaaagcacacgttcttccagttccatcagccatgcctggaacagctactgccgctgttgttgacagccgcccgtgcacacagcacgcggaaggccctgctgcggtcctcgccatcggcactgcaaaccccacaaatatcgtctatcaagatgggtttaccgactactacttcggtctaaccgagagcgagcatcttactgagctgaaggacaaaatgaagagaatatgtaagcagatcgatccttccactttgatcgttgcactgatcatcattttcactagttattttttcataaactctgatgagaataagttatgcaagcgcttaaattttcaggacactcctgccatagttcattataaaccatacaaatatttatactatgtagaaagaagagtataatgatgttggagttcagtcaaattttatatacctcgtgtgtctgatgcaatgtggatgcacggggtgacgttgcatcccaaaattttggaaaaaaatctactatacacacagtatatacttggcatatgtacgcagtatgctcaatacgaggcccacttaaggtcatccatgactattgatctgctccacttgaatttctacgttatttatgtcattgtatttgtactagctatttatgtactgttttgctagtatatttttttcactttatctgttatcttcaatcataacactaaagttttgcatcccatctcagaaatcctggatccaccactaatacctcgttaaatatgatagtgtgtcatatactgtctctcctgctcatcagactaccatctcgcacccatgcctctgtactcatatagatttcaacagtctacgcttttaacaaaaatacaagagatctacagagtagtcatagtaacaaatccatggatcttaataaatttgtatagaaaaatagcactcacatgtctatatgttggcaccaggaattgagtcttagtggatagagttatgtccccacgttacgagaaaatcataagatcatgtttgaacaaaacatatgatgtgctaatccaatctttcagaaaattaaacacatgttcatcttcctaaatataggacatatataaaccaattttttgtcttgttatggaaaatgcttgcaaaatctcatattttttttgtatttattcggcaacttaattgaaatatgtcctatcattcttataacctcagagtgctatgtactaattgtaagagatgtgggtgcttccttttccatttcaggtcacaggtcaggaatagagaaacgctacatccaccttgatgaaaagctcatccgtgagcacccggagatcatcgacaaacacatgccctcccttgaaactcgtgtagacatcgtcaccactgagatcccaaagctcgctgagtccgccgcacggaaggccatcgccgagtggggccgtcctgccattgatattacccacctcatcttcagcacctactccgggtgcagtgctcctagcgctgacctcaagctggcatcactactcgggctcaacccttctgtctctcgcaccatcctcagcctccacggttgctctggaggcggtagggccctccaacttgccaaggagcttgccgagaacaaccgcgatgcacgcgttctcatagcctgcgccgagctgacgctgatatgcttctcaaacccagatgaaagcaaaatcgtcggccatggactatttggggatggtgccggagcaatcattgtcggcgctgacccattggtcgatggagaacgcccgctgtttgagatggtccttgcctcgcaaacaacgataccaggtactgagcatgcacttggcatgcagaccaccagcaatggcatagatttccacctctctatccaggtgccgacgctaatcaaggacaacatccgacaatgcttgctcaacacattccgatcggttggaaacatggatcctaattggaatgacctcttctgggcggtgcaccctggtggccgtgcaatccttgacaacatagaaggtgagcttcagctgcaaccagcaaagcttgcggcaagccgccatgtgcttagcgagtacgggaatatgagtggcacgacgatcgcgtttgttcttgatgagttgcgttgtcgtcgggagaaggaaggagatgagcatcaacaacctgagtggggagtaatgctagcctttggaccaggtatcacaatagaggcaatggtgttgcgtaacccactctcatgaagtcttgatgaaaattaatggccacaatcttatgcttctccggtattttattacagtgtatggtaactaattaatgcatgacagtaaatcaattgttcatgcttaagtgggattatgtcctagcggtgatgtattgatgttgtggagttcctttctaatgtttgtgaagatatttgagctgtcaactactcaactctagtacatgttgtaagtaaactctttattgctttcatatgccctctgattgttaagttttttggatttgtaacaaaatttgtaataccctatgtataattaaaacaccatattgcttatacggttttcttcagcccgaggtttgatcaattgagatgcatttttaaagaaaatacttgaataagatgaagtccgcacggtaagaaaatggtattttgcatgtgaaaaactgttgaaaaataagataaaaagaggcaatcaatatcaacttaatatttcctaattaagattatttttcttctagaatatgcatgagagttgtgtatcattgtattaatggaagaccggaggcgtaagatgcaaatacaaagaatccgaaaacacaaaaggagaaaaaacaaaacacgagcaaaagaagaacaaagtgcctcaccaaggttctcccaacaacctgaatcatgagccttcttaattgggatcgattatcaatgaaagtccccttggcctcgcctaaactctataggagggccttctcactcacaagaactagtcaagccaaattgcttggggcagcctcgttgaacgcaatcgtttcaatgcttccatatagtccatgcaccaagaatgatcagattatttatacatttccctatagccactttttaccaaattgttggcccagctccacctgtcggagaagtggaaacaagggttccctttccccctaggtgctcatggcgctgtgggccccaccaagcactacaagatctacaccttcaaggtttcaagaagaatatggagacttcaaagtatataagcgggcattggtgtgtaccagtgtctcgtctaaagtcatgcctatcatgaactccttctttatcgatatcttcaagaagctcgtccaatataccaacgaaatctactttcggcaatggcaccgtgcctgagtgtgtaggggtgccccaaggacttgcccaccctatggacacggggtgacccgacacacggcagccaaccggttacaagcttttaatccctcagggcccgaggacgctccgttcaatcaatgaagaggttcaccccattaaggacagctgctcgggtctgatgctcacatttaaaccaccactttacattaattgtgaggtgaactcatacacaacttgggagacgtggtagcacatgcaaccccttgcatgcccacgttaccccggagaacacaaggcgtgcgacatggcgcgtccacagcaaccatccccaagttccacccctgttggctacggtcgcttatgggtagcccgtggacaattggaacgaagacttttgattcatctctccacttgttagttggtaggcatggctttcacatctggtcagctggcttggagggactactacaagactaagcatattaagtttagaggagtaggccccactcgtacatgcatgcaatggcattgtggactccccttcatgtgtaaaatgaggatccgtgccatagagaaaagggttcacactctcatctaaattagattagccaaacatccagtgatcaagtaacttctcctcacacttcttcttttcccgcatcactttgtgattcccttcaacatccatagtccacacacagaagtaaggtattatgcacccgtgcgtcttgaacctatgtactcgcttggaaatttggagcaaaagactttcacatctcaatgttctaatctcaaattcaaacaattccattgtaatgttggacaatctaaaagaacaaaaaccactttccattcaaaatggaacttctggctaatcctgagagaacacatcctaaagctactacactatagaagtacattttggaaaaaaaaaaggtgtagtatcatatgggtgaaatttggagacgataataaaaaaaattcatgctgctaccacaaaaagatatagaagtaacaagatttctcaccttcatctccatgatgggattgtgatttcctcacatgcagacaaagcacttgctttcttagcacttttaaaaataaaatgggcacctcaaagcaaaatcaaatgattaagcaaaatcaaatcattatcaatttgcaggagttatttacaccttaggagggactctctacctggcttctatgatgaaatgctcgaaatcatcaattcaatgccttgagatagagatcatgggcctgatggtttcaatgggatgttcctcgaaaaatgctggcaaattatctctgatgatatctattccttgcagattcagttttgttttggcattatatctgtgggcagtcttaatagttcactagatgaataccacgccgcgttgctgcggaaaattaagttacataatatgtacaaataaaatatatttttattatcaaaactaaaacaatttgatacaattttgagcctaaaaataattgagattgcatgtttttatgagagatgaaagacgagacaatttagatcatagatctatcatccaaatgctagaaataattggggtgatatgacttaatgggagaagagagaaatagcattaactatacttagtgtggaagaactatataagtatataggattcgtcactctaattcctaagaagccaaccctggaaacaacaaatgattagttaagattcttaaaaactagttaagcatattagatacatacaatattattaatatgtcatgataattactagcaaataatgcaaaatttataaataatatatatcacagaacgtgcacaaacgaactggctgatagtgttcagctaccaagtttagtgaccacaaaatagcaatatcattatcgaaaataaacaccgccagagaaagca

SEQ ID NO: 41635 - DNA, 834 bp, Oryza sativa
cactggtgttcctgggcctgacccagtgctagtcttgggccgaacggagtaaaaacagaaggaaaaagtgcaccaaaggtccctcaacttgtcatcgagatacaaaaacgtcctccaaccgcaaaaccatatatgcggggtccctcaactatataaaaccagtcacccgaggtcccttggtggttttcaacctggttttgtctgacgtggcggctgaatcagcgtgggacccacatggaccccacatgtcagctagccacatcatcaccctctcccctcctctctttttctcccctctctctctcttctggtttggtgctcttggcaggccagtgccgccagccgacggatggcaaggagaccgactgggcgacgcgggagaggaggtccggcgacgtggcggcggtggcggtgatggcgacgacgacgcgggagcaggggagcaaggcagcggcgacgacgatgacgtgggagcaggggagctctcgccgtcgtcaccgagggcccaaccacgatcttgtagcaacgtcggtgcggcgatgaaggggaacctggcgaggagtgctagggccatgtcggcgccgacgtgcaattggtctctcccccctatccccccacctctacaagctcctctgtctcaccgtctccacatccgcctcctccccaccccgcgccggccgctcccggggaccacccatgccaagccccggcccagcccccgcctctcccccctcctcctcctccttctacgttgcgccctagcctcctcgacatggagcgtggctacgccgcccgccgcgccaacgtcgacgtgttcctcacctcgctcggcgt

SEQ ID NO: 41636 - DNA, 19774 bp, Oryza sativa
ccacgcttacttagctgccacttaaatcaaaaccggggtcaaaaccaccgaaggatctcgggtgactggttttgtatagttaagggaccctgcatatctggttttgtgtttcgagaacgttttttatcccgatgacaagttgagggaccttcggtatactttttccaaaacagaattgtttagtaccacctcgcccagccacgatagaggggagccggaggcgctgtatataacgcgacccgataccaaatcacaaagcatacctttctcagccttttggctaagatcaagtgtagtatctgttattatcagtttaatatctgatatgtgggccatatttccatggatattaaattaatattttgtgggggagggtccaccacggtagctcgctactgggcgagccctggctttgcactgctgccttggcccggcgcacctgtaaaattttttaagcttttgctcatgttaatttggtttaatcattgaccgaattaaactgactaggagtgaaatcattgatgaatttttgacttgacttgacttttcagtgaatgattttaagatttatttgtccaaactgagttattttggttccagtttatattgaaaaacaaacaaacgagaggtgtgtatttggtttaatcgttgaagaaattaaactgactaggaatgaaatcattgacgaattttttactgactttttagtgagtgattttaatatttatttgtccaaactgtgagtgattttggttccagtttatattgaaaaacaaacgaacgagaggtgtgtatttggtttaatcattgacaaaattaaactgactaggaatgaaatcattgacgaattttttacttgacttttcagtgagtgattttaagatttatttgtccaaaccgtgagtgatttttggttccagtttatattgaaaaacaaacaaacgagaggtgtgtttggtaagcctcgtctcgaaatggcgacttgctccgctgcttgcgctcgcccagccgtcgtcgtcttcgcgtcgccggccgccgcgcggcggcgcgccgcctcctccgtctacctccctggtcggcctctgcgcggcggcggcgtcgtgcgatgcagcgctgggcctgtaagcggtgggatgatctcgaagaagggtaagatatgttcctcctcgtctcgcgtggggatttttttcgcttggaaaaatctgacggtggccgtggccgtggcagtggcggagctgtgggcggcggcgaggagcgcgtcgccggtggcggtgatcgccgcggtggccggagcggcggtggtctacaaggtggggtccagtctcctcgcgccgcctcctccgccggcgaggccccgggaggagcccagcgaggaggccccgccgcctccggagccggtgcaggtgggggagatcacggcggaggagttgctgcagtacgacgggtccgaccccgagaagccgttgctcatggcgatcaaggggcagatctatgacgtctcccagagcaggtcgctttcgttaagccctagcttctgtaaaccctcgttttaaagcttttctgctactatgtttctagtttcaaaaaccaaagctgaattgtggatttgtgatagattattcaacttagttcactgacgagtggaatcagctacagaaatgaagtgcaattcatttaatttggtgactacatctatgctattctattcgttgtgtttgtgaagattacatggttttaagaataatagactaacaggcaagtagagtcgaatcaggatcaatctgaatgctaatcggcaagggcttgttcggttaatccccacgatggagggattggaggggattaattccacctctcaataggtgtggaataaatcccctccgattccccttgaatccccttgtgggagggattaaccgaacaaggcttaaatgtttgatgttcgtatccttcagtcctggaaatgaatataagatcaattttagatttctcaaaataaactgcatattcatatgacaaaattattgttcatatgctgttatcaatgtgcacatgttatctgattgtgtgcttagatcatcagtgatcagctcgccatgggactaaagtctgttgttgttcttatagatcaccactattcgctgttaagtatgcctgctatctgatattgtgtgctacagcatgcagtaacatatgcctcaataaaagtctagaagcctaatactaacttctcagttgggatttatgcatgtggaagtactgtatatttgtaagaacaacatttcctatgataaaaatagagtattatttataacctacatttggttcctcatgaggtctgctgaaagtttggaacttacgcatgaaaaaatgctggatatcaaaggaggagctttaatatcaatatagtattaagaagagagggtgagaagcctgggattgaactcaggcccggtggtagcgctggtagctcttctaccactacaccttgtgccattctctggaacttatgcatatgcctacgtttctccaaatcaccaacttataatgttccctacaatagtgtttttcttgcttacgattacaaaatccatatccagttatccgcactcccagggcattttgttatcttcctcagttcaaactttcagtaatattgtctttgcctcatattgtgtttactgcacataaccttcgtaactaaatgattttctctgtgcagattgttctatggacctggtggaccatatgcattgtttgctggtaaagatgccagtagggcgttggcgaagatgtcctttgagccacaagatctgactgatgatatatctggcctaagtttacttgaactcagtgcccttcaggactgggagtacaagttcagcagcaagtacgtgaaggttggaaccataaaaaaggtgctcgtagaacagggtggcgatagcactgccgatgcaatagaggaggcagctgtcgatggtgaagacagcatcctgactgctaagatgtctaatcaattactatatgaggaagaaatggaagtcggtagtgatgatccatgaaggcttcaggagttgaaaactgaattgccttctagcagctaacttcacgcatcaagaattcaagacaaataatcgcagaatgatgtttcatgaattcatgtgtctataggtgtagattacaagaagatactgcattactgctgtcgatttccctttgtcaatactcaaggatatgttgccgtaatgccatgttattagttggctgtcctgttcgtcaataatttcatatttctacctgcccacagaaccccttttcttggttacatgctaattcttcattctttcttgtattgctctccatgcattcttgtagcattgtccgccatgccattattggaacagcttaatacttcataaataccttgaatctgggggcatgtcaggtcaggtgtaattgatttgaacagcagaggaaaatcaaagcaaccagtgccaaactaggcaaggaacttaggcgcaatgagtaaattattcatccagcacaggtatttcattctctggtttctgatggtggattggtggtttctatcacaatttattttaagattgtaaagggcagaagatacataatctctattgcaatttattttagtaatgcttaattgctaagcatattatcttgtacctagctggcatcgaacaatccattccatgaacatgacatagatgttttcttgcgtaacacaccttggcatgagatctagaagcacaactaatatattcaaatgagcttcaagaacacaaataaaagattgctcaacaaagaaacaaccgacaataaaacaaatattttctcagggataggtggacagcgcatgagaccaacctgaagctgcctttttgtttatctcatcactgcttgtatcatgccctacttcagggagtcaactactttcgtcagcaaaatgcaccaggattgttcagctgcataggaacaagaagttgaatttatacctttttcctaactcccaaagtgtcaactttttcatgttctaaccacctttttcatgatcagtgtgacaggtgtaaggacagaggaagctacttccaacagcaaaattctgaacttctgttttctttgagcctttgaggaagtactattggagcacacaacactcgcacaaattaagtatgtcttctttttttttagaaacatggtagattaaattaaatgataggagatattacaaccctgtttttacaagaaataaaagcaaacgctccgttaaaatagaacaaagagatattgcaagatatgcggacagacgagcgcgtagccactgatgaaatccgatgtcaaacatgttatctgctgatgcccagacatatatgttttctaacacgcttaaaatacttttgttgttctaggcaccagcatggccttcttctaacagttaatagccatcaaccgtgcaaggttgttacttgttaccactacaacacaattacgtagcagtaacagatgtaagatttttcctccttttttttttctgaattgaaagatggatgtaagatgttttgccatgtgaagtcttcaggtaacctaagaataaaagatttagcaaaattgcagtcaaagccaagcctcaccaggtcacccactcaccacacggaagagtcttgttgacgagtagggatcttctgtggcatgatcatctcctttgtttgcttgaaacggtcgcatcgtaagcagccagcaagtagcagagaatgagtcattgtgcacataagatcccagctttgacagattaagcgtccaactaaaacgtgcaggaaaacagccgtatacacaccagcacgatgtcaaacgccatagaaaattagtattgtttaggaaggttcaactctggtcttctaatctgcagtgtgtaaactgagctgccacctttgatgctcctcatttctttttgagaatgtttcccggtcaactacggttcatgcatgcaattgatgcaatctcagtcctgtctaactgaaatattctttgttcttaaaaaggagtgtattcataatcaccgctcagttcttacaattattggtaccattagatcccaactagattacctctaattaattaagttcagaagtaatatagtttctttaaagcaaaggcaagaataaattttaaaaaataatgcagactgaatactccttttttaaaaaaacttactgagagtgtgtttagttcgcgctaaaattggaagtttagttaaaattgtaacgatgtgacggaaaagttaaaagtttgtgtgtagaaaagttttgatacgatgaaaaggttgaaagtttttttaaaaaaatttggaactaaactcggcctgaatactgcatgttgaacaactttctccccgacactgaacaaacagggcaatgctgcaatgttaatttcgaaagggaaactacattttggcaggatggttcttccatggccggcaatgacgggagctttggcttgatgtcgccatttccacgcacactatgttccaaaatgtgagtccaatagcaacggcgcgagaaaggaacattgcaaagatgcaaccgtgttctttgctctcatcagagagagaaacgctccatttgtttatcaaaaaccattttgctaaagcaaaaccacttgggtattagtaaattttagagaatgattcatagcttgtcgtgcctcaaaatcttcgaatatgcgtcgcattattatcgattagtactcatcttcaacatgattaaagaaatccaaaatagacccaagcaattacaaaataaaatgaaaccaagatacttaaaccgagttctaaaatggggttggaatcaatccctctaccacgatttccgaactgttaaaagatgtatttcgtgatattttttacatatttttgaaataaataaataaatctctatagtttataatactagttaatgctcaactaatcataaattaatgacttatcctttttttcaagcctaaggatgagttctattcttctctttcccaattcacctttctcttttttcgcatacacgtttttcatactactaaacattgtattttttcaaaaaaaattataacaaaagttgtttcaaaaatatattaatataatttaaaattatttatacttaattaattatacattgataaaccaccacgttttctaaaatcagcatgagacccttgaccgacatgtgggcccacaaggtcaggagagtgtggccaccacgtcgacacgctggggccgtcggccacaggaggtggacgtgcggaggccatgggagctgcgtgtgcccacctcgcatgctcaaaatttgatggctgcaattcgcgaatgggttttctttcagagatgagaaaaagcgaagagagagataagggtagaggatagaatgtggcagctgcagccaatcagaggccagaggccaccacactccccctaccctctcatcccttccccccaccccccaccaaacccaacatggccatgggattcataaacattttggaaatcttgggatagtcaccttttgtttttggggcttgtagtttttggaaatttgggggaggtccaactcttgctccttttttttttcttttacaacaccgtgtttagttccaaagtttttcttcaaacttccaacttttccatcacatcaaaactttcctacacacataaacttctaacttttctgtcacatcgttccaatttcaaccaaacttccaattttgatgtgaactaaacacatcccaagtttgaatgtgaaggtgaggtcaccacgtaatgagtatttactcgcatttcgctctttggggacccataagataaaaacttaaagcaaaatacgataagttcaatctttcctagttcccacatgctgctaaattttctcggaaatttttattgtataaacttatgacaaacggtgacatgctggaacgtgatatcatctgaatccaatcaagacaataaacttctaaccaaatttgatcaatctcctggtgaaagaaatctcttcatagatctcctgatgaaagaatttaacactgaaagaaaaacaagagattcacaagagcttgagacaaagttacaaattcccccctaacacaggggcctctgaacaaaactaattttgcaatagaaaaattcagagccggcagtagaccgagccaatgcatcccactgttgcgtgggccccacacgccatggcctaaccacccctcctcttcatccccccataacctctcgctccaaagctccaaccttttcctcctcttgaccaagccaagaacaccaatccccgcatcaccaatccacacaagcttcgcagctcgcgcgccgcgggaggggagggagaaaagctcgcccccgagatttttctcctctcctctctgctcgtgtttcttggattggtccatatatccacggttcttgggggcgcggcgcgccgccattgatctggttttggttttgtgaggaggagaagttgcggtggtgctggtgctggtgctttcttgatctgatgatggcgagcacgacgtcagcgacggccgccgggggcgcgttcgccgccgcgaagacgcgggcggggtcgtcggcggcgggcggcggcgcgtgcgcgagggtcgccgccggcgggcggaggcggtccggcgtggtggtgcggtgcgacgccggcgtggaggcgcaggcccaggcgcaggcggtggccaaggccgccagcgtcgccgcgctcgagcagttcaagatctccgccgaccgtgagtatcctcctcgcgtccctagcccctccttttcttcccgcttcgagctcgccggcgttgatgcgacagctgtgaaaatctttgcgtttttcttcgtgttttggtgctttgattactgctagttcatatttgagcatgtcaattagtcaataggtaggttgtgtatggagaagaaaaggaaaagatttgggatgtcgcattgctcttttctagatttgctttgatttgtatgaactatttctgcaggttttctgctaagcgaattttgtttactacctatacgtttaaccggctaagtaatttgagagagaaaagaagaggcaatttgtgagctatcttggcattagagcgaattagcattggagatgacgaacttacacgctaacccaaaggaattattattttttgctgttctccagtgaattgcagggagaaagcacatgccaacttgtttttttgtgggttagttgtagacctgtagtagtaatacacgaaatggctttttttattatggcaaagagcttttcatagtaagtaaccgaataatagtagttcaacaaactggttactattactgcaagatgccaaattttcaaatacataaagatgaaaagaacacgtcgtagttgtattttgttttattattagctattggccaagtatgttgcatggaaaaaggttccactctatcttgttttggtcaattgtttgggaatttgaggttgtaaccctatgtaattagtaattactgcaaaaagtaggtattccagatttgcaaccattacactcataatgtaaacacaggatacacccaaaagaaaaaaaagtatccatgtgcaactattgattgaaaacgttttgtgatgcgccatcgatttttagtttcatccttttagtacaattttttacatgtttacttcttgcagtatttgacaattttttctttcactatcagggtacatgaaggaaagaagtagcatagcggtaataggcctcagtgtacacactgcaccagtggagatgcgtgagaaacttgctgttgcagaggaactatggccccgtgctatctcagaactcaccagtctgaatcatattgaagaggctgctgttcttagtacctgcaatagaatggaaatctatgtggtagctttatcgtggaaccgtgggattagagaagtggtagactggatgtcaaaggtaaggattgtttcatcaaatgctcatttgttctgtccatagtcttcttttctcgtcttttccctttttctgtgactgaagaacgcggtttgtcttagatggttctaattcctctgctgctttttttttcaacagaaaagtggaatccctgcttctgagctcagggagcatctattcatgttgcgtgacagtgatgccacacgccatctgtttgaggtatctgctgggcttgactctttggttcttggagaagggcaaatccttgctcaagttaaacaagttgtcagaagtgggcaaaacagtggaggcttgggaaagaacatcgataggatgttcaaggatgcaatcactgctggaaagcgtgtccgctgcgagactaacatatcatcaggtgctgtctctgtcagttcagctgcagttgaattggccttgatgaagcttccaaagtcggaatgcctatctgctaggatgctgttgattggtgctggcaagatgggaaagttggtggttaaacatttgattgccaagggatgcaagaaagttgttgtggtgaaccgttcagtggaaagggtggatgccatccgcgaagagatgaaagacattgagattgtgtacaggcctcttacagagatgtatgaagccgctgccgaagctgatgtcgtgttcacaagcacggcatccgaaaccccattgttcacaaaggagcacgcagaggcgcttcccgctatttctgatgctatgggtggtgttcgactctttgtcgacatatccgtccccagaaatgtcagcgcctgtgtgtctgaagttggccatgcgcgagtatacaacgtcgatgacttgaaagaggttgtggaagccaacaaggaggaccggcttaggaaagcaatggaggcccaaacaatcatcacccaagaattgaaacggttcgaggcatggagggactcgctggagactgttccgactatcaagaagctgaggtcctacgccgacaggatcagggcttcggagcttgagaagtgcctccagaagatcggcgaagacgccctcaccaagaagatgagaagatccatcgaggagctcagcaccggcatcgtgaacaagcttctccacggcccattgcagcacctgagatgtgacggcagcgacagccgcaccctcgatgagacgctggagaacatgcacgccctcaacaggatgttcagcctcgacaccgagaaggcgatcattgagcagaagatcaaggcgaaggtggagaagtcccagaactgagattgaagaagagatttttttttttcagcccgtgtatctactatgtatactactaccatatctgtccagacattctaattccaattttttttctctctctcttgagcctttgcttactgagccctcgctgagttggtcaaattgtctcgtgaattagcgccatggctgctgctagagataactaggaaaatgccttgtttgtaaattactgcatctgctgtggcaagagctccattttgaagatattatatacacgctgttggtgaaataaaatcagaagttcatcaacctttgaagctgttgttttgtgagcttatatcatttttgtacagttatgtcagatcgtgtatgtaaaattgttgattattaacacttcccctagtgttcagctgtttgtccatgttgattgcctgcactctgcagcgaatcttaagggaatttgtgctcctcaggcttcgttttgtgctgaactggcttttcagaattacacaacaaaccacatactagagctaacaattaattctcgtaatttttcgtagttagtgcacagtgaacacagtggagcccgatttgtataaaaaccatcagaatctgtatcttggaaactcaaaattcaaacacgactagtacgtagtacacccttggtccaaaaaaaaccaaaattctaatacgctatgtatagattcgtagttaaaaattactccctctatcccataatataaggcgtgtacatatttcaagattcaattttaaaaacatttgaccaacaattattataatataaattaaattttatttgctaaaattaatataattgacatttaaatttactttaagatggttataattttgttgcaataaactttatagtatatgagaaattataaaaaaaaattttgaagaccgtaccaagtattattattattttaagctggccggaacagcgacgcgcgccgtgggctggaatctacacccagtctcaccgaaccgggcctggccggcgggccgtaaacctctaattctttcctcgggatgagtagccggcccggcccggcccacccagctcaggcgagaaacctcttccccgcgtcgccgtcgccgtcggtctcgctctgttcacgacggcgaagtgaggagctctcgcggcggatcaatgtgaaccctttgacgcgccgccggctggctgggacacaccatcgctttcgcccatcgcgtcgcgtacgagcaatggccggcgaggattttttttttcttttttaccccaaacctggatcgaattaacgagcctttttttctgtaatatttctgttcttctgtagatgctactattattttttttctgataatgtttttagaagtatattttagaaagctgcatgttctatgattaaagttgcagaaaacaagacccttggagtattttctttaaaaaaaaacttgcaggaaatcacacatattatgatttctggcataaaacccaccttatttaaatctcaagtaaatttagcatatgtgaaaagaatattattcaaaacagcgtagtaacaaaccaacaacatgtattaaaaaatcggaagctaatttttttacagacactttatacgttgaaattttaaaaaaaacacattcaacatgtataatgagtggtgatcaaagtatgatgagtcatcactgatgaagacttcataagtgatgagatggcggattgcatgagtcaggctcttgtgcctaacaaattatggatgccatcactgaaaacttgttgtcttctgcactcctcagagacttcttgagtcttgacatcttgaacagaacagtgcatctcttgtactagcacattgtacacaattgtacatcatgcatagtgatcagctaggctgtctaacttctgctgctaaatcctagctaatccctaactctacaatttctagcccaactctctccaattacagagatatttaatggccatgtgtcctccatcagtggattggtctacgaactgttcttaactgaagttcatgcattgatcattgcttgacacctagattaattcaatactatgcgtaattgcaccttgctccgggtaaagcacaccttgtttcactttgcaccagatttatcatgtactttcactttacactagaggctattgcctattgatatgagattcaattaatatccagatgcagcatcaaacctataaaaactattatgaaatttcagaaaattatgcatgagttattataaaatatgaatacaacttttatgaaaactcatgagttgtattcatattttataagatttatcttcaattatatgaagcaacttgatgcaaaataaaacttatttagatacactctatgtgtaaagtgaaagtatgtaattaactgggtgcaaagtaaaacaagctacactacaccgggtgctaagtgcaatttactcttaaattattataggagaaaaactctgtagcttgtttttttctccacaagccggatcatttgaaatataatgatcttagttccagaaaaaaaaattataggaggtcaatcttgtcacaatggtgggcagcataagtccaagtcggtgccaaggaggtccttgcatttacttcttacagtgcacttggacttgggagagctttcttggtgacttggtgaaagatccatttgccttgtcactataaaagcagaaaagcaacacacattttcgttagaactttttgcccccagatctcctcctctcttccttgctcagctgttcttgttcctcttgctaggtgaaacactttcttgaattgctgagaccatgttgagatcaagaaaatccagggtaatggtgatgctagttactgctgctcttctactgacggatatggccggcgttagctatggccggaggctcatcccggacctcgatgccatggcggtcgtcggcggctcgccgccggcgaaaggcgggtacatgtcaaggttgcaggttcctccttcagattcaggacatcacgttggcgatgagtacagaagcatgcatgctgtttccaagagattggtgcctcagggaccaaatccactgcacaactgatcagcagcttcagctgagccagcttcttctctgctgccttttcaaggagatatgctacagtttaattgcagtcaattagccacactgagtgaattttcacttcattgagtggtgtaaattagatcttgtagagtagtaagagtaaaaggtacatatgtgtgtatgtaagtattttagtgtgaagagtgaagaatgtaacatttggttctttttacttatagtaaactctgaaaagggtaaagtctttctggtttgtggtgcgcaggacgaaaatgttattgaaaatatatgcaaatgtatttactagaataatataggatacaagtcaaagttttcagtgcagttgtgttctttgtcaattttctgaaaagaatatgttcagacttgagagataagaacaatgtactgataattgatgatttaggcagtacaatccaagttatcagaacttcaaaattgtggatcccaaagtcttcatggcagctcagactttagaacttcaaagcaggactactcgtatatcatccaaatgcatgtcattgtttagtcaggttggtggtaaatgatagattaaagaaatcaaatggaagaaggcttcttttttctgccgctccacgtattttagtaaggaaaatattgcaatgaaaatgacataagcaaggaaaaatatatttttgtcagtaggacaactagcgcatatcatcaaggttcaagtgagagatcacagcacatcaaggtgctgaaaatagctagcaatgtattgtcattcgtgacacatcaaacaagttaggctgttactgtgagtgtggtgctatttgacttggaagcacgtgaagcgattttcaggcagttttctgaaaacaatattcagaattcaagaaaagtctgaaacctttctgcctggtccatatatagcacaatgccaccttccaagtctgaaacttttacaaagattttatttttcttacaatggagagtttaggtgctgtgaatttgaaacatttaccaagatcgcatcctcagtaatgcactctttgtttttcaccttccaaattaaagaaaagttttgtcgataaaaccatgcaggcaaagtacggatctccaagatccgaatgttcagtcaaacattcagattccaaattgcaattcggctgccatccaaactcaccattctacagtctatactctaataactctatacaccaactctaacaaaatcaatcatacgatgagtcacgcagccgatccacatgaagacgcattttgcattagacaaatccaatatgtattcaactgttcattattagataaatccaaagctcagaaccaggacaaccagctcccgaatagaaaaaaactgtggacactagcgcacatgagccatgaaacagaaccttcaacttaaaaatcaatccatgattggccttggagagttggacctcactccatccagttccatcttcttgacctcctttccagcttcttcttactctgctcccaaatcttctcacatacatgaagctgctgctgccgccgtcgatacgacggggcatgctggtcaccttcttcttggcatgcttctttcttgcagagcttgctggtttcagccatggaaggagagttatggaggacaaagaagacgatcactcagaggcgtcttcagaggagcagctctacgagttgccaagaacaagaggacggccttttgtcagtgctcccagcccggcgtatgaagcttccgacaggccagtgcctcaaggctcgaatcctctgcataatcgatgaggtttcttcttgctgaatttcctctgctggccaagcacatgcagatgcgttaattgtagctctagcagtgtatgcagatgagaagaatgctgaacattgaacaacgagtttggcttttcacccttgtttgtgagtgaaaaaagtacatgcaatagcacgagtaagcaaacttggagttgcatatagtatagacctgttaattgatgtgtttttccacaattgcattatcctagttgcatataggacaggaagcaaatagttaaaaagttgcaagcttggagttggtttgcttccttttattttgtaaccttgtacagtaaaccagtctgtagtactcactagttctatttgatgatcaaatcaaccccactgttcttgacaaaactggaccaaaaaaaagggtgaaaaaaaaagatgggggtctgccatggaaggcacatgggccggaagcgggccagggctgcagcggcccgttatccttccaccgttggaagcgggcggtactcgctgctctgtgaaaccagcctcacgcaatacccgccactctaggtgcagggacgctctagctttcgccagggcgccccatacacgctacgcaacttggaacgggcgggccgcatagagcgaaccacaggcccaggccaaagcgcaaacgaccaggcatccgcaccaccttattgcccccgctcgggtgacaagccatcgctacttggctcggcgagaaagcgggtggggagtgagtatttaagctggtgtggagcttactgaattggcgaggtggtactaaactcgagttgtttgtcagcttcctctgactctgagaggtttgttttttggttagctcgtggccttcgtggatttgtgaggatggttgggctttgggcttctgtttcacaataatcaacaggccttgtccttggagcacttcgcacaaaactcggtccttgtgagatgggaactggactctccgttgtgttcttgcagaaagtttttgtggattgagcttgtagtgattttctgccgttgatttttctttaattgtagcatcaaggcagaaaggttttacaattccaagaactgcatttgcagagatcaaaatatattactagcaattttagccatacaatagttgctcaacttcaaaaatgtcatcctgtcagttggcagggatctgtaatttggatggacaagctagcagatcattttcactcaaatttgagaagccaggacatgaaaatttcactttacatgtacaaacggatagattgccttggttctagatctgaaaattaccaggtacatcaaatggaaatccaagggcaaatcgcccaattcaatctctttcgtttacaactaccacaaaaacattggagcaaagaattccgcatatgacactgaaaaggtagctgcattcctcttcctcccaaagatcttcttcccccatcagaaactagtgccagcatttcgatgcatccaggatctgcgtcagcaatgcagcgtttcttgtgcaaagccagcaaagcaaccctgtaaaatgatcacctcaaaccggatcaaattttccttgccacaaacttgaagctggcatgatttacgtatctgaaatctgaaggaatcccacaaatctatagaacaagatgctttatacgaccaaatcaggaatcaggtacagaacagatgaaccaaaaaaaaaactcaagagaattacaatcacaaatccataagctattcgagtcacacactttatgaacacaaacacaccgcacaatgcagggacgatggtttcttgaatgccccccaccgaaagaacgccaattgaaccacacgcatccacagatcacacgaacacgcagaaactaatcaagaagcggatcagagaagggagcagcagatgagatcacatcttggcgaaggaggcggaggaggcggatcggtcgtagtagtactcggggagggcctgggggcgggagagcatgagggggcggtccttggcctcctcggggtcgtagtcgtcgccctcgtcgtcggcggtgtggacgtggatgcaggagcagctctccatggacgcgaagaaggccgacgccacgctggccccgacccagatcgcgtacccctccagcttctcgtacgacaggatgccgccgccgccgccgccgacgccatccatggctagccgccgcgctcgccggaaaacgtgaaaaagtgggagacagtgggggaggaagggttcgtggtggctatttttctctcgtttttgcctttggttttcctggaacagttcgttttggctgttgtcctaaagttggcgaaggaggttgggaagttgggaaagggaaagcgaatgtcggattttgagaccttcgaggcatgtggttttttttttcttcttcaaaagaataggagtggttaatatgatgtctaaataatataaataaataaataaaacttattatgttgcatgtacctccacaagcatgtcggatcaaattctgttgatattttgagaaaacaataaaaatggatcataatctctcgagtggtctccctgttctcatatgtatatacataattattttttaaaaaaaatgacaagctttaatttcaaatttgatatccttaagttaaaaaaacaaattaaactctaaccagtatacatgtccatgtagtcatatttgtttttatgttgtagtttgtagatttcaaatttaaagcatattaatatatcttgttaatttttaatattttttataacattttagatgatatgagaaaaaaaacaaggcaaaagtatttccccgaaaataaagaatctagtaaggggtacatcataaacaaatagcaaagcaaaaatttacaggcatgttactttgtggttgtaaagttagatttcaacattcaaattttggttgcaagcagataaaaatcgtccaaatttagaataagttcaccggccatccctcaactttacaccacgattttttaaggtccttcaaccacaaaaccagaaatctccacccctaaaccatacaaaaccgctcactcaaagtctctaggcaatatatatgggtggtttcgctgacgtggcatcctaatctccatgtgtcaacgacggttgccgccaccaccaactgggcgcctgcgacgctagcgcatgcccgcgcctccccgtcgcccacccgcgccgccatgcttccccactgtgtccgtcggcgcggtgcagcgccgccctcctcctctcctgcctcgcctcgccgaccggcctacagacatatatatagagagaggaggaatggagatagagagaggaggaatggaggaactgaggagtcacctaggtgtagaaaatactttctggaggaggaaccgaggatgagaagaggggagagagaaggatgacgtggcatccttacatgtgagtctcacgctgactcagccgccacgtaagacaaaaccgggtcaaaactaccgaaggacctaatgtgatcggttttgattagttaagggacacctggttgggggacgattttgtaattcaataacaaattgagggaccttcagtgtactttttcccctcggggaatcacgtgggccctgcggccgtgaaggcccaaaccgtccgggagacgagacgcgacgcgagacgacgaaggcagataagtcgataagatcgtaagatcgcggcgaggcgcgcacacacaccagctctctctctctctctctctctctctctctctctctctctctctctctctctcttcgccgcagcgcagccaccctcacttgtcgcggccgcacggacatggcctccacctcttcctgcctcgcctcgccggccacggcggcggcggcgccccggctgcgggtgcgggtgacgccgagggcggggcgggtggtggcgtgctcggccgggggtggcggcgggccggaggcggcggggctgtttgccggtgagcgcaaggcggtgggcgggcttgcgtgcggcgtcctcgcggcctgggccgtcgcgtcctcgtccagccccgtgattgccgccagccaggttggtctccatggcattctattggggggtgtagtgatcttcctctggtggaataaatcccgcacgatcgtgacaacgggtgaacaaatacataggctagagttgcgcttggcaggaattgtgtgcttagaaagagaaatcacttgatttggagctgtttaattccctgtcaaatgcaatgagagttaccaaatcaagattgaccccagtatttcgctcaaattcgatagaagaaccaagtaataagggaaatgcatttagtttagctgacctaactgatcaaatcgagtaaccatccaatgttgctcttgattccttcttcaaatcccatcaaagaaaaatctgcttaaatttctccatgcaaaagataggcgggaccgctggagtgttgttagaatgtaggattttttttttgagtaaatttcacaaaactacagatactatgaccaaattatcacaaaactacagatttaactcgatgtatcacaaaactacacatttaacaccaaatttatcacaaaactacacatttaagatgaagtgtcacaaaactacatatttagtaactaaattatcacaaaactataggtttag

SEQ ID NO: 41637 - DNA, 1647 bp, Oryza sativa
gtctgaaatttctgctgtcaactgttgcaacactgactgattgatatggtattctattatctgtggggggcaccctaattttggcaaatgctttctgtgcaatgtaaagcaagaaattcttatactgattactataccagtgcatgtgaaattgtgagttcagatttgagtgcacatataaatggtttttgtacatatctggagaattcactcaagaagtatgcagcgtattttgtatttctgatcacaaatttcatttaggaaacactgacatttttgctccagttgaactgcaaagtaaatggtatcctataggtatgacccaaatatatgcagtattatgtaagtcagtacaaatttacagtacatttgctcttctaaactcattctagcctcccagagttatttttcttttcttcaatggctttatgtcttcctaaaataacatcataccctgtttgctctggttgttagaggttgcctccactgtccacagagccaaacagatgcgagcgtgcttttgtcgggaacacaattggtcaggcaaatggggtgtatgacaagccactcgatctccggttttgcgattacacaaacgagaaaactaatctgaaaggaaaatctctagctgcagccttgatgtccgattcaaagtttgatggggccgacatgtctgaagttgtgatgtccaaagcttatgctgtgggggcaagcttcaaaggtaaactaactcaccttctgtcattcatcacactattgctgcattatttccaaaatcatgtacctttgaattgataaacagaacactagatgcttatatctcaattgttttcaggaacggatttcacaaatgcagtaatagaccgtgtcaattttgagaaggccgatctccaaggggcaatcttcaggaacaccgtcttgtcaggatcaaccttcgatgacgctaaaatgcaggacgtcgtgtttgaggacacgataatcggctacattgaccttcagaagctatgcaccaacacttccatcagcgcagactcaagattagagctgggctgcagatgatccacccaaattcccacctttctataaccgtttatgtcaatgttaacagtgtttcgatgattaagtcaagcctgtttatagagccgacatgaatccttttcttcgatatgtatctacaaacctctgcacaacttttcttccatatatgtagtatttacaaacctctgtacatcacacatattcggcatgcaatcaaatgcactacaagccacattttgacattcatgtactcacaatctgtgcaaactgcaaacaccagattacacaaaaaggaagaacattatgcctctcccatacatagagattgctcacaatttctggaataacattactggtggttttatgcatgatttattccatgagatcactatagcaacactctacattaccatgtgtgctagcttgcctgccaactcttttgttgcctctctcagctcctgccattgttgccatgcatgcacactgatgatcagttcttcttctatgctactcgactactatatatagccatgggtaggtaggccatggcgatgcctaggtgctagctgcaccgtcgtctacatggccggcccgtcgccgggcacctgc

SEQ ID NO: 41638 - DNA, 4829 bp, Oryza sativa
gcatatggcttgtcattctgtgtcgttgccggagtcgatgaggcaggtctcgacgccgccggtcatccagagaaccaggcgtagctgctgcggtgctggctgctctgcggctcctcgtcgatggcgcgggtgaacatgtcctccgcgccggcgaggtcgccgcgtgcgtgccacatgaacagcgcgtacctcctcatcgcctcgccgtccaccggctccgccgccaccgcctgcttgaagtagtcctccgccctgttcgtcaccggcatcgatcacggcatcatcgttaatggcgaccacgtacggggagcacgcgacgtcgatggcggcgacgagggtgtgcgtacctgtcgaggtccttgtcgaactggtagaggagctgcgcgtagttggagaggatgagcgagttgacgtcggcggcggtggcgatgatcctctcgtacgccgccttccgccggtggacacgggcgatgtcgatgatctcctgcaggccgtcctcgtcgtcgacgaacaccggcgtgtcgtcgtcgctgtgcatgatgccgatccgggaccagagctccgtctccatgtcaagctccaccagctccggcatctcggcgtcggcgtcctcgatctggtcggtgtcgccgccgtcgttgtcgggggcagcgttgctggccgccgccgccaccgacgcggacggctcgacgttcttgcgtttgatccggtccatctccgcctccatgaccgtgccgaggcaggacgcgacgaggccgaggaggccgacggcgaggtcgggcgactcgaggtgcaccttgcggatgacccacgccatggcgtccccggcgccgcgcgcggcctcggcggcgcccccggccgcggcgccctgcacggcctccaccgccgcgaccagcgccgcaaccgcgctcgtcccggccgcccgcggcaccaccccgcgccgcaccgcctccagcttcctcttcgcctggatcgcccgcagcgacggcggcatcgcggccatcgacggcagcggcagaatctgcctcttctgctcctcatccccaccaccaccgccgccacctccgccgcacgccgccgccgccgccaccacaggcctaaagaacccacccctccccctgcccctcccccccccgccatgaacgccggcggcgcgcacctcgtcggcatgccaaccacgatcgccgacggcgtcatcccaagatcgaagcccctcccctctggcgttcgttacgatccgatcgcgagaggctctcccaccaaaggcggtgctgtggcagtgggggaggagggcgcggcaatggcgggggaatatatagccgcgcgcgcggcgcgctcccgcgtgccacgctggtggcgagctaaaggcgcgtgacccgcacgcctcggcgagggggaggtgtcccggttctccatgcgcgcgcctcgcgcccgcgtcgcgcgtcgcgcgcgcgccagttcacgtcgggctaattttcgtcagggagaagcctcgatctccatcggccgcgcggcgctctcggcgcgggaggtggtggttagagagcttttggccaagcgagccgcgcgccgcgcgtgagcgcgagctcgcgtccacccgggcgccgtcgggaccaggctggaagacgatgcgtgcgggaggagtagtggccggagtggagagcggagggtgcacgcgcgcgcgcgcgcgcgaggccattcgagaaggaaaaaaacgggaaaaggttgcggaaaagttaaaaaagaagaagaagaagaaaaacgaaggtgttttgttgtgccataccgccatgcatgacagcgtgatgagttttcggggtaccactggagctaaaatgtcgatgggtgtaaaatttcaaatcgagagaaaaacccaaatcttgatggtaccattgtgagtgattttacggtcgttaagaggtgcccgattaaatttgactaacatataatgttatcgaaaatctctctctcaatataatagaagtgatccgaattaaatgtcacgatagattattttttttctgcatttcgcgactaaattcccgacaatatatatggttggagtacacggtaggtgtgatatgctttacacgaatattgataaaaaagagtgataagagaatcggcggtgcaccgtaggtttccaccattttgacgtggaaattctcatatatatatcgtgcacgattaaataataaataatgttgtcggtatcgaggataagctatgacttggcacctatgccacgaaccaaaattaaccgataatttggagaaaatgtatacaacacaagataggtaaggtaggcacataaaacaagataggtaagataggcgtgtgatccataaatatctttgtcatttggcgtaaaaatatcacagcaaacacatatgatgacgcattaaaatctattttttccaagtgaatgtggacacaataatcaagaaaccatgactaaatacttcctttggtgatgctctaaatcgtcatatatatcacataaatcgatgcaaaaacataaatcaacgttatagtcttagaaatcacaaaccattttttctttatgaaagtatgcagtagttcaacagttactcaattctctgttcagcggtaagctagtcacggtaacacgactcatgttttagagatatttaactatttgtcacttttagatgtgacgtttaaaaatttgttattgaacttagacacgtgaggacgcaagataaattattaaagggactatctacaaatcattcgccataaaacgaacccaaacgcagtcggatttttctctactgctaatccatacctaacgatttagtggacctccaactacgtacacccttttacgattaattagggactagtacgtattttattttttaaaccatatgattaataacacataaaaattacaatgtaattattctataactagtaattaatgtaagtggtatgtaaactgtagtgtgagtggtatgtaattacattgtaactgtagtgtaagtggtatgtaattacgttgtaagtgtggtgtaagtggtatgtaagtgatatgtaagtatggcgtaagtattgtaagtacctagtgaatgaattttaacttaattttggcattgaaatcattaatcctactatgctgagttggttagtcactctgtctaagacctagaagaccatagttcgactccccaccactgcgtctaaattttttcctttgcactggcgcgaatctcgatgaatatcgtacgggcaagacctacaagaccatagttcgactccccaccaccgcgcctgaattttttcctttgcactggcgcgaatctcgatgaatatcgtacggacaacaattcaactgttttttgtttgaaaatctggcgacacatttatagcaaatgtcattagaaacaacggacattctgtactttttttttaaaaaaaagaaacaagtttcaactgggtaattttgtgtcacttgcatgtgggtccatatcactatggatccacatgtcagtgacacagagctaggtaacgtacgtgtacgtcagagaatcttgttccgttcaccgcggggttgggcaacggcccaacgccaaacacagtatcagtcttccgctccactgctccttttgctaggtcgccggagtccgggcatctcgccgccgccgcgtccttgaggctgggcatgtcacgccgcgtccccgctcggagtacgcgaccgaagggcgaggaggccgcgcgggtggcagtggcgccgaggacgcacgccacgtgtttgacgaattgctccgtcgaggcaggggcgcctcgatctacggcttgaaccgcgcgctcaccgccgtcgcgcgcgacagccccgcggccgccgtggcctgctacaaccgcatggcccggtccggcgccaagaaggtagtggctcccgacttgtgcacccataacatcctcatctcctgctgctgccgcgcgggccgattggacgtgttggtttcgcggcgttcggcaatgtcgttaagaagggatttagggtgaacgccatcaccatcaatactctgttaaagggcctatgcgccgagaagaggacgaacgatgcattggacatagtgctccgcagaatggctgagctcggttgcataccaaatgtcttctcctacagcattcttctcaagggactgtgtgatgaggagagaagccaataagctctcgagctactccacacgatggctgatgatggtcgctgcccacctgatgtggtgtcgtataataccatcattgatggtctcttcaaagagggtgatgtggacaaagcttacatcacataccatgaaatgctggaccggagggtttctccagatgctgtgacttacaactctatcattgctgccttaagcaaggctcaagctatggacagggccatggaggtacttacagtgatggttatgcccaattgcttcacatataatagtattatgcatggatattgttcttcaggacagtcggaaaaggctattggtattttcagaaagatgtgcagtgatggtattgaaccagatgttgttacttataactcgttgatggactatctctgcaagaacggaaaatgcacagaagccagaaagatttttgattctatggtcaagaggggtctcaagcctgatattactacctatggtaccctgcttcatgggtatgcttccaaaggagctcttgttgagatgcatgatctcttagctttgatggtacaaaatggcatgcaacttgatcatcatgtcttcaacatattaatatgtgcatacactaaacaagaaaaagtagacgaggtcgtgcttgta

SEQ ID NO: 41639 - DNA, 1238 bp, Oryza sativa
gccgaggagttaatttttgaaatattggatcaaggtatcaatcccaacattgtgttttttaatacaatattggacagtctttgcaaagaagggagggttatagaatctaaaaaactctttgacctgttgggacatattggtgtgaatcctgatgtcattacatacagtacactcatcgatggatattgcttagctggtaagatggatggagcaatgaagttactcactggcatggtctcagttgggttgaaacctgatagtgttacatatagcactttgattaatggttactgtaaaattaatagaatggaggacgcattagctcttttcaaggagatggaaagcaatggtgttaatcctgatattattacatataacataattctgcatggtttatttcgcaccagaagaactgctgctgcaaaagaactatatgccaggattaccgaaagtggaacgcagcttgaacttagcacatacaacataatcctcatggactttgcaaaaacaaactcactgatgatgcacttcggatgtttcagaacctatgtttgatggatttgaagcttgaggctaggactttcaacattatgattgatgcattgcttaaagttggcagaaatgatgaagccaatgatttgtttgctgctctcccggctaacggtttagtgccagataattgcacctaccggttaatgctagaaaatcttatagaacaggggttgcttgaggaattggatgatctacttctttgaatggaggagaatggctgtactgctgactcccttacactaaactgcatagttagaaagttacttcacaaacgggaggtaagcaaggctgaggtttacctttctaaaattgataaacataacttccacctagaagcttccacggttgagtcgctggttttgctggtttccaacagggagtgtgatcaatatatgaagtttctcccagaaaagtatcgccccgttctgaaatccagggctggttgatactgcctgcagttacactgctgtaactagacattgttgatattcttatagaccttattatataaagatgacattctggattgcagcataatgggagatctctctttttgtctgttatgtgtggactgctagttatgaagagcaaacccctgttccaggtcatctcgaacaaacgactactggttatagcacagttttatcattcctggcatgcgtacctgataatggttataatcactg

SEQ ID NO: 41640 - DNA, 25065 bp, Oryza sativa
agcggcactagggaatgtgataacgctgttggtctgcaaggtacatgctaatgcagattgagatctgcattattccatcaaaggggtgtcgaatctttaagaggcaagagcaaactggaattgagaaatgaacaacagtgatactaacagtagtaggatgcatccatctgatagctgatagccaagaggaaggataggtcccattaagcttgttgactcaagagggtggaacattggtttgccaagctagtctgggtagcagccagcaagaaagccttggtcagcaccatcagagttgtcacggccaatctctcatgaagaatgcccttgaatacatccatccatagaagattgcaaatcggaaatgttacccgatgtcaaattacttgtttggcaccacagatgtgtgagcagaaaatattttcaggtgtgttaacattgaacgattatttaataatgatctgctattgcttcaataaaaaatgatctgctattgcatatttcctgtcagataggattattgtactattgtattctaatgaatatggaaggaaatatccagcctgtgacctgccaatgattattcgagtaatcacattcactatacagattggcagaatacaactcatatttcattaaaccatccaaatagtcaattgataatcaatccattggtaatggctcaactgtcatattaccaatccaatgccaccatcaacgcgactgtagtagtatgttcaaattttagcaatggacccttttactctaaagaacactatgtaaactcgcagaggtaccgtatttttaatcatcaacacaagagaatttcaaacagcatactgcttaagcgtaaaaaaaaaggacatgggacaggtggtattgtctacgtactgcttaatagggcttgcacttatttatgattgtcatgaaattcaccaatctgtatgagtttggagttatgtatacttttcacaggatgaatttcatgtgcagaagaagcttttttgctgttgaatactgtacacttgcagtcttggatttgaagttctgtatcaactatcaagaaaattgtttgtaaagcttctatattatgaaatcctcatgtgttcctaatctaggcagaaggcaccaattacctagtattatttgcttgtcgtgtatgcttcctgctattatgtccatattatttgtctattaagagaaattttaggtgggggattccttagcaatgatgtatgagttatttttttatgtgtatgccaggtaccctgcatatgaaaaattagcttctcttgaacaatgcaagaggtaattgactttattagcttctccaggaacttagacttttcccatcggtaatatagctcatgttgtgtttgctaagagtgtttgtggggtagttgggctgggctatggtagaaagctctgagaaatgtttgtaagtagtaactagtaaagacttgggggtccaggcaagctagaactaacatgcgacattgcaggaaatccaacgctgtaatttggtctcgatgaaaaagttgaaatggtgcactactcaaagaatgtccatcccttttctttggaagaacattatttcagatttcagaaaaaccaacttttcagaaggttgtaatgcaattgtttatcttttcttatatgaaaaggattgaattgctttgtgtatactgattattgcatcctggataattagaactgtagagttaagaacttgaataacacagcaacactgggacaacttaaagccgctacagtcagggactcagggataaattggtatctggattcttgaggctggtgcaaactcaaggaagaggtatgtcagctattttgaatctcactgtccttgatcgtttaaattattttattcatccattttgtgggcagtttcttaggcgaaagagatcatgaactgctataactgttataactgttgttactacagtaatatgccgtgctttgcaacgagccagaaccatataattggggatcagctgggtgggtggattgagaataaattactggatcgattgctacgcacacatgaagcagaccttctacggtgggaagggaacaaatggaggatatgactccgtttttaaagttgtagagaaaaaccttctgctactacagggtcttctccatcgaagtggttctctcatctgttggtgacttggtgtaatggtgtactatgtgtagatggtcatctttttgccgggccggccaagaaaggccaaccaaatttacttaggattgaagaatatatacaaatatacaaagttataacttcaacgagaagctgtcgaagtaatggaaattgtcaccggagcaacttcccaaaagcaaaagattacactaacaacttcccaaagtgtagatggtcatcttactttagtcagatgcatgaacctgaattgtagtgtcgcctgtcaacccagtgcgacagggggctgccaatcaattttgaacatgcgaacttgtaataaagttgttcagaagtgttttaacagcaactgcaagttttgattcgaaatgagtcattttcatagcatttttgttcattatctagtgcttggtgtctactgtggagtcctctgcttatcaccctgaaagaggaagatgaattcaaggacaaatctgttcttccatcgtgtgccatttctccacgccttctaatactaaaaaacatgtcgatcagtggagtcggcctgtgtgcgcattcatgaccatgtttttcacctccctggaactggaaggatggtaattcccaaggcctggtaattgtccctcatttgataataacattgtcacatactctgtcagaaaaaaaaaactaatcctagggatgtatctgaacaacgtgtatgtccaaatacattctcaggattgaattttttttatgagatggaaggagtagtcactgactgtgcttgccgccagactataaacaacaccacagaagttggagacaggcaatcaagcaatgcagccacgcagtcacctagtcgtcaccatcaggggcagatcaccgtgagtatcagaggctcaagctcttattacctaataggagcttcattggttgacttaataaaagcacatattaaaatttgaattttcaactgaattttagagttgattttaagatattttcagcataatttctttttagcgtcgacttttaagtcgatacgaataaacatataaaaattttatctataaatcaatttttatttcctaataaatcgttttgtcgtattaggaaatataggcaatcgatgatgccctaaatccttgtggagagacgaagaaagggaatttggaagaataaggccctaaaaaacttttgcgtgtcacatcgaacgtttgaccagatatcgtaagtggtttttagacacggatgaaaaaactaatttcataactcacctgaaaaccgcgagataaatttattaagcctaattaatccgtcattagcacatatgggttactgtatcacttatggctaatcatggacaaattagactcaaaagattcatctcacgatttccatgcaaactgtacaaatagtttttctttttatctatgtttaatgttccatgtatgtgtctaaaaatttaatgtgacgtttttaggaaaaaaatatgggaactaaacaaggcctaatatgagatatacacggtttatttttgcccctagtcagtgtttatttttgcttttttttttccctgagatatacacggtggaatgacgtggatgatcactcatgtcatggcctcatggggtccaggcctgaaccccacaactcgctgaactcgctatacggcaaggcgacgctgcccacctaacgtgccagataccacgaaccgtctcgcccaacctcccccacggggatacgtatgatatgtgtgcgccccctcctcctgccggctgacgcgacggaacgtgagtccgtcacgcgtggcgaactagtagagcgttgatgtcatttttaaactatactacctctctcatacacttttagctaatttatgacaaaataacaggattgaaaaataaccacagcgatcttatttaatgaacacaataaattcacacatttcatatataaaattaattaaaaggaagtttgagataattaaggaaacatttttagattaaaaggaagattatgggatggaaggcttggagatcataaggaaagatatttagattaatcaatttgttaggtcacacgtgattagaattataatttttgtgggataaaacctgagagccaaaattgtaatttatatgggacggaggtagtatcatcgtttattaagattgataaatatatgataatatttagtttgttatcaattattggttatgtttaaagaattttaacaatatcacatttagcctagagtaaattacagttgggccaccttttattgccaaagtttcactttggaccatccctaaactaatattttcactttggatcgggtaactttgccatatttccagtttgaaccacccaactctctttactattcatgtttaccctccattctggtgaagatatggcctgcatatagacggtgaagttcaccgatgtatcgaaaccgatttgattgagattgttgatgggcgctgaagaaattgtttaggatgatctaaaccaaaaaaatggtgaaattacccggtccaaaatgaaaagattggtttaagggtggtacagagtgaaacttggataataaaatatatggcccatattgcaattcactccaccttttcattaccaaagtttcactttggtccaccctttacctaatatttttactttggactagatatttttgccttctttgcattttggaccacccaaactttcttcgcgagcatattaacagcctcaagctcatcggcaccttcatgccgatgatctcccctgtttaggtgtaggtcacatcttctgccggaggagaggttggacatggctagacaaaagaattatggtgatccaaagtacaacaaaggaaaaaatacctagtctaaaatgaaaagattggttaaagggtggtctgaagtgaaacttcggtaataaaaggtggtccaaagtgcaactcactctttagcctattatattaaacttggtaatgttaccaatttgctaaatttttaacaatatcaattttttaaaaaattaaaaatgactacaaaagtgacaaaacttaagggtgtgttcgctgttccaggttggggaattggaatagtacgcacggaaaatagagcggttcattatcgcgtgattaattaagtacttcctccatttcataatgtaaatcgttttatcatttcctacattcatattgatgttaattaatctagacatatatatctatctagattcattaacatcattatgaatgtggaaaatactagaatgacttaccttatgaaacggagaaagtattagctaatttttttaaaaaaaggattaatttgatttttttaaataattttcatatatatatatatatttttaaaaaaaacacagtttagccgtttgtaaaaaaacatgcgtgagagaggttgggaaaatttggtgccgaacacaccctcagtttttctagccgcgcgcggggcggcaacgacgaacgaacggctcgcgcgcggtgggtgggtgaggcggtggcccgcgagacacggcgccggcagctgccgcgtgcccgcgtataggcgcggcccccttccgtgcgagagggcgcgcggcgtgatcgcgtcaaacctctcgtgtgccgcgcctttgccgccgccgtcgcgatcgaagccaagccgagcgcgaggggagccgcacggcagcaagggcacaccgcacacggctccaccatgctcgcccagccaccactgtcacgcacgcgcggcgttttgttctacgtacgtgttccatacgcgcgcagagacagagacggagggaaactacggccctgttttgattccaatttttccgtcacatcaaatttttctacacacataaatttttaaatttttcgtcacatcgttctaaattcttcagactttcaattttagtatagaattaaacacaacctacattgatcttagttctccgtaaagttccataaagtttgtagtcctgttacaaactttacgagtacgcaggaactacattgatgtgtgatatgcgtgttaacgtgagcaccacaaatttagaagtttttggttgacattcacactctaccgcagctaatcacttgttgtggcgacattatttctacttgtgaacaatgctaaaaagttttacattataaaacggggaaagtacgagtaggaagaggactgcaggaactacattgatgtgtgacatccgtgttaacgtgagcaccacaaatttaggagtttttggttgacattcacactctatcgcagctaatcacttgttgtgacgatattttttctacttatggagaatgctagaaagtctaataaattaggtctaacctgttattgtctcggaaagatgttactaccaaatgaactagatatttggccgaaaaccaaacagaaaacaatcacttaaaacaccgatgaacagtaaaacaaaccaacgaggaaattttggcacgtcgctttctgcaagggcgagacaatccatcgaccagtcctgcgtggcgacgtgctgtactgcgctgttcggcggccaacatgcgtagggaggacagcacgccacaagtccacaaccaaaacactactactcttacctctatcaactttttcttatatttatcggccaaaatttaaatttttaatcttaaatttagagctgatttagattttttttcatgaaagtttatttttcagcctttatttttaaatcgctaaaaacatgtatataaaaattttattcataaattatttttggtttgtaaatataccgttttggtttatttcatgaataaataagcaaaacaatggagccgactactactctatcaacgctagctgagcaaatggacggacggtcacgaggaaaagtatctctatcaatctcagccccaccaaccttgtgaggaggtgacatgggccaaacggtcagcaactaaaggacaggtgaaaaagccagctttaacgctgacgcctgtggctggctggctgctgctgctgccctcaacctcaagtggcgtagccgttcaagatgcttttctttttcctagtggagtagtatatcttttctttttttagggaaaatccaagagagccggtataatagtaagctataagctaattataaatatatttttaagagataaaggaagagagagtagcagcaggttacatatctataaccagctgcagcacggacttcaagacgtaatgtgtgtataacaaataagaccaagttagtaagcaattattatatgaatttgctattacattggttatagatgatttagagctagcagtggattatactattatacttgctctacgaagaagaaaaaaaaagaaaagatcaagtggatttttcagaaacctcgaaaggaaaatgtgaatgaatgccagtccagttggatcgtaatggggtaaagaaatttcataggcaggggccaaggaagggtaatgatgccgtaaagagcacgctcacatcgttccaatgaaaaatctcttcgacgatttcgttgttgacccatgctccgctcgagagatatttaaccatttaccatatttagatgtggcaattaactttttgtcactgaactcacatgtcatagacatatgtggacccacatatcattgagatagggatggtaaatagttatttatcaaatctaaaagtggcaaatagttaaaagcccctttgctggagcaatatgtttttcgctgtcaaatttgtacaacctaaaatgaagtctactagtggtggctttcagtcatctgcaatcactctcacacacacacacatcaggatttttttttctcacctccaggttttcaagctaaaatctgccttgtcatctcttcaacaaactatgctttgcatcgcatcatccgcacatcagaacgatacaatggagaagctagcttaacccccataaactgggcatgaaaaaaattctgacaatagaacagaacagcacaaagatcattggcaatggcagtaagaatggcaatggctctcctgcgtcgaagacgacgacgacgacgacggtctgcaggggctcgtcggagtccgaaccaccggcaggccacaggctcgccggagctcgtcataccggcggagatcgaaatcccgggcgtgcatcaaccgcttctgcttcgccgcaaaccggctctcgaagaagccctcgaaggagggctccttcttggtccggaggaagaaggtgtagccggccatgaagtacatggaggtcacatagaagcagatgggttccatgacatcccatgagagctcccagaatgtgagcctcatgaagccggcagtctggacgacgaggtatgccagccccagccaaagctcacggcgcacctggagcgccgcggtgcggtcgatctcgaccttctgcgcctccatggccttcagctcttcccttgctgggccatccaaggcaatgggttgcgctctcggaatcggtatggccttctcgatggctttgacaacctgcaatggtgaatagaaagaacaaaaaaacatttcgaaaatttacttggttgctcttcttctcaacagagaaccatcaaagaaagagcgatgttcgcaagagaagattacagccatgaaatgcgaatcagttttcaaatgattaaatttccaaaaggaagtgcaagatataattgtgtttccaacacattgcaaatgtgttttcaaaagtaaaagaattatttgatactgaaagaaaaaccaatattgtgtatattgttaggacaataatgttaaattgcttaaagaaaagaatccccacgccgagccaagaggatcagtctgtgcaggataagattgtttagttggacaaggaacatatgccgcaaaagcctcaacctctatttttatacttatatgaacagcaaaaaagactgtaaaataagaacagtttacttccaagactaaaacatgcaaaaaagattttcccaaaaacatctatgccatgcccaccaccaccacttgcatggggtaaattgccaaattgtctgactaaccgcacttgcatggaacaaaacaaacagtaaatagtacaaattatgctgcctacgaatgctgtgacctactctagatcagatggcatgtgacagtgtccccctttactttggctaggtcaggacataagaaagtagatgtgtcataacctgttagccgtccattaatcttctagtattattctaatgtgataaagatgtagcttatgtattcaacagatattaaaaaaaaagggcttctttactcatgatagtgttgattacttgatttccaactagtaaagtgaacggtagcagcaatagaagcaagcatgtaagaatgtcaaaaagtaagaacagaagtaagaatttgattctgaaaagtctgcaacactgctaattatctatgctcctaggtccttgaattcactcttaagaatttccaattaattcacattttatggttgtctattctctaacttcaggtgattctcatttgctgaaccaaaactagaaattcttccaaagcaacttttaccaaatagtaagccaataacaaggacaccactatgagctatcctgcgttataaaccagaaggagctgatctaaaaataacatacaattctagcaaatgcacagaaaaggttatggagcaaaaagggaaccacctagtagcacaaaattgtttgatatgtaactaactttcagttttggccctcaaatttgttgggaggtatcacaaagttaaaaggtactacatcaatactccaccaccactggcatgtgatggggaatgcaatggcatcttagatactgaatcctctgccatgcaattcaaacatcatttttatactatcagttgtgcagcccatgccctgtaagagagaccaaatatgtctccaattgttgtcctcatgacatggcatttaaattgcatggtagaaaatccaatagaatactaactatgaacatttccataaatgatataatatcagggaacataaaagttttgagtatgtgctggatgatgactattaatatgcatccttcctccaaaaattttggctgccacaggttaattctcctcatgttcattcatcggagatcaagattaaaattatcactaatgtcaattaagttctctccttttctttcttgctccctcaggtataagatttgaggggctaaagaatagtttttttttttagttttgtttttagtcgatctggttttgtgagaagaaaagacactcccatgtcggacggagtaaaaatccccaaactttgtgtgtcaacaactgctcttactaccgtttaagaacagcgccctttctttcattcttttcctgttgggaaacatacaaagaaacacgcggaaaatctcatcagatctcgacacttctgaattctcaacccggtcacccggaaacaaaaaaaaaagaaaaaaaataactgcaaggagagagaaaagatacgagaaaccagcgtgtatttctctcatgacatgctaactgcaaaatcaaaaaaaaaaaaactagaacaaaattgggagaagagacggatcaagcaagcggcattaaattaaggtggtggatttgaagctgatgagatgggggggtggatcgtaccatctcgggcctgaggaagacggtcttgccgaggacgatgacggatccggactcgtcgagcgcgcgcgcgacggaggcgccggactccgcgccggcggcgtcgcagcagagccggaggaactcggcgtacggcacggtgcccgcgcccgacgcccgcagcctcgcccgcgccgcctccatctgcgtcgcccgcagcaccttcctcgcctcctccaccgtcagccccgccaccgccgacgccgacgcccgctcctccctcgccaccgtcggatgcgtctgcggcggcgccggggggacgaggccgtcgaggttgatgcgcgggaacgcggcgccgaggtcgcggatccggtcggcgagggggatgaacccgcgtcgctcgggcggcaccaccggcaccgccgcgggccggaacgccgtctgctcctgcatgaagcggcggagcccgcacgccgccggcggcgcccgcgccgccctcctcatcagcgccgccgccattgcaacctctctcttcctctctcctcacggagctcggaaatcgagggaagcaatggcaacaaaaaatggggggaagaagaaatcgaaacgcacccggttcacgcagctcgtttggtgatttgtgggggaagacgaagtgaggggggtggaggctatttatactccccgcgattcggacgcggcccggtcggtcggagtcggagtctggcccggtcgcatccggtcggaaggtttgggtttttggatgagtacgaaagtttgttcgaaattttgccaaatttcggcagggcccttcgtaccgtcggtgacgacggacatgttcacattactgccacttttaacattaccaatttttgagtaacaaactaaacataattaaatattggtgattctgggtttttcctcttcccaaaagctttttcaaatttgcgtaaggctttaaaccaaagggtccaacatgactaaatctggtaacactaaaatgttgctaaattttagtaaggttttcagcaaggaagtgaacaagcccaacatctcgctcaattcgtcgaagttcgtacggtgatattttgacacaggaaacatggggaagtcatgtgttatactccattgtagccagcaatttttgaaagcctttaattgagtattactaggggattataacacctatttttcttgtattgattacttgctttgaatgaaatttggtagtcgtagtacattccagataggccggagcggaacgtgtttcttgcttgttctgccagttatacatgacttgtattattgcggtacgttttggcatcgtgtttttgttggtctagtactcctatatgattactgatttttttttggtatgtttccacttggaaataagaaatttcctcatggatatgtgcttggtttttttttctaaaaaaaatgtcactattgagccgaggtgaggtaatcgtcatttgtacgagcatccccacattcacacgtgtcagaatttgtgtttatccttttttctagatgaaaatggtttgtgtttatcattacatccttgtttattgacggtaaggtcgatttgaacataggagtttcacactattcatgtttaaatgaattttagttttatttcaaatgctataatttttcaaaatgtatgattgaactagttatccgtgatagttttctccaaattgttcactaaattatttcgttccaaataaggcatttgtaagaaaaacagttcggttttcggaaaatgttgaaattaatccgtcctcgttttaaacgggttctaataagtgggtaggtacgtagcaaaaggccgtgagcttaaaaaaaagtgaaaagcatatacatattaatacatatcctacatagtccaaaagaagctttggattaaaaatatatgcacttagataagtatggattggatcaccagctcccgatgacgatgaagtgtagggaatatttcgtaaaattatgttgcttcttgcagggcgcatgaagagcctcagccccacatgacacaactacacgatgaagaagaaaagtccaacaaaaaaaaagatttgagcatgagcacaccttacgcatatacaaatccaaaaacatccggacgcgcgattgcatgaatcaaaacttcacatcaaaaacattatattgatttatatatagagagatactagaaaaaaaaagtctcgcgcgttgtaataggtaaatgttattttaatcttattttttatacggtttagctaaagtaaaattcactgtataaatttgtttagatattgtttttataagttagtatgagagtttttctaaagagatttctcatacgactcaatctatatttcaaaaaacgaacaaacttaatattcgactcaaatacaaatatgtaatttcaaaaaacgaataaaattaaaaaccgattaaagatggataacataccagagataacataccagagtgcctgtaacaataattttaatttttataacagtagggatatatcactttatgccacgagttaatgtgaacttgtcaataggcatgtgtcctagttgctgcggcacagtgctggctgctttttagcctcatttagccttatcgaacagtattatattgttctaaaaaaagaacagttttattttttgtaaaacatatttttcttaataaaatggatatattcattctagaaacctgacactaacactctgatcttgcaaataaaagagaaaatattataccactcgatgatttcatttgatatgtctagatcataattaattgccaagattgatcgtggttatatacaaaatacacaattataatcataagatagaaatataaatcgcgtattaaatcaaatacagttcgatctgctccacacaattacacaggaaatctagtttgtcactgctccgagctttattgttatcaactgtcacgcagttgcgtgaatcgattcttttgttccgatcagcatatgtgatcgaggcatcaatcctggtcatatcattttatcgagcaagtacgtaagattaacagggagatcgacacaattcattatcacccgtgcaatgctttagaagaatatgtaaacctctattacagccgaagtgtctggcacgcaaaagctggacatctttggtgtgtgcgtagtactaacaagacatgcatgcaccaactcccatctatctatataattcttccaaaaaggctcaaaaggatattggtgtgaggcacagcttgtgccggtgttatctccagctttgaatcgtgttccacataccagcagtaaggaatataatatatatatcaagattaaaacaagtcaaaatattttataaatgagttttaatagtagagtttccaaacatacctctatctataaggaccacttgaatgcgttttctagtgcatgccgatttaccatcaaacacaccgtatgtacttagtatgcctttgctatctcccaaattaacaaacacccatattaaatctagtatttcttttttttcctaaaatataacacatactaagatacaccgtatatgtgattatgtgtactactatctatatactatattattatatattgtagaatggatgtagtattcatacatgttgacaagttcacttgaggagtcttgccattttaactacgcttaggccttgtttagtttacgaaaagaaaatttttgggtgttacattggacgtttgaccggatgtcagaaggggttttcggacacgaattaaaaaactaatttcataactcgcgtggaaaccgcgagacaaatttattaagcctaattaatccattattagcacgtggatgttactatagcacttatagctaattatagataaattaggctcaaaagattcgtcttgcgatttctattcaaatcgtgcaattagttttttattttatctatatttaatgttctatgtatgtatttaaagattcgatgggatgtttttaaaaaaataaatttgaaaactaaataatgccttaattctgaagggatgactgttagtatcaaatttcccccaaaacaagaaaagtgactactacatcgttccagaaagttcttttgggtcgagttgtctaaaaacagagcacgtccaggtccatcacggatccatcaaactagcttgtggagtactatgggctcgttcactttgctatcatttttaatcttaccaagttttggtattaccaaattttagtaaagttgctaaaattttgacaagattgtcaaattttggtaagatttcatatctacttactaaaatttagcaataaactaaacgtagccaaaattttagcaactttatcagaaaatagtatgtttgaaaataacatcaaagcgaacagggcctaagattatcctctcttttcttttttgacacaatccaaagctcaagctcatccacgagatcgttcaccgttcacccaaggtgacaccccgctgtacgcgcggccgcgtacgtgtccgcctcgcccgccgcacagctcaacaccgtctcgcagccatacgagctcgctcgctcgctcgctcgtcgtcaaccgcgtgaccggccccgacttgtcaactcgtcgacaccgcgacgcacgcactctcccaccctccctccctcccgctgaccccgcaccgagtcgcggctgcaccgggcagcgactccccccgtacgcccaccgcttcgcgcagcgcaggtgtcgcgcagcgcggcatccgcgcccacgcccacgccccacgcgcaacacgtactacgtacgtctccccgcgcgcgcggggatggaggagagcgagcgcgagacgctcgtgaccgaccgacctggcgccgtagcgcgcgcgggcgcctcctacccgcgaaaaaaagtcagacgcatgggtggagactggagaggatggggagatgggcgggggcggacgcggcaggccgtcggcgcgcggtaagacgtcgcggtcgccacatttgactggcccgcggccgcggcacaacgcgaggagagaggccagggccacacacgactgcccgaggaaaaggttttcgtgctgcgagtgtgacctcccctggttggcgatcgatgcgtacgtgccgcgcgctgttgcggctgcaccgtacgcgtcaaacagcaaagcgaaccgcttgatctgcacgcacgcacgcacgcacggcctcccccgctcgccgaagccgaacagctcgggttttcaaccgaaagcgtggacgtttcatgagaacgtttcaaccgcggcgtgaacggctggttgctgtggcctgcagtgtcaccttgtgcctgcctggtgctgcgtgcctgcgtttcagccacgggttgatttgatggctcggccgcgacggccggcaggagcaccggctgaaagcctgggactcgcagggagctggatttcatttaacttttggcttttttttaataaaacttacttgtttagattaaaaaattttggcaaaacatcacatcaaatatttggacacatgttatgggagtattaaatgtgaaaaaaaaaccaattacacagttcgcatctaaattgcgagacgaatcttttgagcgtaattacaccataatttgataatgtgatgctacaataaacatttgctaatgacgaattaattaggcttaataaattcgtatcgtagtttacaggctgaatttataatttgttttgttattagtctaagtttaatacttcaaatgtgcatcgtatacttcaaaaactttacacccaaagaactaaacacaaccttattttacaaatagattcctcaaaatacttattttataaatgaacccttttcacagcgctaatgtcattggcgccatgtgacgttagcgccatcccatcatcccccgttaaaagctactccctccgttccaaaatataaaggattttggacagatggaacatttcctagtataacgtatctagacaaagaggaagtgtcacatctatcaaaatcccttatattttagaacggagggagtaagtaaagggggacggtaccaatatcattggcatcgaggatctattcataaaaagaataaataaaaaaagaccaatttgtagtaggaaaagatctatttgtaacaaaaacatttacaaataaatcctcgacgtcggtatcactaatatcaaggaccaattgtaaatattttttattacaaataagtttttttacaaacaagtcattttttacaaaaattacaaataagtccagatatcaatgatattggcgccaccccctttcacattagtaacttagctttcaccggaggtcgaggggaacgacaccaacgtcattagcatgtcaagttagaccacggcaccattgatgttgacactgaaaaagaactatttctaaaataagtttttttttctattagtagaataagttttccaaaatattgaaagatgaaaaaaaaaatcagcgcagagaccttcacgcttttatcgtctcgtgaatctggaaagttcagctttctccgatggatttggaatatgttttgttttttcagaatttctgaatgcccggctttctgtatcaacacaagcttggaatgtgaataactgaatctggatgctagctggctagagcgccgaaaacgtctaggtgtcaactgaatgttagttttcattttacatacagaattacacaggcaggatagatacacattctaaaaaaacacacttctcttcactttttgcccgagaaaacggcttggtttgtgccacagcacaataacttccaactgtatttttacggttaccctgttcctgcaatttttttctacaattgcacggtagatgcatacatccacacaccactacatataacagtaacatatttacacctcacgtatacatcttgtgatcaacggcacctcataatcttactaaaatcatattgaaggccttttacatgtgcatttcaattccgctgataaaaactacactactctctagccagctaaaaatgtacccaaaatatgtttcttcatatagattcagcattcatgaatcccaaaccgatcgaagtgaaacaccgtacgtgttttcgaggaagagcactcccgacatgtcggttcggctttgccggctggtagatgcaaacaaaaataccatacgaaatcatggggaggacaggctaaaacaataaaaaaaagaaaaaaaatggagattttggattgtgtggttgtatagctgatgtatattagtatatgctggcttgatttgatgggaagattccttgtaagatctgtgtaaccttgttgccattttatttcctcagtggaaaaaggaatattccttgtctcatggatatgccctgtggtaaaagcttcatgagagagtgtgtttagcggtggacatcttagtaatgtcaaagccaaattattcttattacgactgtaccatctccatatataattggttgattggttgagttcaataaaacttcttttataaaaaaaatgttttgggatataacacacatatatgtagacacataacatcttgtatatgtgcctaattataatgttttgagagcaggtagaactttttttactaccactccatttcatattaaatttaagttttcaagttgtatataaagattaagaaaatgtgactttagagaaagtgattttttttagagtatttccatttccacacttacagtccgccacgatttacacgcgacgcgttgactatgtaaaaacactgcacggaagaatttgtactacgtactttggtttggcagcatcgtatgaatgtgaagttgggcttgagcttatcgtggcacggaaacatacggtgggtacttagtgtacaattaattaaatattagtatgtttgttttctcaaataaacttctagacagtagttttgcacgagatatattgtttagcaattctgaaaaacatagtaacagaaaatgacggagaagcccaactgaaaagaacgatacacctgataagctggctatggttgcacaactgtagcggccacgcgccgaaccgtgaacttttgctattgggtacctacatccttaggctctgttcttttggttgagttgggaactcatccctccggtacggaaaacgaagcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccagcaaacgaacagagccttagagcacatacagtgagaagaagtggcgagcaccctcaatgcgccacgtccttgccgctgctccacattgattggtcatgtgctctcgcaatgtttgtaccgtaccgccttgcaatgggcacgatagcctggttagggcaaggccacttgttgcggagccacacctcacgagacatgttgagagcatgaatatcctcaacgcgcatccccgttcacgcgcatttagaaagggatgggctcgacattgagatcctgagcatggaggcggtggtggttggagaagaggggaagttctagtagttatgttgccactgcgaaactcatctacatggaaggtcttttaagtgccagttgtacttgcacagaagttttgtgtcctcaactatactaggatgcctctagtagtaacatcataacaagcctcaccatggataactcaataatcttctcgcatcatggacctcgtcaactagagcccccaccagctctgtgcgaggacctacagtctagtgacaaactgacaactcgatttaccaaacgatgtcgcctcaacctactcgtcgccatctcaatatgcgctcgccaacgagggaggacggtagagaggtctactgctaccatgctcattcttcatgcgtagaccaccctgtcaagctcctcgctccatcctgcaacgaggagggtacgatagcagagaggatgacatgatggaaagggaggagaggacacaacagcgtgggaggatgctagagagggcggtggccggataaatcactagagaaggtgggcaggggcaacggcggaatgggatcaagcaatcaattaatggagtagattttatactcatttcaaaattttagggtgtctaatgcaaaattttggacttagatgtgagttttcttaaatatgaggactaaaataaaaaacgataagggttgattagaaaaattaaagccacaccttattgtgggagaggaggtaagcctcaacctatatatcacattatattacctctcctctcggaccggtcgtcagggtggcctccgtccactgttaatgcccttacaaaacgcaacgttgttgcttactgcttagagcaagttcaatagtatagccaactactagctccaattcttctatagtcaatctaatagatcattcatacaatagttacatattacactattaatatctggtcccacctgtcatacacaccccgcgtcttggagtccgtgctacagctgtttataaatctgtagcccgctgctcttctctctcctcatttaacttcttaaaatatatttgtagctgacttatagcctgcttttgtacttgctcttatgaagaggtctgcaggccgggaatcctctgagcagttagcttgggtgcattgcatatgcaacgagttagctaaccacagcctgttggtctcctgacaaaggcacttcctccccatcacttccgtgccgtttccttcaccaagacaccaacaataatgctccatccgagactaggcacaagtctttattaaaatatcggaggttacgatcgagctgacaccgccaagataggtgtgatgagagagatccagagtcatcagacagtgaatcgagcaagcaacgcgaggacacgtacttacgcactccaaatattaaggcgatcaggcgatcagcaactgcactttgcaaattcggccgatgatagcgtatgcgtgatcaattaacgtgtaattcttttacgtgttcgcaaaaaaaactagattgcatatgcatgacacctacacacgtacacggtacacacgatggatggatggatggattgggcggctcaccgaactggcctcctctcgcacgcacgcacgaaggcaggcagccagctagcatcgaggacgtacgtccgagccggcgaacggatctctcccgtgcagcaaaggcgtacgtatctcgtcgcggccggcaagacgtcccgggctctctctctctctctctctcgtctccaggggatcgatcgtcggtggagcacgcacgcacgcactcatgcacaagagtgtgatcacacaatcctcggctcacacatgctaattaacagctggtgcacgcatgcgctagacgaagcggcgtacactaacacacaaggccatgtgtcatgagttggaaactcatctcccatacatgaaaacagaatattaactagttattttttaaaataaattaatataattttttaaatcaactattctatcaattttttttaaaataatattgtttaacagtttaaaaaacgtgcgcgtgaaaaacgtgtagaatgaagttgggaacactgagtaaagaatacatcgtgagagcccgaggtgctatcaagcctaagcgatcaacaaagtttccgagtatatcagtgatcccacgtcgtagtttttgtaaaaatacgttttagagttatcagtaaacatcatttgatagtggagatgctagctgcggagcctaagcaagacaagtttaactgctagttccgttgttagggtgccgcgttctaaataggggttaggccgacctaatctctcgtttactgtgagcacgcttctaaacggtcaaacaatatattttgtaaaagaactttttatataaaatcaaataaacctattttgaagtttataataattaattattaattaattaatcatatactaataatacgatcccttttacggtaccactaactagcttaaaccaacagctatacaaacacaactaagggcctcttcagattatagccaaaataaatcttaccaagttttgtcaatgccaaaaatttggcaagatggcaatattaccaaaattttaatatgatttcttttgtattgattaaatttgacaacaaactaaacgtagacatttttttggctactttaaaaaaaatagtatggttgaaaatgtcatcaaagtgaactggccctaagttagtgagagagtatattgaaggaaacctggttgacatatgagatgatttgtattacagtgttgctagaaaactttcaaaaaaaaattttgcccccaaaacttttagatttgcagcaatcggatcgcctcgagatttatacatgaaagggaaaaaattgctagaaagatttttttcatacatgtcacacgtaagatctcggtgctagccaatcaaactaagctgaatacaaattttatatactccctccgtcctaaaaaaaattcaacctaggagcggatgttaaccctcctaaaacaacgagttatccatattcgttgacggaacgagtaagttatatcgtacttacagtgtatataatataattatactttagttatagttatatttgaaaagttttctaaaaacaactgtaacagttttctagatacctcccatcacggaaagattggcttattgctcttctaaccggtgtggcagccacgtagataattcaatttcctcgatgggattacaccgtttcgccacttccggcaagtgtgggggagggtacaaattaacgtgccgttgccgtgtcatatggacccacctgtcacatgatcactgtgctggacactgatgtctctggagtctagagtctataggcaggtggtggcaatcttttttttttcatttgttttttttttgggcgtggcgtgacaatgcccacgagattttgttaatgggaagatggggtgatgatttcataccactagccttttgtcactaagtccttccactgaatggggagaagttgctgatgaaacagacaaagatgactctaatgagacatcgtagtcaatttctttccaactcaaccgcacatatctattgcctgacgttggagtcgaggacatgaggattgagatatcatctatagtactatatgtgcagcgtatatcacttacatataagttcaatgtaagttagacctatatatcagtcacatctgttacacatatagtactttcttcattttataatataacgatcgggacataccgaggcatgtacatattcatcgtactatgtagcatcccattcgattttagattgtcatattatggatggagactgaagagagtaatactacggatgatgcgtgtccatgttatacacattgtattatttattaagtgattcttgaattatggcttgtttcaatagatggagcaattctttcgaactatagtactctagtgggacgattgaattgaaatccatatccgaaattttcttctcgagcaatcaacggaaggctgagaagaacccctgcttatcatcgattttgtggtactcacacagtggataaacaggcgtcgttagaggttttttctccaaattaaggtcagaagatgtctaaacaatcccttaaaaaaatgataaaatgaaaatggccattagccaatcagtaaggtgtccatgtgttgagctccttgctgggaatcttataattttggtgtaagtacagaaccaactcaacagatttgtacgatgacgctgagattcgttaacatgccaagattctgattctctttaggcagcgagcttagcaattgtactcatatataggcaaagagattcctttcagattcttgctcttgcttaagccaactaaacacgtacccaatggagaaatgcctcaacgagtcagtcgaaagcgatcaacggagaaaccacacactatcagctatacatatcaacgcatggtgatcatgtaactatcaccaaaagagccaaacaaacggcctttgttttctttaccctttttgcagagataattcgccatagatcactcggcgacagcgaaaaacgatgtccatgaatgtgtgagttttcttctgaaatttcttcatgtccatgccacgccggcctctgcacgagtgaagaccaagggcagcaaaaagaacaactcattcaggatgtgatgccacatggtgttgatgggaagaatatgggtgattagtcgctgactggacggacagaccgctttgtcaacaacaaatcaaccaaaagcttcacatggctttgaatcgaagcggaccatggcgtagggagagaaaacaaagaacttaaacccgcgcggcctcatgtatcatgcatgattgttacaaaaatgatctaaaaactactaaaaacaatgacatatggtgtcaagagcaaccaccatcatgtaaaaagacgacagctacttctaagaggagttgcaaacgtatgttttggcaaggagctaggattgatggaaaaaaaaatcaatcaatcaatcaaacaagctgaagattcaggtttgcataccagattgcttgcaatttcaaaatcaagtctgaacagctctgcaagatggtaatcctatatacctatacaagtgatccccactaactgcagttattaccaattctctgcactgtggttgatccacgtcatccaaaaagatagcagccgttggatgaaatctcaatggtatgatatcaatgcatatgttatcctggtgagaacacccaagtattacacacgaaaagccaagctgttcgctccccttccccacgtagatgcggcgccgcatggttccccttcccctgcgctgcttcccctccacccgctcaactccctccctccctccctcactccctccccgtgcgtcggttcccttacctggccagcagtacaccagggagctcctcactcccataggctgtggctccctggtgagtattttactgctaatccgttttttaattcctgtaattgacggttaaggtgagaggccaaacttcttggatttcttttaaggtgtgcatctgccctcaacccttccctctcctcttttgtaccaccgatcatgtccttctttgcaggtgccctcccccctttctctctctcatacgttgctttgtttacactttacactgctcgatttgatagtttgtttcaattttctta

SEQ ID NO: 41641 - DNA, 11998 bp, Oryza sativa
taagagcgaattcaaggtggactggtgttttttcataattcgtaagagctggtaattatcacctcaaatttgttcatttttatgttggtttcttaatcgtattgaaatagttaaattttacttataccttcacactatcatctgagtcactttgtctcatgtgaccatgacctttgattatagaaggtcaccaacggtcaatggtggcctgattgagtttgcagttttatgtatatgtatatatcaccaacaaaaatgtcgttacaatgaaacagatggatggttggttcagtatatttctttttttttaacaaagaattaatagttcagttttacccgagtgtcagatttattactcaatacaattcttataaaaaaaaatcctttagttaattgtcttgcgcactgcacatactaccaacatttggcaatttatattggtatttcctttgtattcacaccacaataattcgtgtagttgctactgtctaatttgttatactccgatgcagagttcttttattactttcagttcagtctaggaccaataataagttcagaacttcatattactgacttggtcttttctacaatgaaatgcacactatgggatattttgattatcagattatggacataattttttatctaatgttatattttattttcctattactatttactagaatatgcaagggaaagaggaatcaataattaaaatattgatatggcaacttgcttcttgctggtgaataaacacttgaacaattctagcagctaacttaggtgcggtcaatcacagaatctttgttattgatcctatagtttcttgcaaatattcctaattgattgtgttgtaagcctaaagattgtatttactttttatttaattcagtatgcctttcatgctatactgcgcaaattgtgttgtaagcctaaaattctattcactttttttttaattcagtatgcctttcatgctatactgtgcaccactaaaaagcacgtcatagtttagattttaatagtaccgtgacgagcagaactgttgcacgttgcattcgttttgcatagcaacaaaacaagcatgtggtttctgttagtctattgatttattttttttgtcttttgtctctgctaatgttttatttgttgctctcatgtctcaaaatagatgtcctcttatagtaggttcgatcaagtgatgctcacgcaactaatatttttatttcctaattctctatatctgtacaatttcactctttttcgatatgatttaaattatgttctccagttaaattggatggtttatgggtcgcatttaactttgtccatattttcagtattatgcatcacacgaatgcaatatatactgatgtatgctatatatgatatctaactgatatagttcttaaaggtacaaatatgatttatctttatatttttctcaatgaatcctttgcaatcccgtagcaacgcgcggggtatcatctagttatgttaatatgaaacgccttttgttgtttactatcttctcattaaaatataatgcattaactaaaggtcagaacctaaagagtggcaataagatagcaatacaaaacaatacatacataacttacagattaatataagagtaaaatactgccagcattctattcatattgcaatctgatgtcagcggttcactgctgctgacatttaaaattctctttcaatcatagcaagttctccagaaatgatatgaatcatgattcttctcaacccagaaaacgctaaatttattgtcatttagcctaatcattagttcaagctcaacttgagtgatgtgtgccaaggaaaatcaggcatctcatgaaagcaaaaggcaaaatggccaaatgctaaacatcatggatcataccactattgcataatttcaaataaccatacgagaagacaaatccacacagcaccaagacgccatgacatgcatagaagaacgcaagttcctatataagcagttatgtagcgatctatagacaaatactcaaatccatgagccagttggtttgcacttgcttgacacaaggacaatgaaagaaattggtcagtaatacgcgttatgcaatcctacgtacctagtggacttctccagcaaggatcttatctgtttcttcatcagcctcgatgccatcttttttcatacgatcaagcaagtctgacgctggttctcctgcattgacatatgtcttcagtaacccatggtaaacatcccttgtcagaggaaccaatctctgtaataagcttgccatctcctcagctgcttctacattcttttgctctgcgaaatagtttatgctcatcagcacatttgccaggtcaggtttccattcattacttgcagaagcaagtgccttctttgtgagatctgctgccttcgacacctgaccaaccttgaaatatccaccagccaacttataccaagtattggaaaaaagtgtcctccctttcttgatgaattgatcaacaagagcttctgccttctccataagaccttctttgcagtaagcagtaagcagtatgttgattaatcgggaatcatggtaaacatgcttactttcccactcttcatatgctttctcagccccaacaatgtcattcatcttaagtaggacacttatcctgcacatgtacattgtgttgcatgccgatgccggaactttggatctatagacatcccagatacggtccacctcactgtccatctgtagatcggcatacatggttagcaaaaacccataagcgaccctaccatccttcctcgcagtaatcctcttttctgattcttgaaaagcctgcaaggccctttcttgcatcccagctttcatgaaaaccttgcctacaatggcaaatgagtgccaactcataagattattacacgatgccttctcgagaaccttttcaatcgcctcaacatcttccacatccgcgtatgctgacaccagattgtcaatagtgaaaatatcaggcacaataccaccctcttccatagccttatacatggagtccaccctctcaacctgcccgatttgcgaataaagattcatcatcgcattgtaagcataagaattggccatccccatgccccgcatattctcgaagagctcctccgccttctcgacgcgctcggcctccgcgtagcatctcagaagggagccgtagcactgcagttccctcagctgattcggcacagcgtcgaagtactccacggccttgtcgaggccatggaccttgctgatcagctccagccggtacgcgacgtcgccgggggataggtggaggtgccgccgctcggtcatccacatggaaagctgcaaaaaaaaaaaaaaaagccaccaaattgcatgatcagatgcggcgatgggggtgggcatcaaggatgaggagttcgtcgcgcacctcgagcgcctgggagaagcggcagcgacggcgcaggtacttgacgagggactggagctcgggcttcgagacggggcgttcctcggcgagccaccactgctccaggacgggggccagcgggatgcgcgggtcggcgcccgcgacccgccggaagagggagtcctcgccctgaaggcgcggcggcggcggaggaggaggaggtggaggcgagggggagacggtctcctcggcggacacggagaggccgcggcgacggcggaggaggccgccacggaggtggaggaggagtccccgccggtgcagcagcatggtggtcgccgccggcgatcgcgcggcggcggaggcgagggttttggggggaggaaggagagagtggcccgaaatgagcgtctcgtgatgtgtaaagaatgggctgaagattcgcagaagtagatcagcaaggcccattcaacagtcctgtttcggcccaatatttatgggccatacgtggatcacactagcgttttggcccatattaaatgggcttggaacaggccgcattggatgacaatcccattttggcccaaataaaatgggccaaacgtgaatcgttataacgttccggaccaacttaaagaaacagtacagtttttgcttagacagagccaaacgaacagtacgtacattcttttagctttagattttttttttatcacaatgccactacgaaccatcagaatcaaatgtcattctgccactgaaaagataaaaggtaatttgctgttgtgccactgaatgaacgaccgtgacaactcatccaccatttgcagcagcaatgggttcccaatttcccaaatccattacgcgaccgtggcaatcaggaaggtttacaaaaccgtgcggttatcacacggtaatcttattagtctttaaaataacgctatacctcatggtaaccatacagtttttacaataaccacatggttatcacggtaactgttaaaccgtaaaaccacgtggttatagtggtaaatgccaaaccagtttctacaataaccacgtggttatcgtggtaaatgccaaattgggaagtaatcataaccctttccaaaatggtttgataaacccgatcaggatatagcggccacggaaatgaagggctgataactgcgggcccaccaccggagtccaagaagcgaggatcaccggtgagctcgtttgcctcgaggtgcacgcgcgttttccaccattgctatgcacaagcgtttttgctagtaacaagtacaaaaatactagcagtattcatattaaaaaaaaatcttcatctgatatcagcgctgctgccatttaatttttttctttctaacttagcaaatcgttcagaaaatgatacgtatcatgattctacccagggctcccttcgtcccataaaaaaccaacctagtactagatgtgacacattctaatactacgaatctggacatacatctgtccagattcattgtattagaatgtgtcacatccagtcatatgttcgttttttttttggaacggatggaatagactctgaactgaactgattgacattttagactgatcattcattcaagctaatgatgagtgatgcgtgccaaggaaaaccaggccttctctaaaaacaaaaggtaaaatgctaaacatctcagatcctaccactactgcataattttacataaccatacgacaaagacatatccgcacagcacaatgacaccatcacatcacatgcatagaagaatggcaagttcctatataagcagttgtacagaggtttataatcaaatactcaaatccacgggccagtgggtttgcacttgcttgccccagaaacaagaaaaaagacacaaaataagtaactaaaaggaataattggtcagtgatatgttttatccaatcctgcgtacctagtggacttctccggcaaggattttctctgtttcctcatcagcctccatgccatcttttttcatacgatcaagcaagtctgacactggttttcctgcattgacatatgtcttcagtaacccatggtaaatgtcccttgttggagtaatcaatctctgtaataagcttgccatctcctcagctgcttcgacattcttttgctccgcgaaatagttcaggctcatcagcacattcgtcaggtcaggtgtccattcattactaccagaagcaagtgctttctttgtgagatctgctgccttcgacgcctgaccaaccttgaaatatccaccagccaacttataccaagtattgccaaaaggcgtcctccctttcttgacgaattgatctacaagagcttctgccttctccataagaccttctttgcagtaagcagtgagcagtaagttgattaaccgggaatcatggtaaacatgcttactttcccactcttcatatgctttctcagccccaacaatgtcattcatcttaagtaggacacttatcctgcacatgtacattgagttgcaagccgatgctggcactttggatttatagacatcccagattcggtccacctcactattcatccctagatcggcatacatggtgagcaaaaacccatatgcgaccctattactcttcttagcaatcttcttctctgattcttgaaaagcctgcaaggccctctcttccatcccagattgcatgagaaccttgcctatagtggcgtatgagtgccaggtcataagatcattgcacgtatcggccttctcgagaaccttttcaatcgcctcaatatcttcagcaaccacatacgctgccactagagtatcagtagtgaacacatcagcaacaataccactctcttccatagtacgatgcatggagtgcaccctctcaacctgcccatcctgcaaataaagcctcatcatcacattgtaagcataagaactggccatccccatgccccgcatcttctcgaagagctcctctgccttctccacgcacttggcctcggcgtagcatttgagcagcgagccatagcactgctgctgcttcagctgatccggcatgctgtcgaagtactccacggccctgtctaggccatggaccttggtgatcagctccagccgatacgcgacgtcgccgggggatagatggaggtgcagccgctcggtcatccacatggaaagctgcaagagaaaagaaaacaaaacaaaatcgaatgatgcggcgacggaagtggtgaacaaggggattcgtagattcgtcgttcgtcccgcacctggagcgcctgagagaagcggcggcggcggcagagatacttgatgatggactggatctcgggcttcgcgatagggcgttcctcggcgaggcaccactgctccaggacgggggaaagcgggaggcgcgggtccgcggcggccgcgacccggcggaagagggagtccttcttgcgccgcggcggaggaggcgagggagaggctctctcctcggcggccacggagccctcctgcggtttccccggcgagggcgaggccgtttcctcgtcatccacggagtcctcctgcggttgccgcggcggcggaggaggcggcgacggggagacggattcctcgaccgccactgataggcggcggaggaggccgccgccgccgcggaggaggagaccacggcggtgcagcagcatggtgggggggcggcgtcggcgctccggcgaagtcggggcgagggttttgggaggggagaggggaaggaaatcgcaaaaaaaataataaaataaaaaaaatgaaagggcgtctatagcaacgcgtaatgggcaagcccagctgcggtagcagcggatcagcgaggcccatctagcccaatcaaatatagctcgcgcgtgaaccgcaatccccctgtctcctcccctgcgcgcggcacaaggcatcaccgccaccacctactcttcttctcctcacaagggctgcgtacgttgacaggagaaaggggagactgactcgttttccgcacgcacttttttcaaactactaaacggtttgttttttataaaaattttctatagaaaaattgttttaaaaaatcatattaatctatttttaaagtttaaaatagttaatactcaattaattatacgctaatgactcacctcgttttgcgtatcttcccaatcccttctccctcgaacacagccaaggtcaccataggaatcctagcggctagattctcccggatccaaaacggcggcggagcatgggctgcagctttaacggcgctgaccgcggccactgcatcaccggcgactgcccaaaacacgatggcccacgctgtcactggcacgacgttggccaggtacacgctcgcaagtcgcaaccccggcgtcatcgacggcttcaacgtgccggtgagctttcagccaaccaaaaatgtcgctcgctgcactaagatacgctgactgacgtgcgccgtcgagatcagccggagacggggggttgcgacagcacatgctacaagtttagcaacgtacgacacctactatagctggcctgccaggggcagtgcgagcacccaccgaccaaatactcgaggttcttcagggacaagttccctatacgtaaaaattcacatcctctaccataatggtactaccactacaaccactgacgtgtggagtaataagaggatagaacccccatgtcagtgactataatggtagtgacattatggtaaaggattcccacccctgcaaggagggatgatcagagcagcatcttcacctccactgccggaaccaactgccatatcagttgcccatctccaaggttagacattactacatcacagctccttctctggagcaaaacatgggtattcttgaatgatgttttgaatattagttatgctgcaaagtacaacttgcttcctaaatcgaaattttaattggatattgaaacttttgctgctgtttaatgtaataaaacttgtaaatcatgttaaactatatacttttcaacatgtacaattaaaagcattcctttgctgatgcatgatttcagttcagttcataacataattttacattttgttggtggtttatgaatgcaaagcatattaagagagcacaaatgagattgtcaggcaacagggtaagtatgtgcttggtgctcctaaattgcatcagaaaatatattaggaagtatgattgtatgaatctttcatcctcattaagagaaagtactacttccattttcaacatgagtcattttttctgctcatttcaacgatttcaccattgaatgattgaaatcagttgatgatgtacaaaaataatattccccaactacagaaggagtaacctgaaatcatgcccttactccaggtgtttaaaaaatcagaaaatttacgaaaaaaatattaacacataaacaaaagattaatggcgccactgcaaacggtttattacttatgaactcacggtgttcaccccattagcatttcaaaggaatctgcaccatgagcacactggtactaattgtgtgcacctagaaggtcctgtaacaaggcagcagctgattgcacttatacatatctcaaactgcattttcttaaatatgaagtgttcctggagtttagtgaatctgggcaaagtaatattctcataagaatatccaaggcaacgatatgcatcataatgcgtcaaattgctaaaaaaattttctaactcagattgtctatggagacatgcatttagtgaaaatccagtgtatattcttgtagaactattaaacatgagaaaatctaagcggtagaagttcgcccgtagacactaacttcctgtattgcaatgaattatttctcatgtttaatagttcttcttggattccatcacaaccaaatgaaagagcttggcatttctgaaatctgtacatcttttgtcaggattgaggtcctctgcagtcaaatgcatagtgcctttatcactgacatatgggtccaagaatcattgggcccatatgtcaatgacaaagtcacgtgacttcgactgcagaggatcctgatcccttttttcaatgagcaatgcaataagttagtttctctaatttttattctttgtatgaaccgtttgttgatttacgcgcatggccaattttatctatatttttatggttgtacatttatatcctggcaaagttttaccccaatgtaagattgtacatactgaattattcataaaagaatttattgttggcaaatatataaccgaaaaacaataaccacttgattattcaaattaacgtggacttcctgtgaagagagaatagtgacagttcaccaccagctgcaaccgataatttaaagttttaaactgttgtaaattaacattctgaccataaaagaactaaaaatcatgtcagtttaaaagtataatcatgtaattaattttaattctcacaattgacatttctatacaacttatttaaataaatggccttttgtgtaaaataaaaaaaagacatactaggtttcctgctaaatatgttctctgaacatctatgtagaatagaattgaatttactaaaattatatctattacaagggaagtataaacaaattatattataaaaggagaaaatactaatttatgttattaaatattattttaaaaaaatagttaattattatacatctttatagagaaggaggttataatcgtgtaaacacgcaacactagtttagattgatcatttgatcattcattcaagctcatgatgagtgatgcgtgccaaggaaaaccaggccttccatgaaaacaaaaggtaaaatactaaacatctcagatcctaccactactgcaaaatttcacatagccatacggcaaagacatagacatatccgcacagcacaatgacaccatcacatgcatagaagaatggcgagttcctatataagcagttgtatagtggtttattatcaaatactcaaatccacgggctagtgggtttgaacttcattgccccagaaacaagaaaaaggacagcaaaataagcaaagaaaaggaattggtcagtgatatgttttattcaatcctgtgtacctagtggacttctcccgcaaggattttctctgtctcctcatcagcctccataccatcttttttcatacgatgaagcaagtctgacactggttttcctgcattgacatatgtcttcagtaacccatggtaaatgtcccttgttggagtaaccaatctctgtaataagctcatcatctcctcagctgcttcgacattcttttgctccgcgaaatagttcaggctcatcagcacattcgtcaggtcaggtatccattcattactcgcagaagcaagtgccttctttgtgagatctgctgccttcgacacctgaccaaccttgaaatatccaccagccaacttataacaagtattggcaaaaggcatcctccctttcttgatgaattgatctacaagagcttctgccttatccataagaccttctttgcagtaagcatccaccaataagttgattaaccgggaatcatggtaaacatgcttactttcccactcttcatatgctttctcagccccaaccatgtcattcatcttaagtaggacaccaatcctgcacatgtacattgagttgcacgaattggccttctcgagaacattttcaatcgccttaatatcttcagcaaccacgtacgctgccaccagagtctttttttttcttagaactgccaccagagtgtgagtagtggatacatcaggaacaataccactctcttccatagcctgatgcatggagtgcaccctctcaacctgcccattctgcaaataaagcctcatcatcacattgtaagcgtaagaactggccatccccatgccccgcatcttctcgaagagctcctccgccttctccacgcaattggcctcggcgtagcatttaagcagggagccatagcactgctgttgcttcagctgatccggcatgctgtcgaagtactccacggccctatcgaggccatagaccttggtgatcagctccagccgattcgcgacgtcgccgggggatagatggaggtgcagccgctcagtcatccacatggaaagctgcaaagaaaatcaaatcaaatcaaaacaaataggaatcggtggcatgatgagatgcggcgatggaagtggtggccaacaagggggattcgtagattcgtcccgcacctggagcgcctgagagaagcggcggcggcggcagaggtacttgatgatggactggacctcgggcttcgcgacatggcgttcctcggcgaggcaccactgctccaggacgggggacagcgggaggcgcgggtccgcggcggccgcgacccggcggaagagggagtccttcttgcgccgcggcggatgaggcgagggagaggctctctcctcggcggccacggagcgagggggaggcggtttccccggcggtggaggaggtggcgacggggagacggcttcctcgaccgccacgcggcggatgaggccgccgccgcggaggaagacaccacggatgtgctgcagcgtcgtggtggtgtt

SEQ ID NO: 41642 - DNA, 24771 bp, Oryza sativa
gggggccggcgtcggcgctccggcgaagtcgggtcaagggttttgggaggggagaggggaaggaaatcgaagaaatggggaataagttcaccgtacgtccctcaacttaacaactagtattttttttggaataagtccactttggctcccttaaaaatgacccgaatctaatccatgaccctaaaccgcaaaaccggatatctcgacccccgaactatcgaaaccggtgcaatttgactcccttggcggttttggagggtggtttcggtgacgtggcgctgacgtggcggtgttgacttagtctgtggggttgacatggcgcttaggtgtcatttgaattaaaaacggatatgtgggacccgtttgtcattcacacattaaaaaacatggggcccactgacatgtgggacccgttcttcttcctcccttctctctttgtttctctctctcctctttggccggccaggccgccgggggagcacgagctggagcggcggcgggtgggggccagagcggcggaagctgaagcggcggcggcggtgggagtggtggcggatggcgctcgccctgcaggccgactgcttcaccagcgacctgagctagctcatcgccgacatgatgtccgggtcggtgccgcttgacgcaacacgcaagcacaagtatccctgggagggtggccatcttgggtgtgttcaagcgagacaaaattaattgctcccccctgcctactcatcctattcttcagtggatggtgaacgacctgctaacggtcaattttatctctggttagttgctaaatgaatcaattttatttctagatttttgtgatgcttgtggccttagcagcactagttgaaggagacgtaacgggggatgagttggtggcgatgatggggctggcgcgggagttgacggccacgcagcgagctcgagcaatgacttgacgacgtcgtcgttgcaatgctgaatggcgtagctcgatggcggccctcgcccctaactagcttgacaggttcgatgtcggccgtgtcgtcagcttgtcgcatacgccggatgcccggatcttgttgttgcaatcggcggagaggccagagcgccggatattgttatcacggacggcgagaggcggcggagggagcagggagctcgttccccggtgagggcgccatgacggtggaggtgaggactggggttagggcgcttaggtgccgtgccgtcgaccgccgcccccccgctcgatgtcgtcggcatcggcgtcggcgctgccgtcctttcccgcctccttgccggtcatcgagctgcccgttgccgctctggaacccgccgtcagctctagcccgccgccgctgcttcagcttccgccgaccaccaccactctagcccccgccgctctagccgtgctccagtccccgcggctggccgaaggggagagaaagagaaagaaagagagaacggaggaagaggggaggaagaataaagagagagatgatgacatgtggaccccacattttttttatgtgtgtgaatgccaaacgggtcctacatatgtgtttttaattcaaatgccatctaagtgccacgtcaaccctatagactatgtcaacaccgccacgtcagcgccacgtcaccaaaaccgccctctaaaaccaccaagggagtcaaattgcaccggtttcaataatttgggggtcgacatacccagttttacggtttagggtcatggattagattcgtgtcacttttaagggagtcaaagtggacttattccttttttttttagattccttaaccacaaatttagaaatatgtaccctaaactcacacaaaccgtgcactcaacgtcctatgatataatatataggtggtttcacttacatggcatcctagtcaggaaaaaaaagtgcgtgagacctacatgtcagttgcactttttttttctcttctctcgtacttctcatctctattctcttcttcagtgagggaggctggcggcggacgagaattcacaagccacacaagctgctgtctggtccatggatcacaacttgaacgagttgtttgagcttcccatggatttgaggtccttgtacggccccgacgaggtgagctcctgctccatccccgctgggtagccggcacaccgccgccaccgctgctgccttctctgccgcaaccgatgaccccacctaagctccggaggccagactcgcaaggatcagcgacagcgctgctgtcacggccttcacgccgagcgacatgcccggctgcgtcgagctccgcggcctcctgacctctcgcatatctgattttgcggttcgatgacgttttttatctcactgacaagttgagagaccttcagtgtactttttcctaattttgctaaggctatgttcgtatggggtggatgggaacttattccctccgcatggaaaacggaacggtctattagcgcgttattaattaagtattggctaattgttttttaaaaaatagattaatttgatttttttaagcaactttcgtatagaaactttttgtaaaaaacacactgtttagctgtttgaaaagcgtgcgcgcggaaaacgagggagatgggttgggaaaaaggagttacaaacacagcctaagcctagctgcggtagcagcggatctgtaaggcccatctagcccaatcaaatatagcccgcacgtgaaccacaatcccgttccggcccaatttatatgcgacttatgggtggctcatataaaacctcgaaatcaactccaaaattaccaaaattaagttttaagatttaaattttggcatcagcattatataatatacacgttatgtagtaaaagacgtggcacgtacgcaaaatgctgtttatctcagacttcactgtaaaatcgccaatgacaccagtatatcacagacatgcacaaattatgcgtacattctaattttctaaagcaccctctattaattgcgataataaggaagttgcaacgcttcaaggcagagcgaaagcgaggcggcaaaatgaactggcaatataaccgtactgaacaggtcgtcttagttattagccgtactgaacaggtcgtcttagttattcttctgcagatgtcacagttaaaagcgatgtggcacaggcatatatctaagtttgaaatacggatctatgaatacaagaaaatgccatcaatagagcaaactcgatggtcgacggatggtagaaacaccaggaagaggaagatgcggatacgacggtaaattttcctcactccgaaagcgtggacttcagctctccactcttctccagctcaagaacgatgtcacagcctccaatcagttctgatttgtagtacagctgagggaacgtgggccagttggagtacgtcttcaagccttgcctaacctcctcgtcggataggatgtcgaacgctccgaagctgactcctgcttgcttcagtgcattcacaaccttcgaactgaagccgcagcggggggcatctggggtgcccttcatgaagagcatcactggggcagaggaaatcagggccttcaggcggtcttctagactttctttcgcaacgatccctttctcagatagaaccttcttaagctccccactcttatgcatctccataacaatgtctgatccgccaaccagttcaccgtttatgtacagttgagggtaactaggccagtttgagagaagctttagaccctgcctaacctcatcatccgtaagaatgtcaaaacttgagaaagggatcttctcttgcttaagaatatgcactagttttccactgaatccacacttgggctcctcaggtgtaccttttataaatgccatcactgtgctgaaattaacaaggctttccaagcgttccttctgagctgcagtaagcaaagctggttcagaaactgcaccactcttctcagtatcaggcttggctttcactgcctcctcgtttttgcttccctgtggctgcagcggaatgttgtgctccttaaaaacatccttcagttcaccgctttcatgcatagcaatcacaatatcacatccaccaagcagctcacctttgcagtagagctgaggaaaagtcggccagtttgagaactttttcattccttcacgtacatcgttatctgttaggatgtcaaagctcccaaattcaactccttcctgcttcaaaacgtcaactacttttcgactgaaaccacaccttggttgctcaggggttcccttcataaataagaagacgggatgggaattgacaagctgctccaatctcttgttcaatgcatcttctgcactactagtggcagaagctccattttgctgtgccatctcttgaaccttttcaagtacagcaggcccagcagccacacccaggctagcaggcacagcagactcagcaacgctggcaggcccagctaactttgcaaccttattggccaagctggctggatttgcaccctccagagtatcaacagttttaccttcctgcaaaccccaaaaaaacaaagacacaaagatgacaacctctttaagtaaaaagcatcatactgatatttcaaataatttgctaacaaatattcagcaatatactaaaggacctatgcatgcaagctttaatagtaataatcatatgatcaggtgcattggttcaagagcacaattcacagctcatactgattgtaagtccatgaattgagagagactgtgtgttacaccatcagacaacacacctcatcagatgtcataagatacattcataaggagtctttagtgcagacagttatggtgcactaaattacacaacaaggtagaatctttactgcacctctaaaaaatggtaacttcactgtaggcagctaatgtcagtggagacaatccaaactcattacttcagggtatatgagcaagcaaatctgatcactattttgtggaataaaaaaattattgcacctctcatcttgttggaagaatacaagctacttattcagcattatagccatactagcattatacaaggctagaactcatccgcatcaagttagtaaggaagagtatcatgatcctaccagaagttattatgcaaaaatatataactatgtgaaatggttcgtgtcagaacaaattatataaaggcagttgcgaataccttcaagaaaacaaaatatggcactgctgtaactccatatgcctctgaaatttcgggttgttcctcagcttcaacctgacaaaagttactagtgtatgagaaaacaaacaagcaaatgatatagaagtcaaattctacaatataatacagtgattaacaattactagagagactaataggaatataagtaatgcccaaagaaaaatagtcacaaagaagagctactgaattataacagtatttattatataacactcagtttgatggtatcactcaatgaaactacagaataatccagtagcaaaacgaatcataattatgtaagggactggaaatatttatattttgtctcatactcttgagtcttgacagatttcagagtccactgagaactcaaaaggttgcaggacatattctagcgctaagagtatggttcctagcacaatagcaactagtcagacatgcagtaagctacaacccaaggtggaataaacagtgaatcggtgctaagcaggaaaatgatcagcgcttaaggatgttacacaactacctcttcaggagttgcattcaaccagtaagtcaaactggataaacaagttggatgggcaatcaaagaattgtacgctaagcaggaaaatggtcagcgcttaaggatgttacacaactacctctttagttagttgcagtaagtcaaactggctctttagttagttgcagtaagtcaaactggataaacaagttggatcggcaatcaaagaagaagaattgtacttgatagttgatacatccctacacaatactatgaagtaaaagaaacaacaccacagttacaaatcaaacacagaagtagagcagcttcaatagcatttatcctacacagaacatcgaagaaataatcactatcaataatttatatactatgggctctatattatggcagaactccaggcagccaggttagtatcaacctctcaaaaacatatacctacttcccagatatataaaagcaaactaattccaaatctactcatgattcttgaaacaagattcacaattcatcatccgaaaaacatctcatatgaatctactaaaacaaatggtaggaaatacagtatgtgaagccaccagcaagcaagtcactgtaaccttccaccaaaatccttaccacaccataaccctaagcgaactaaacagctcaaatctaccgcgatcggggaggacaccagcagtggcacgagcgcacgcacgtacccggaggaagacggcgtgggagaagtcgacggcgaggtgcgcgaagacctcgtccatctgcttggacgcctcgcaccacgccgcccagaagtgcaccgcggcggcccgcgcccctcccgccgccgcctccagctccgccttcgaccccacctccctcaccgccgccatcacgccctcccccctcccctcccttccctcaccggcgacgacgagagatgcagcagcaggcggcggcggcggaggagagatgagaagacgactcgcggcgggggggcttgcggcttggggttttcctctgctttcctttttttttttcggttttttttcttcttcttttttacctcccgtgacgaggtgcgaaggcgacggaagattccagaaggggcgggcggggcggcgggtgggccggaaagtctcctggtatttgggccgcttcgggcccactcgttaggcgagttggacttttttttttttcttttctgagcgagacgcggtggtggggtctcggcgccgccgggagcgcggctgcgggtcgggggagtgaggctataaaaggggtgaaaaaaggggaggggttcacctgatggggaaatggactcgcatggccagaaaccctagcctccatcccctcccgagccttcgccgccgcaagtagatctgagactctctgttttttttccccttttgtatctgaatctctctgagcaatccagcaggatcagatctgtaaggcgtaggagtagtgatctgaaatccgtcagcagtagttgatacatctgggtttttttggttattgttgttttttatgtgatttttgtggtttgtgtgtgagttgggtgaatcaagtggatcgatgatgcttttcaagaaatactgcgttatcttcctgattacatgtgaggctgttgctatcatggccatggcctcctgatgacacaattatcttgctgagatccaagttgcggtaactttgccctcttctttttttcttctcttctgaattttttcatggtttttgggagagattttcgttacttgattacagttctaggaaaaggccaccttgttcaaacagggctttcttgaaagggatcaatttgctaggagtacatgattctaaaagcgatttcgaaataaaacacagttctcgatctcatacctgaaaacaaaaggcccatactgtgtaaactgtgattatgcttctgttaaaatgggatatttgtacaaaattgacgccaatcacctataaacagattgtgagcttttatcttagtaaaataaaatgtgacattctactcagtgttcagtgatccgatgtcgtctcttctgcgtacaacttctaacagccgttttcggtagtacaaactagcgaaacaccaaaaacgcagcatttgagttctggaatacgctgaaattgttagaatcaaccacgaaaccaaaatcattgttcagaaacgttgcaacgagataaaacacaagaacttgttttaacaaagcatacggacagtacatatacggttacaacacccagtctttatacagttctgctggagttccatctactggctgtcattgtatctcaggacagacaggttaacataggtacaacgcaattacaggctaaaccgaagcgaactacactgtcagcatctctaacagtatcgtcaagcaagcttatttacagctgctctagtaaatttacaacgtccctggcagaatccctctcgtttctggcagcgacgaggcacggtccatggccttagcaggacatctcacccgtcagctgcatagaaagcaaccgacttcagtggaatcacctgctcctgcaaaaaagttggttcgatcaatcacgcgtttaatccaaaacaaaatgggtattaattatgctagcctatgaagctacctcagagttctctatttgctctgcagggaaatgaagtccagtggaacagttctcaagcacctcagggctcttcatccatgctttgtgtgcttcaatggctttcagcttatagcgaaacatctgcgatacggatctaaaattaaggatgtcgacaattacttaacacaacaaataattgaagcaggtccagttaaagaaaagtagcagcgaagaatagcactctgaagtctgaacctcagataaagaaatggttggtttttccagttcatctccctcaacatggattccagtaccctggcattctgggcaaaggatggatgttattttcttaggtgcattttttgcctttcttcctcgattgctttttcccttgcttgcaattttgtctgctagcatctcatattggcataaaatagtccagtgcacaaggcaagaagtgtgaaacaaatgaaatgcctgcaaaattagccgtacaaagtcattggaggttgcagcagaatactacaaatttttaaagaagaaactatacactgtctatgttttgcttgaaatgaattcaaccactttgcattatacggtttggaatccctggtttgtgagaactgtaattccattacaacagtgaagaagttaccataactaatgaatggaaattagtcaaatgcctaattttttaggtttgctttaatttatttatctgtgagaaatgctaagcatgtcatgcgttgctatcttcaagaaatactaagaaactgcaaaggcaaagaatgtttgaaataacttaccccgcttgagtttctactgctgcaggctagatttcctgtcttgcagttgagcaaggtagctacatccttttcaagaagcattggtcgcccacaaatatcacaagctttctcagcagcaaggcgcttctgcttacgcaactccctcctcatagatttggtggataagaggccaacttgaagattgtgtgaagtacctgtcggggaacctgttatgatagcttggctattgtcatgggcggagctgctttgctcattcgactcctctgaagatgcttcttgatctgaaaatgacttctttcttctctttccacggtgtccagcatcatcaatcacgaagaaagatccagcagagataggaaggtcctgatcatcagaagaccacttcctgcccaactcaattgtataagagaagttgacaatggcaaagtcagattgctcataggtgtcacactcatccaagccatgggagccatcctgtcctacccaagcacaccagatcttgctaatctttttacttcctttgctagcttcccataacctgtatgcaatatttccatatcccaaaagatgcacaggcataatccgaaacaacatcctttagcaatacactaggaataacgagaggaccgtcagttccactttggtttgacagcacatgatcttcagatacagaagcagttctaccattaccatgcgcatttgcaccacggcgtgtgccttttgcgccattgcgagagctagaatcatctctcaacctcgaagtcacttcagtgtcgttggctggaaccagagccagctctctggtgttctgcgagctcgagtccagcaagagcgggtccttctcgcgcgagttgttgaagaagagcacgccgtcgttgaacggccatggcatgggcccgaacagcgtgaccttagcctccgcgtagcgccgggagtgcaggttccccttcaggtgatcaaacagcacggtgtcgctgaagcactcggtgaggcagatggtgcagaagaagatgacgcgcttgccgacacggcggagctcaacgtaggtgtgcccattctgccggacctccctcagcgtcgccttggcggcaatctcgcggatgtccacggggccgttctttctcaccaccaattccttccccaccatggagaaaccccctcaattcaccaccgaagctcctcctttttccgctattacagatccctactcaaatttcccaccaaaaaaataataatcccccaaatttgctttcaaaccaaactgcttgctgttagcactgcaccacgcatcaaaaaaaaaaagaggaagaaattccagcgttaattggagggaaatttactcaacctaaattcgaacggatccctaatctacacccccaccgctggggctgccaccaccacgccgggggggtcacgatgcggagcggggagggaagagagagacggctaacgaataccttcaattcgagccgggaggcgacggggggcgtcgggaggggcgcggccgcgtcgtcgctccgagcgttctctcgccgccggccatgcgcgcgaggagggggaggtcgggaagaggaagaggaggaggaggaagaggaggaggccaccctcggcgcgcctccgggagtgctcgccggggcgcgggcgcgcgtggggtggggtggggaggcggcgggagatggtcggcggtggcttcgccggggagaggagaggagaggagaggagagaggagatgcgtggagagaagggaaggtgagatgaaggtgaatggtatgggcgggcggctttggtccgtcgttaacttttttttttctctgtggactccgcggggacaatgttgcgtgggaattgggattagtgagttcgaaagatgagtttttggtaatcgaattaagggacacatatgattttgatagaaatataagcgtaaaatagattattgtaaaatataggaaaaaccgtttgattgaaccgcaggaaaaacacagaaattggatgagagagatagactcaaaggaaattaaccaagaggttgaagctcttgctaaatttcctctaaaatctctataggattgtccattccataggaattttaaaggatagaaaatttttttataggattgaaatcccctaaaattcctatatttttcttccaattcaaagagccctaagaataaaaatcgaggaggaaaaggataaacttcttgaaacagtcagtaaactactactactatgcagcaggatatcccgtatgttgttacatatgaccatgtaaagataaatagttttgagaaaagatgcaaagctaaatactctcttcgttttatattgtaagtcgtttgactttttttctagtcaaatttattcaaatttgatcaagtttataaaatgtcgacgtttgataccacgatttcggtatttgcatagtatggggatcgttggtactaggatatatgcgagattgtaatataaaatatggggacgaggatttttatataggttcgggcccctaaattgtgaagcccggtcgttgctcttattcaccataatcacatcagtccaatatttggggtagcctatctatctgttgtcgacttggtggtctgaagtgctgactcatagttgacaatagggtagccttccttctcgaatccgcatccggcgagatcaaagacagcgctatgtctctcctgacagtatccgtagacaccgtatgggacaagccatgcttatctctgaagtcaatatctggcgtcttgtcttggcgtatgttggcttgtatgttgatcttgtgtcttgatctattgttccgtgtcccctctcctcctagggggtcttgtatttatacccataggtgtcctcttgtccaagtagaactaggaaaaccaatatggatacaattcgagtagtccttgtcatttccatatagaaccctattcatccttccttatgcggaactcctcctatatccgaaggttatttccgtataagacatgatatgtggtgagtcctgccgagatctagtcaactactattaggtatgtggtattcataatcctgacataaaaattttttagcaacatataaaatatcaaattatttttattaaatctaacattgaatatattttgataatatatttgttttatgttaaaaatactactatatttttctataaatttagtcaatttgaagaagttagtcttaaaaaaaaaagtcggacggcttataacatgactgaggaaacttaaagacttctatacttgttacatgatgattggggagataatagtttttcaattaaaaattaataaaggtaagagaacaccttgtaattagttaatgctttcgttatttcctgaattttatgagctatctattgggtgaaccatgtaacaagtggttatggcctttctgaagcaaaagccggacttttttattatctaaaataaatacaacgaagaaatgaatgttactccacatgagcagagaccttctagccctccaatgaacgatctaacgatttaagattttttaggatgatgtagtttaatgcatactgatcttttgactttacctgtatatgatagtgggtcaagttgatattcctttttcttaaatcgatcacgtatcgttactgtgctatgatcattttaaaaaaatagttattgttttgtgaaatttactcaaatatagattgccatgtttgggtttcttattgttcatgcacacaacgttttcacactcagcaatgagacacttcaccgacaggtggccccaataccttacttacattacctgatgcacctaactcatgcagaaactctgatcatcatgcgctacgtgagaatcactcccaccccttctttttgcaaatactcgttggttttaattatggttgacaatgttttgaccacaacaaattttaaatgatataataatgttacatcaaagtggtatatttagattcgtaataaaatgtactttactagtaatactgtatttctttttggcgttcgcaaaaaaaaaactgtatatttagagatcaacttttatattatctaaaagaaataaagaatacaactataactatacccatacaattgaaacaaataaggactatatttaccttaaaataaattaatcagtacgaaagcgaccctaacttattcgccaacggaacatttcatggccatataacccagttcaattctgcgatgaactctcacgcggatgcgaatatgccacagggcttctgccgcgacgccgacctccgaattgacacacgagccgcgccgacacgacaccaaccaaccaaacagaacaaaataataataagaataattgagtggagagcagtgcaatgtcacgcaacagatttgtttcgcacgatgtgacccattcaccaccgtgcgctcgtgcgagtcaacaacatggcacagtatttgggagcaaaaattgggcacgggcatatccagattccatagcataattcaagtgaaaattatagagatccaaagggcatatcctaacccagtcctttaatccttctgacactaggggattcccctttgctacgggaattactaagtaattttcaatattatttttcgttacaattcagctaggagtaaaaagaaaaaaaataatcaaatctcagggcttatcaattttttttaatcatgaaagcactttatattaaatattataaaaatgatagagataattgtaaaactattgtggaaatgatgtgaaaggtagcgattgaatatgcttgcatgttaatttatagaactaaatagattgtagatgatcttgcatgcttgcacgaggttgaatatgtaattattgttagtgggtgataatgtggcatggttgcatgttaagctttaaagttagtgggttataactttatagaaagtatagatagctgttgtatctagagatagcgaatcaaaaatattacagtaaaagaaagcaaccaaaaacaggagcctagtactagtacaagaattactatgaggcctggtttagtttccaattttttttcccaaaaacatcacatcgcatctttggacacatgtatatagcattaaatatagattaaaaagaaactaattgcacagttagaggaaaaatcgcgagacaaatcttgttggtgatatgggtccgggggtatcatgtttagagtttggaggctgccccccaatgcctcgtggccctcccccaaggggagtcaggcccgaggtggggtggcggccactctttcccaaagattagtcggaggaggctgtcccccaatgcctcgtggcactcccccaaggggagtcaggcccgaggtggggtggcggccactctttcccaaagactagtcagaggaggctgtcccccgatgccacgtggccctcccccgagggggggagtcaggcccgaggtaaggtggcggccactccttcccagagactggatggaggagactgcccgccgatgccacgtggccctcccccgaggggagtcaggcccgaggtggggcggcggccactcccttgccgagactagagggagaaggctgccccaggcgccacgtagccctcccccgaggggggatcgggcccgaggttgggcggcggccgcccgctcccgtgactaggggtcgggctcccccgaccccctctctaggtcaccatgtacggtgggttaagtgtccgcctccaggtacccacctacccgcatttatggcggcccgagcagtcgcgccacgccgcatttaatgcggtgtgcaatgcactcaaccggtctgtgaccggtcgaatgaccgatgggactggggtagtgcgcctgtgcgctgctcgtgtgtcaggcaacgtgcagcctgacatgtcccatcaaataatgatggtgagaggtcctcatcctcttatcccagccggagtcggtcctcccgctttggtcaaagcaaggctcccatttcccggtgtaataggagcccagaagtcttcacccattaaatggtgactgacaggggcacccccgtgtcaggcggcaagatttgacaggcctcatcatcaagatgacgtgcgcttgcttcctaagtcaagagacaagacatgcatttaatgcaaagattgtaatccttctccgctaagttatgtttttgggcccatgtggtaaccccttgatatataaaaggaggaccttgcccgccgggaaataggacgactcacagaaaacctgaactctaggagaagaagagcgagagtgctctccggagtttaggaacccttgtaacactcaaccataattccaaacacaggagtagggtattacgtttctcagcggcccgaacctgtataaaccccttttgtcttatcatttttaggggattaaaccccctcaagatcacacagcttcgctcaccaagccctcgaatctcatccgctgcccccggccgaactcacaaaggggggcctcacggttccctgatggaggggttcattctccgataaatcttttgagtctaattagtccatgattagccataaatgttacagtaacccatatgtactaatgacgaattaattagacttaaaagattcgtctcgtggtttccaggcttccaggcgagttatgaaattagttttttcattatttgtgtcaaaaaaaactcttccaacatccgatcaaacatcggatgtgacacgtgaaaattttcttttttcgaactaaacatgcccggagtttctctcagtcgttggagccccctgactggcaatcattaacaggtaactggacttactgtgactgccttaaaattaattaaggactggatctcgtctggatcattttcatgttaatgttaggtggggcacatgatctccaacctggagactagcaagccaaaaattttgctgatcatgtcacaacaagcaaaaccagaaaccgagattatagtgtacataacatgcgaaatactacaatttattgaacctgggctatgatccgggcaagagtagatgactatcaggcaggaaggcatgtggaaccgtgtcgaatgagtaacagaagaaatgcagagcattgcagaatggcaagcccttgaaaaatgcttatgcattctccacaccaggcgcaacgtcctcatcaggcacagcgtcgtctgcattctcatcaggctcacctgccctccgatctacaaagtcgtaaccatattcctcctctgaaagattcacctccacagatctgccataaatgaatggtctttggcccattgttgtgaaaggcaatagccccaatgcacgggcggttttaatctctcttgcaaccttacgctgagctttcgcacttatacgagtctgaaaagcagatcaataagttagaaaccatggcaaagcatttatataaatacataattacgtgtgcatttgtgaaacagactcatacagcaaaacatgaaggtataccctaaaaagaactaaacaagataccacaaaagacactacgctgagagttgccgaggagagatggtgctacgtggcaccttaattatgatattgtgttactttagaactaagcactgaaaagaccacgtccaacaagaatcaacaaagatatctcattaacagcatcatcagcaatgcatgaactatacaaacaagacaatatttatgtctagtgatcaaaagttacatttagaatattggaaacctttgagtccctgtgcatgcattgaataaaagttgctatctgaactctggcaatcctttcttatagagaccattctactctgaaaatatcaatttgaaagctatctaaaatagcatgatgaattattaccatacatcaggagtgtcattacccaaatttctattcacagaaaggggaaaagttccttattacctgactcctcttgattataatgccagcttctgtaagaaagttggccagaaatctaacattctgcaaggaacaaccaagtaatcaaaaactgcagctattaatatacaggcaagatcattgtttgttattgtatcattcaaatgtaaaactatgtttgttttttctgcattctgaattgtacattttcaaccatgcacactcgttttacacgttgaaacttgaaatacatgcctacatacatcccaatgatttcgactttgatagttaccgtgttccagtatttgcatccaaatgtcatcttagaataatgtgaggcaataattcaaataagtaggttaacaagcaacatatcaacccactacagtaaactattttagttattgttaaaattcaaacacaacagcggtaaataaaataccagaatctcaaatgttataacttctaggatagaaagtagatcacatgctatcatcatctaagttatgacttcctcaaatgacataccgttcttgaaattagtcacagcataccaccattatgtgttactgaaattcatgctggttaactggctaaacactctatagtttacaagaatacaaggtgacaaagtaatgcaaaacctataattccattaaaagctaaaaaataaactgcagactatttacacagtttgtcaggcagatgtacaaaccctaaaatcggctttctttaaaacctcctctgtagttgtttgaaactgtggcctaggagggttctttgcggctgcaggtcttgtaaggtcaagatcctgcatgcagtagagtgtgataaacatgctgttagaagactcattccactacagtatgtccatggaatgagcaaacagatataaaaaggtaaactaaaattaatactaagagtcacattttctaagttttcaattgtttaggcattagtgtatcataataggaatttctctgttttgacaagcatgtatccagcaaaagatgtaaatttgtgtgtacatatacaacacatcacaacctgttctagctcacaaatttaccgctgagttccagaatacttattcaggataaatgtaatcctaaatagtgcacaaggcatgtgctctttgtatacttcaacaatgatgtgaaaaacagaaatccctcttaccttgacattataagttgagcctcgcctgaaagtcacatctggcctgtaatcatagtcatcgtcctcatactcctccgtcacatgaaaggtgcgggacgcctcatccaacttctcatccaaaccatcttctaaggaatcgaagcccgtgcacaattcagccaagatgctgctagagttacccctgttacggaacccacccctccaaccccagtcagatcctccacggcgattctcaagcccatcatccaagccactcagcatcctcttctcaaattcttccacgctctctcccacccctgcgccggataagccaaccaaaacaagcataagaacactagtactattgggacatcttttttaggcatcaactcctcaaacaatcactagtactgtcatcgcaattgggattttgcacgcgaaagctctacatcaacagcctcatcttttcgcttatgcatatgcatatccgaatcgcttattgtcaacaaaaacataatttatgagtacaacttttatatatgtgttctagctattcaaaagcaaatgctataaaaaaactacaacgaaaaaaaacacaaaatcaactctaaaattaaatttaaaaattaaaaattggcttataagcagcatatgtggctgcaaatctgcgttaaacctacatctccagccactcgattcaacccgatggataactacaacgaaaaatggcgaaggtgtgggcaagcacgaacaactccatccaggtcaggattcgacacaacttatattagggaatatcgcatggagggatccgttcgagaggaattctcgatcaggaggaggaggcggcagggggggggggggttctcaccgtcaccgccaccggacaggaaggagcggcggaaggtcgcggcggcggcggcggaggcgggggacgggggaggggggctcgaagggaggaggcgtcggagggatcgcctcagcgccgagctcgccatctcgccgcgaggtggtgcgccgcgccgccacccgagacaccagcgagaggaggaggaggaggaggtggggactggggagcgggtgatttaggggtttgggatcttttgcgtttgggaccctggagaatctccttattttgtgcggttttgagttgctggttttttttttttgaagtattgagttgctggttctgcttgtacttgttcgcgctcctccctctccggtcacattacgaggttcatcgcttagtctaataaattaaaatttataatttaaaattttgaaaagttgatttttaagatatttttaacggtagcgttggcttttaagtcgctataaacaaatatatgaaacttttacctataaattagtttttattccctaataaaccgttttggtttattagaaaatatgagcaaccaataagactcttttttcctttattttcctagcagactcatcattttgctcacctgctctgtgttgaataatgaattttttactgatatcaattttgtttacaaaatatcttcaaattataaatcatgtaaatttaatccatttgttaaagaaaatattccctccaatctttaatatctgttgttaggataaacaacttttgtataaatagatagttcatgtgtttatcaaagcgtcatatatcaatgaccagaggtacaacatttgattttgggagaactaaaatcagttctccgaagatcgcataaattttataaacggaatatcatgtttccatttcctctatgcaattgtaacaatatgacacaaacgtacaataataatttcattgtgataaactaaataaccaattcgtatacgaatggttacatgcaaattactactacctccattccaaaatacttgtcgttttgagtttttttcataacgttcgatcattcgccttatttataaaattataaaattattatttattttgtttgtgacttgttttattataaaaagtactttaagtataatttattttttttatatttacactaattttttaaataaaacgaatgatccagtgttacatgaaaaaatgtcaaaacggggtagtagcaaattacgcccaaacaaattggcgagagccgagaagaacaaaagtgggttcctttgatccttcaaacccaaaaccgaagaagcgcggggtgcaaaacgcaaaacaagctcgctcctgcgttctccatcgaagcatcatggcggcggcggcggcggcggcgacggcagcgaggatactcgagctggaccccgcgcacccgcgcgccggccgcgtcatcgacgacatcgtgcgtacggagaagcggatcttcccgaagcacgagtccctggcgcggaccttccacgacgagctcaagcgccggaacaccaccctgatctactcagccgcggccgccaccatccccaccactggagacgccgccgccgcctccgacgaggaggaggaggtcgtcgggtacgccatgtacacgtgcgccacctccctctgcgcctccatcaccaagctcgccggtgcggcacacaacaacaaacactcctctcccccctaaaccctctcaatctcttgggggctgattccgtggctgtggttgctgatgcagtgaaggagagccggaggaggcagggccacggcgaggcgctgctgatggccgccgtcgagggctgccggaggaggcgggtccagcgggtgtccctccacgtcgacccggcgagggcggcggcggtggcgctctaccgcaaggccgggttccaggtcgacgccaccgtcgtcggctactacgctccacgcagggatgcgtaccggatgtacatggatctctaggaaaccaaaccaatcagcatttgagcaagaacaaaaaaaaaaaggcttgtgaattgttcaggaaatgcaaatggagcaatatgttcttcgccaattgtgatagggaaatgctacgggacggtatcctgttcgaacgggatgctatctctaaagatcgcctgatacctggtaagtatcggccgataccccgtttggacgagatggtacctttgaggtattatctcgtttgaagtttgaaggataccgttatgtagcattctccattttgatattgagctcaactttgattggattgattgtattgatgcttctaacagtgaggatgatctgaagggagaaaaaaatggtatgaattggtgatctttgatgactgatgattctgcagtttcagctattgtcgctgactgtgaatattgcttaaaagtcagccagttcagttgaaatggtgttgtatgagcttctcctaaaaggagaagttaactcaataagaggctcaggttaatggcaactcttggataaaagcctcttttaacacaccatgagtaacagcagctggttaaatctgactcactgattagaaaccaaattttgcagcagtaaagctggttaattgtcaggcaatgcagtaatccgtgctttgccaattgtgatattgagctcaatttgatcggattggttatatatttatattgatacttctcaattctcacagtgaggatgatatgaatgaaaactttgctagtaagaattggtaatcttggactgatgattctgcagtttcagctattgttgactgtaaatactgatgtagaagtgttagccagttcaactgaaatggtgctatatgagtttctcatgcaaggtgaagctaactcaacgagaggctcaggataatggcaaatcttggataaacctgagtaacagcagctggctaatttgactggcgctaaccagaaaccaaattttggagcagaatcacttgatgcaaatgttggcagagccatcatgtttgtaaacagcaagagcaagctacaacagagctcagaataacagtaacaaacagcactgcctccatttggggcatgcacaagttctctattgacagagccatgtcagatatatacaagctggctttgatatgcttgaagataggacgcatgtaaccactaaataagttctacaacacgaccaggaggtttgtgtctccacaacggttcaggcatttccaagagcttgagtctaagcatggaaatggagaacttgggggcatagcttaatcagaacagagcattggctgaaggccgtcgacgaagcagcgttgcgagtcattttatgtgggaatcataaatactgaagatgacatccggaacaatcagaggcagcttgtttatgtacatgaacagccttctgaggttctctcttgacactgtctccaagtcaaccacatcttggtcctcaacatagatccataagtcaccagggtcagtcttcttcaagttgtcacggcagaatggacaagactgtgatcttgaattcctgcaataacacaatccttttgttcaagcattgttttttgaacagatatgtatggtagctgtatggcaactccagagtacaaggacgtgatccaagttttgctaacccaaaagatatgcatcggttgtaagaagccaagaataaagataaatcatatagatatgtaatatgagaaaacctaatgcacaataccacaaatgattttgttccgcaaacatattgaaacaaagacaaataaattccagatatacacttatacagtatcaatgttcgctaacaagctaggttgctctgcatgattccatgaccctcaacatgattgattagctaaatagttagctacagaaacaacagatcacccatgttttcataatcaggagtcaaataactacacatgattagaaacaggatgcataagaactaagaagcaggaacaaagacaaggtcgatataatcaatagactcaacaaaatgccattctcaaaagatctttggattatgagtagtaggagacagttcagaatatgctttgatttgctaagcacagaatgtataggcttcctacattttacaatagctgaatattcaaaattgtgctgtttactcgcttcataagtatgtatgtgcccgttatatcctgtttagttaagctactgcctactggacattgattcatagcgtcagaaggacttgaacttaagcctctgagcatattggtagggggcatgtcaacctgacattgttagctaatcaacagcaccacgtttgaagggtcctaagcttccatgggaccacgactctcaggggacgtccatggaagaataatacaaaacacatcatctagccaatgttagttaatcaatcacattcatgacagagaaggctgcagttgcacatcaccagaatgcagtcacacaaactacatgcacagaccaagaaattctgcgtaccagtcctggtagcatctgaggcacatattatgggtgcagttgggcaacaccactttgctgttcatctccatgcaaatcccgcactcctcttctctctcggcatcaatttcggataagatgtttctttcatcctcatctctccttctgtacctctccatgcacacggccttctgctttttgtcctccgtatcagtaatccccctttgcagttgcagcagagaaggaaatatcacagctgttccagccaaccatataacaattccaatcaataaaacaatgcaatgaggagaatatctgcataattagaccctcggctaaagttacaagaacatgttacattaccgtagaattctttgatgctggctttcctctcatgggtagacattgtcgtcgtcccgtcgacataaacctacacaatgagctacaatttcagtaagaaaaactccgaaacgcaagcaccgaaccgacaaacatacattgtaacatgccattagaccttgtagacgaggatcctcagcaagccgagagccccggcgaggctgcagtcagtccactgcaccaggaagaggaatatatgcgccgcggggctatacgagagccgcatctgcaggcacgcgccatcgtactcccggggaaattcggaggccctgctcatcagaacaccaagaaataaacaagcaattagcatcactgggtggtggatcacatcacatgtggctggataggcaccctgccccccctctctctgaatcacaccactaaaattctcctccacttttccgcagggaatttagaacgctggattgctggaacacatgggagggagtagtgttctttttaatatgctaaatgagcacgcgacaagatcccttcctgatctgccaccgctcgtgcgctcgctagctcgcggataatgtatcgaacaactgaggagacgcggcagaaatcccaccacctcaccagccaacccgcgcggcgcgccgcgccgcggcgtggttcgattacccaccgatcgatctctcacgccgcaccggcgcggcctcgccgccgccgccgccgcggcagctggaatcgagaggggaagggcgacgggatcgcggtggggaaagccggaggaggaggagggaggagcttacagggtgttggcgtgctggatgtcagcttcgagcaccttgaacgagtccttgtacgccttccgcatcctccaccaccgccaccaccgccaccgtctccaccgccgccgccgacgccgacgccgacgccctccttctcatccaaccccggggcaacccccccgccgcggccggaaccacccaccct

SEQ ID NO: 41643 - DNA, 8552 bp, Oryza sativa
cgagtgtgcgtgccgggcgcgcaggcggaggcgcgcgcgcgctccggccggcgccacgtgtgcgccgtggcgcgccgcggtggcgtgccgcgtcggggcgcgtgcgtgtcacggcgcgccacccgggtgttctcgttgtcttctctctcgcggtaattacctgccgtaagcctgtgttttgcattctgtagtacattgggaactaatcctctcaacacttctgtagtacattcttaaaacatcatttgttagattaatttagtattagcttaacaaaacttctttaaaattattattatcatatttttaaattgattttttatgaaaaatcattgtttaactatttagaaagcatgtgcgttaaaaaaattgagataactggaatttggaaagcgtttagcaaccgacaaaaaagaaaagccgtaaactaactgtgtgagaaagcgtcgtcctttatcctacctatggagtagatgtaatttcgtcgagttaaaatgaaaatgaaatatcaagtcttcgcagagccgaataaactttcttagaacttgcattggattgagttaaggtgatatctaaatcaaaagaaattctgtaggatttttacgggaaataactcccctgaaaaaaggggtaaaattcctgttgttgaaaagaagcttagcgtgtgagaaaatcttttgttgaaatggatcgaatacctctcatgttgcatttagaatgcgggaattttacgataatgttacaggaatttaaatattcgtatgaaacaggaacaataaacaagcatatgtgttcaaaatgagcatcaaatgtgaaagaaatacttcatcctaagctgcctctatgctgcttcaaattgatttccttatgttctaggaagacttcaaaatcttgtatattgctttaagcaaaaaacgagccgttaaagttaaacgcaggtgcaatgcattaaatcgtataagagcttgctttgtcacaggtggagcattgtataatctgcctttgtgttcatctgggcacacaagatattttgctagattgggtctacggttatgccgtcgctttctgcctttttcacgaggtacaccagctctaaccctcctaaatcacaccccgcctgcaaatcatcactacagctacccagtatattgttctcaacatgtgcttgtatttttcatactcttaggtggcatatctcgatcgaaaacctattgttaagctaagtgctcgtagcaattttttctattccatatcagttttcagtcaataaagctgtacaaagtacaaactttcggtgttaattagtcaatacctgatgtgtctgttagtacaacattaggcatttacatatcctttttaccatcgatcaaaataaaactgtccacattttatcccgggaccaaaccaaaatgtttttttgactatgtggtgcctccatcgaatttattgtttgtcctatggccgctgtaaaattttgaattctaaaacatagttttgaagttgtttttgagattttctaatcgtagtttattttgtagtttatttttgaacgtcgactcctaaattgctaaggccatatataaaaaaaagtgacccaaaaattattttctattgctgataatccatgctgcttataataagcattagactaactgatggcaacaaaagagttatagcatcaacacaccaatcaataacaaacaataacaaaatagagagaaatgaaaagaaaaactacaacatacatgtcaatatcgcttcaattattttaaattgctaaataggatggcacatgcatgatgccatgccatcaaaaaccgctcttggtcgcgaagctaaagcgaaagttgtagaaagctggaacaaaaaacaaaagcttgcttgaaccatcctatatcctaaccctcgaaagcgaagacgcaaagcttcacttttcaaaaggaaatgagtgaggctgacaatttaggtctaggaataaaatatgaagagtttcaagagttgtaatatggagagtttcaagagttgatggatgtacagaaaccgatttcatgacaattgcaagaggatgatgacgaggtacaaacccgaacagagccactgaaagttggaggttgagatggctaattgagagaacttcaactatagcttaaaaaaccatcatctggaacgagaaaggagatcatcgcagttgcggtgtagctcatcggagaagaaagtagcagatgacacaacttccttttcattgagcttgaggacaaaccctacactacagcattgatggtgagcccaaaagcccctagatgagaggcagttgctaaataagattgtggcaataccctccatgaccggacgcaaccgggacaaaacaagttagacgcaaacggctttcttgagctataaaagaaaagagaaaaaccaactacaggaagaactcaactatagaggacacaatccccttaccaacggccgatgactagggggaagaaagagaggggacggaagatgggatgcatgtaagtaactacaccggtacgaaagaagagagttttatagtatcacttaaaacttgaataccaagttatacgacgagatatcaatacgacaataccatttttaccatcagattttagttatttaacttacacaaacaagacaatcacactaaaattttactactatcgagctaatacatggacgctaatttatttatccaccggcagggaaggtgcaaataagcatcactgggtaggattatcagaggaacctaacaatttcggcactaatgggccccaccaagttgatgcaccaattggacttcatgaggtaggctgtggattcttcctgcaataaattaattaaggaaatgataatgataactgcggattagctaagagagcctaataaaaaaaacagtagtacgacaaagcagagaggagttcgggatatttctagactaacccagctgtagctgctccgagacagattgccttatccactactcctggtcccatctcaaaacaagattggagagcatctcatcagtacactgttcttctgtcaatgagatcgcattcaacctctgtcacttttgccccttctgaatctccccagcttgatgcagtttgtttatttttcaatactctaacctttaacacctttttctacaacaattgatttttcattttgatatgaaacaaaaatgaggaaaataaggtgttgttgttctaatataattgaggaatttcactttgggctatctttattaagtaaaattttacaatgaactaggactaaattcatattttcacacaacactgcatataattatatttttttttgtactttggactagggttcacaaagttgcaagcaccgaagactccatcaggtgatctactattttaataaattgttaatttaactttgggatggctcaattagacaattactctgctttaaagaaccgagcctaattaggggcgctataatccagtttcattattatggaattaacattgagtatttcattatttttagtttgagtacttcatcaagttaagtgccctcaactgttaagtagtgaaatatgatttgtgagcgttcatatgtagtaatgaaaccccatttatttaataggatctactataacttgctacattagttgttcttgtgctaacatgtgtatagttgtaatccctggtccaaatgcaataagaatgataactatatatgtggtgtcatgtgaaagataggttaggtcttaacccattgtaaaactttggttattaaagatcgtccaaagtaagattctctccacattattttagtttactactactccactagcttagatgctcatagcttgtaaccaaaaactctccataatttctttttttaaaaaaaaaactctccacaatggtttatttggcgatttggagagcatatgatttttttttgcaagcttcgagactgtattatcctgtttattgccccgtgatagactggtaatagaccttgtttatttaatatttcaaaataaattaaacatatgcaggagtaatcgtctgtcggaaagattttgatggtgaagccgaaaggtgtttcagaaaagaaagaaagaacgaaaggatgatgttacttcatattgagtatctcactctcaacagtcacctcctatgttatgtaactaatgcacctacctaggcctagcagaaggcaaaaatagaaaaaacttttgccccattatttacttgctgggttttattagccgtagcaaattttaaattttggaacttaagtataaagttatttttaatgttttctatggtactttgtttttagctttggattttttttaatcaaatgctttcgcccatctttactaacaaaacataacgattgttcttttagcattggattttaaataaacaagcagatataaaagttttatgcgttcgttcatttctccacgggttatcagccacagagcgatcgatcagagtgaattaataggaaattctattgcatcaaaattttatttacctgaatgccgtttttcttttatctttttaccactctctcttttacgctttaaactttcatttcaacccctttgctctctcactcttttcagaataaggaatcgttggttaaatagtagtagcagcagtataagacaaggcaataaaaacagacaagaggtagaaatacagtaaaatggacaaactagccatcatcacaggttcagtacaaggagcagtatttataaggactatatatcactatgcccccagtgaattcttgagcccctcttggagacaagcaaatttgataaaaaaacactagcctttgtctgaaaatattttagtactagtgaaaaggaacaatgaagaagggaaaatggtccaaggaagaggacgatttgatcaaaaaccacatggagaagtatggcattggccgtagctggcaggcactgtctgatgctttaggtttgtttttttttttcaccccttgatgcatacacactgttctgaacattggtattaacattaacaaattgatgtgctcccatcataaactaaaacgaaaagaaaaacttgcttatgtgaaaattgtgtttttttaatcaaatcgtcctcttcattggagcattttattgtagtcaagtaacctcttgcaaatgatctgctgttgctgtctagatcagttaatcttctgtttagggtaatagaaaatagtaggtaggtaaccctgttctactgcatgttatttactgtaaaaatggaaggcatgtgcagttacttgactacaataatttgtgcaacttttatgatctcaacagtttatattagttgcagaaaacactacaaaaattctgtttttattactagtagccccattatttatttatttgatcaatcctctaactgtacagtttcttattaattttttagacaagaaatatttctgttaggagtttaactgctatctattctcttctgattctctcagaaaaccatcactatatcgtttgctcatatctgacttgatcatggcaatgtatgaaacaagtgttttttttttccgatggttcgcagggctgcagaggtgtggccggagctgccgttcccggtggctgaactaccttcggccggggctgaagcacggcgacttctcgccggcggaggagaggatcatctgcaagatgtacagcaagaagggaagcaggtcagtgagccagcctcatgtatccacttctgttgttcataatctgagaattgttgattgtttcaacattgtctgcaagaactgcactgttttactcactgatttgatttgatttgatttgattggtctcatgttatatttagctgagatttcggatcaaatgatctgtaactttgtttatcacttctgttcatcgggatatgagaaattgagaattcttgattgttcaacattgtctgcaagaactgcactcttttactcactgatttgatttgatttggttgctctcatgttatatttagctgagatttctgatcaaatgatctgtaaattttgtttatcaatgatctgctagtgatgaataatgcttcaaaatctgcctgcttcgctttgttgcatcacggacacaagttgcgaattgttttttggttgccattgttgatggacgcagctggtcggccatcgccgcgcagctgccggggaggacggacctcgccgtcaagaactactggaacagcacgctcaagaagaggttcccggcggcggcggcggcgaggagcaccgccgccgcgcgccgcaggcaccgccccgccgccagcgccaccacatcgtccgacgacgacgacgacgtcgacgtcgacgacgcgaccccgcccggcctcgcgctggtcgtctacagcgaggggagcaccgccgccgcggcggcggccggcgagctcgctccgtactccatctcatccccggccgccactgccgacgcggcggaagaagaagagccgatcgcggccgttccgatcagcacctgcatcctggcactgccgccgccaccaccaccgccaccgccgccgccgagcgatgccaccggcggcgaggtgagcatcccctgcttccccttctcgccgctgccattcatcgagccggacttgccggagctgacctggacgaccgacctcgacgacattaccgccaccttcgatgccgccgcctgccgctacccgaagcggccgcatccaatcacaccggattcgcctcgccttccgaagcttcccgccattgccggcttcgacgacgtgcagagcttcttgtcttggttcgatgactgatagtgtagcaagaaatggctcagttcttggtcggaattaacagtagctggtttaggaggagatgcatggttatcatttgtgtaatctgttcgaaatttttttaaaaagtttttaaggttgtttgtgtggctactggctacgtgattatctaagaactatcggttgatctaatcattatctgtgaacttgctggttgcgaaggtgaaccaaatgatttagttttttagcataaatttgtcgcaaatttgttttataatttaaccaaaagcttttttgaaaaattgaaaataaaatcatctgtagcatatgcctacggtataatacgtcgccgtttctgcttgctcgtgccaccgcagcgcctcccgccgccgccgccgaccgatgcctcgccggtcgccgctgcctctactctactcctcctcctcctcccctttcaccgcttcattggcggtgctcgcggcgtgaccccgagctcggagctgacgtctcagcgctgctgctccgcggacggctcggcgcgcgccaactgttcgacgaattgccccaccgagtccggtggcgccgcggctaccttcgcgccgccttcgctgcctccgtctccaacctcaacgcgcgagacggccacaggggaggtaggtttcgatgatctcatcacctgcggcgatcgatcgatctcagctcgtcagcttccgatctcgcgtgtgacgcctggacctctcgtcgctttggttttggttgcattttaagagctttgtttaatttttttttcttgcagtgaaagcagaggctatgaaatcatcggcgcaatgaagtaatcactcctgtcaatggtgattgattcagcaatgctgctatcttgcgagaagtcaatccgtttctcgatgaaatattgctttggtctgaaaggttagacaaacattatcctcttgttacagattccaaacaggtttcttttcatggtttaatcctgctgacacatgtggttactggctacatgatacaatagctgccaatgaatgccaaggttggatggttacaaactgcatctgaacttgaaattgaaacactgactgttggtgcaaacctagagtttctattatgtttaatcggtataggacatgttttatgatccaatcttttatttttactggttcataaaagtgtacctggtgccaaacttcaaaaaaaaaagaaggtaaaagtgtacctgccttatctgccagtgtcgtatccagtacagagagagaggaaacacattgtattgagcaagcagctctgtcagtgtcaataaccatactactgaaatctattttcacagagtacaagtgtgctgatgatatataatggtagataccataggttattggtgagaaaatcttttaactttggaatttctgtttgtgcatacttcattaactgtactatccctattgtcctgttgctgtaaaactcgttgatcattttattaaaaaaaatatttttaaaaagctagccctgaatacctcattggattaaaaaaggtgttcatgtttgttctctttctctggtgctgaagctgaaagcatgttctccacatttttggccaacctataaattaaccaagttatcgaatgcaatatatcttagagaggacaactagatggtgcaaatatggtactccctccattttttaatagatgacgccgttgactttttctcacatgtttgaccattcgtcttatt

SEQ ID NO: 41644 - DNA, 31019 bp, Oryza sativa
attttgttacgtcaaatgtaacatgtgaatgccatttttattttaccttttaacctttacagcctcatcatatatagagttgtttgccaatttcttcctctttaccattccttttcttcatcccttctctcctatgagaatgaggaatcgttggttgtagcataagacaaaccaataaaataaaaaaagaggaagatatattactgcatggtaaaatagacaagttagtcaccatcatgcattaggtgactaggtgttactccttggaagcagtattatttataacataaggcaggcctcatcactctcatttgaattgtttagcactagacaagcaaaggctatatatttagtaatcaatagtaaaaggaaaaatgaggaagggaagttggtccaaagaagattactatttgatgaaaaatcacattgagaagtatggcatgagccatagttggcagaggctgtctgaaattttgggttcgattttttcacctctcaccatgcatataaatcattttccaatactatcattcatctaaactgatataatatcatatttgatagaaaagaaaatcggtctattggaaaaagtaatatcattacttcttcagcggctttctgatccatgttgctcatcagaagtcattgtcgttatttctacattcttctggttaggatcaaataacatttattttcgaagattgaaggcatttgcagttactcgagttcagagatttgtccaggtttcttttatgatctcattagtttatcttagtctcaggaaatatgtatggaggtctagtatttccccttaaaataatttggattcttttgtcaactttggacaagctaatgtttttatttggatttaactgatatgatcaaagtgctgtatgccctcttcctggctcattttttacaaataaaaaatattccatccgttttatattataagtcgtttttatttttttaaatcaaatttctttaagtttaaccaagtttattctagaaaactatagcaacaattatagcaccaaattagttttattatatctaacatgaaacatatttggataaattctttgttttgcgttgaaaaaatattactatatttttatttataaatttggtctaatctaaagaagtttgatttataaaaaaaaatcaaaacgacttataatacgaaatgaaggtaatactgtctcttgttgcaatgaggaggttatctttcgatcttctctaaatgaactaagcgatcacagctctaaattttagatgggacggagacgaagatgctcgataaaaataaccgaacaaacacatatagtagcatattaatattaagcacaaaagaacatcaaaaataaaaaaatagagtataattcccgagtcaccaaaccctagctacgagagccaagataggcttatatacacgagcaaaacagttctgtttttgctcatccggttgagcttgtacttcagagcctttgctgctgatcctggtctccgaatcttagcaggccttactggacacactctgcacaagagaaaactctgtttaggaaggtgattgcaaggtaaagattagacgaaaaacattcactgctggggcgtggatggatcccagtgatacaaaatgtgtgtttcctaatgttcaaatgttcagagacggtttttttttttggatagagaggttagttatgtcatcacctgcagcctcctccatcatcagccatgatcatgtggagcagctcaagagcttcttggcttctgttctcatcacacagccccctgagaagaatattgtaggagaagacattggtatgcaaccgagctcgatcattctgcagagcactatgtctattgcgtcgttcgtcctcttgtcggcacagaggcccttgagaagaggattaatggtgatggcttccactctaaatcccttcttgacgacattgcccaaggccgcgaaaccgaggtccaagcggcccgcacggcagcagcagccgatgaggatgccataggtgtgcacggtgggaggagttaccttgccggcgccggctcgggccatgcggttgaagcgggacacagcggccgcggggatgtagcgcgcgacgtcggcgagagcgagcgccgttcaagctgtacatcgaggcgccgctgccttgccggagcaattcgtcgaacacgtggcgtgcgtcctcggcgccaccgccacagactgcaccctccgagcgaggggtcgcgcccacggagcgagggccgccggcggagcgcgctcggctcgagtgggtacgcggcgtgccatggcgcagcctgaaggacatgagtcagcggcagcaaccggcggcagcgctgagtttactcacaccaggaaggagtcggagggaggcaaggaaggaagggaggagctaaccagcgcgcgaaggaatggcgtatgccggtcttgtgttcgcgatggcctccgccgccggcggcgacggcggcggcggcggcgggatgcggtgctgtgtgttttggcttcgcgttttgcgcagagcaatttggatggcaatttcacttgcaaaattatgtttaacggaaaaggttattcttcaaaactttaacctccaatacttcgtaatgcgtaagattacttctcaatccaaatcactgcaactatgtcctgttctaatttgatttgatttgatatttttaagattacactttgatagtggtttcgatatatcgctgaaaaaaaagaaatattttttcttgcagtgaaagcagaggtgcagtgaagtaaccactcctgtcaatggtgattcagcgattcttgcaaaatagtcagtttaaatgttactttgctctgaaaatttagacaaacattcttcctgttacagattgaaaacaggttatcttcatgtttcaatccagctgacacattttttacttgcacaacttcctggttcatagaagtgtatctggcaacgttcaaaacttcaaattatcgaagtactggagtaccttccgttaatttctgggcactgtactttagccatatttgtaatttttcacacaaaagcatccgggaaattaaagattttcttctggttaacttcctaaaagtttgttaaatcgtgcacttgcatacctgcacttattttcattgaagaaacattactgcaactgttatgtacatatagctgtatatctgttttcaaattataccaaactttcaactcagcaagtactttgcatattcaacacaatttctttagacccttcactccaagaaaaacataagcaagagatgatacacatccatctcccttccttactagcaagagagaaaaaaaatgatggtaaaaacccaactagaaattgtaaaaactcatcaaacaaccaggtcaaaagtggtcaaaactcctggtttgtgagccatggtacattggtacataacccacatcaaattcatgtactagagtacctgacttcctttttcttggagtgtgggatgacgattttcggagcatcaacgtgcatttccagagagttgaactccagagccaagataggcttagataacaagaccataacggtatgtttttgcgcatccggttcagctaatacttccgagcctttgctgctgatcttgccatcaggacactcctgtggttcagtaattcttggtctccaaatcttagcaggccttaccgggcgcactctgcacaagagaagactgtttaggaaggtgattgccaggtaaaaatattagaactacagactctagaacaacaacaatgtatttgcttggacataatgcaacaattgtgaaaaaattcactgctggggcatggatggatcacgttcacaggtatataaaacgtgtgtttgatgatgtctagagaggttaggtatgtcatcacctgcattccacttggcaagagtacttgagaagatcaggatggtcctctatctgtccactgaaattcacagtgcatgtcatgttcggttttgagctattcgataaaaggtctctattttcagaaaaaaaaattgtcgctgtaaagaacaccacatatggctacttcagagagtggaggctttggcagttttcttttggaaaacacaaataccctccacttggttttgacctaacctgaagcttggaagagacattctgattgctggacccatccacttgtgtttatgcgaccctgttgacacttttgcatgattagaaagtgaaagaaagcattgaatcaacaaagtgaagctttagtaacttccatttttgagacataaggttaggcagttgctatcctatggccgtgtacacccttgttggtgtagaggccggattttaatccattatccaaaaaaagggagttgctatcctaaagacattttggaattccacatgatatccatttcacaattagaaccctggaaatgaagaatgaagtcatttgacgaatagtagtatgaagaaggtttactaatatagaatttggtagctctaaataagatgcagacttttaaacccaggcagttttagcgaaaagaactaaaggagagtaaggtttttttttttaactccaacagataattcagtcattcagtaaaaaagatcatgcttgttgatgcattaagcagataagtttcaactcaccagtaagcggtacactaatgttgcacaaatgtcttgtacaagagcccttggtctctgagatctcgatctcacggtcattcccttggttggagacagttgagcgcattccaagcaagctcaggaagctgtttgatttaaccaatggcttgtttctaagcgcatcagcttcagtctagcacattcgaacaatgtccaagcaatataaaaagttgtagacggcaaacatttgacaaacctaatcatgcaagtactctaaacatttgacaaaccttatttcccaagtacctgtgagaatgtagcaacatggcttgggagacctacttcctacaggaatgacaatggcactgatcagggtaataatatcaatgcaaatggacatagcatcacaaacaaaccagagaggggatcccggtgtcaccttgcgaccatgccggcaggcttcggcactgttcaccagcactctagcagcccacctgtgaacgaattcagagacttcagaccaaaccagcagagcacacaagaacttttgatcaaataattagatagcatcacaacccatcacacacactcatgtcaagcatcaaccaccaagcaactcatcttaggcatcccccttgggtatggacatctgaaacaaagttcagaaaagtagcaagtttgcaaattttatccatttttcagctgtctgaaaaacccacacttcccacatgcacatattccttcccaataaaaattgtcatcttttttttttcctgcaacttggccgtaccatacggagcaagtacaggggaatcgaatcgaatcatgcaaacacccaataattaaaagggtgcagcaaaaggagagcccatatgcaaagccctgtgctcaagtacaatcaacactaatcaagacgcgtttttttattggcttttttgagggactcgatcactcgaacctgccgcaatgcaaagctcggggattattttccccctaatctaatgcaacttggccaagaactccacccaatcaggcaagggcaaaagcactagcggtggactcgattaaactaggccaaaaagacgcagcaatctcggcgactcacgcgcaggaggtcggcgggttccacacgatgccggcgatcaccacgagctgcaaggagagacagcgagaaatccgatcaagaaattaacggagcgagagagggacagatcgccggagaaggagaaggcgagacgagacctcgtcgaacttgccggcggggctgtcgtcgtagcgggcgaggaacatgccgccgagggtgtagccgaaggcctccacgaggcggagctccctgggcacgaacgcccgcgccgtcgccgccttcaccaaatgcagctggtacaatgccctgccatagttgccattgcccccaaccatcaaatcaagaatcaatcaaacggaggatgagatcgcgatagagagagccttgcttgcctgcccctgaacacccatggcggcccgcgcccgtaccctgcagcagcagcagcctcctctctgccactgccagccgccatggatggccactgactcaacacacttcctcggctgcctctgcaagaatgcagctactgctactactagtctactaccaccaccaagaaaggcacagtgggggagtggattgcaataataaaatagtagatgcaaggaaggagatggatggatcgggaaggaggagaaggtgatgaatgatgatgcactgcctgatgctgggatgcaagattgcaaaggtaaggagttgtttaaacaagtttttttattcttcttctttttttttttttttttggtttgatggtttgtgcaaggagatcccaaaaccttatccggtgtacagggagcacacgcggcaatagtttagaggatgggggatccgtgagggccccatccatggctttgtgataatccatggtgttttaacttcgattgactctcgtatagcacttaggctgtgtttaattcgtgtgcaaaaatttttttaaggatatggacacacatttgaagtattaaatgtaaactaatactaaaacaaattacagattacgcctgtaaattgcgagatgaatttattaagcctaactaatctatcattagcaaatgtttactgtagcatcgcattgtcaaatcatagcgtaattagtcttaaaagattcgtcttgtgatttacatgcaaattgtgtaattgattttttttttcatatttaatgctccatgtatgtgtccaaacatttgatgtgacggaaaagttggaagtttgaagaaaaaattttgaatctaaacacggccttactccatcaattccaaaatagatgtcgttgtgacgttttgatttttcttttcttgcaatatttgaccattcatcttatttagaaaaattagtgcaaatataaaaatataagtcataagacacaaacaaaacaaataataattccctaatcttttgaataagacgaatgatcaaatattacgaaaaaaacttaaaacgacaagtatattgggatggaggtagcactagttgttgacttttaagacaaacaaatttgaattgtataactttttaagatgattttggagtttttttctttagagtctattttacaacattatcttttaaattgctaataactcgatataaaagataccaataaattaactatgatagcttctttcatcgttacctggcttatcagcatagctaaaatgatcggctcctttgaaaacacagcaatacaggaaatacactaatatgacatgaattcatgtactacctcggtggacaaatataagtactccaagcgattgaattttttggctttatacatctggttggatgtagagtccgggtttactcgttttctaaaaaaaggattgaaatttgtctacaaatataatattctaaagtacctatcattcaaatttatttttatcttattcctatcaccagtcaaaggataattttccaatgcttttcctctactccttttcttttcataaacttgttaactagtaaaaatttcaaaacgtcttctaatatgaaatggaaggagcatttgcgccttgccagtaggggtggaaaaaaaagcttgggctcgtgagctcagctcgggcttggctcgagctcgcttagctcggctcggcatgaatgccaaacgagccaagcccaagcctccttttcaactcgtttctgaaatgagccgagcctgatttggctcgtgagcctaggccatcatgtatctatatggatgattttattttctagtggagttattatttgttaatatataatttattatctatattttgatgaattgaatatataaagttattttaattttacatgttgatgatttgttattgcttttcttaatgattacaaattatatagcttcaacggaaggctcacaagccagcttgagctggctcgagccaggaaacgagctgagccgagctcatgttttagctcgtttccctaaccgagccgagccaaaccaagcctagcttgttgcgagccatggcaagccgagccaagccattggctcatttccacccctacttgccagaacgtttctgaagaaaaaaatgtatcgcaacgtatagcaaaatactagagtcagattgtctgatttcccggggacaaaatcacaggtaaacagcagcacacactcaaaaagatagtgagagagaaccacaaatactgtaaagcaagcactattattagcgtggaagttactgttttagggccactctacaatcatactgcctgtagtatactattatcctgttccatttatcctctgttggacggttttgcttctcttgaattgcctctttgcagatcaactcataataatccaaatccaaaacaatctttgcagatcaactcataataatccaaatccaaaacaaccagcatgtttttgcaaacgagaggcaggtctcaattggcgggagcacgagcacttcctgacaagaaataaatttgtaaatgttttatgacttcggcagaatattcattctccctcggtgcagcaggccaagaagatgttccctgcaaattcatgaaaagtccaaggaaaaatagaagtaggattagcattttaacaaacaaatttcaggggatggttccatgctagaacaatagtaccaaataagtatccctttcctcacaaaaaaaagtattcctttcaatctcctaatgctgagggaaagctttagaaattcttcaacacaatactttttccttacccaaaaaaaagagaaaaatatgtatgacgataagaatcttttttctttccagacccaacaaaacatggccgaaggagcttgcacaaccattgataatttcatcagaagttcagaacctttgcaacaacccttgttctataggatttacagttattatctgtcgctcaaagcaccaggtgctaaaaaccattggcccagattatagaagctagcaaatcatgctgtcatgctttctgccatgtttaagcaaggtagctatcatgatactgcagtcccagaatcaatctcaaaaccagttgagcacaggttgaggttgccaattgtcaaacatctggagcacttcatgaacactagtatctagtagtattattctttttttacaaagttcttctagaataactctgtacatgacgatatccagttaattcctaaagcagcaaatatctggtactcttcatctttgtagccaccgagccagttgtgagaccaaattggggattaaaaattggtgcgagcagcttagacagttcaccttacagtgtaatgttttttattttttccctttttttttgttttttcccctccaacctaatgttcacaatgcaaccttgtcttccacaatttccattaatgagatggctacaaggtagagccacctctacctttttacgtcaaaaatagtcagtttagtacaaaaagcatttcttcatcaaacatttcaagtttaccatatgcacatagtattaatatgttggagatatgatgatccagtagaatatcattttatacaacaagatcttgttccacaatgtttttttttggataattaaatactgcatttgttgaataacaatacttctatcatttcttcagtgcggagaaaggcaaactagtatagacccaacagtattcataattgaactcatgaaaccctcttgattgaaaccttgctatttatgcatacagagaaaagaaccctccactagcaggattgtagcagacaagaattccaattcagaatttcgtagctgcaaaaatcttcagcggttccaatattctataaatacttgtacttttcaggggaaaacctatgatattcttggtgtttgcctccagaaaaaaagatctataaaacagggaaacagaccatgctttgagagagaagtgcttatcatcagtcatggagaggtaagcaccagctctgcttagtgcacctctgtgaaacagtctgctaactatgctatttatcatacaggggaatctttgtcactgcaagtttagcagataataaattagttctaacaaagctacaaaaagtagcaaaattagagaactataatatcatctgggaatttttcttcgaagggaatcagatatagtgtgacaaaaaaaagggcagtttgtacctagcaatccacatgtaacagataaaggtgatccccaaacatagagtggtccagaatttcttgtttgtattactaattcagtgagaaggccaacaatagccagttacaactgcataactgtaggccatttcaaacaggatggatttcacttcagagcaaaacttttcagggagaaattccgtatgtttgattgaatttcctgcttgaaatcagcaaaatcagcaaatcaacagtcgaagcttcaacggggaggttattttgatcaattttggacatgtaaaccccagcactgcctagtgcctacttcccctttttgaagtaactttgtaactctgcaatttagcatgcaggagtcgacacagtactacagtcattgtcctccattgaaagaaatagatcatccaattcttctagcaacccctgttctataagatcttttttgccacttttgataatctgtacatagaattcttttgcagtagcagttcttcctgtacgaaataaaccttgcagcattatgttatatgtgataaaattaggactaacaccattgctcaccatctcttggaaaagtgctaaagcattctccatcctagtaattttacagtagccattaatcaaagtgctatacgtaacacaattaggtttcaatccttgctgcctcattttgctaaatacaagcatggcctcatctacttttccttgcttggcggatgcatatattagtgtgttgaagacataatgatcgggttgcatatcactttgtaccatcaaatcaaagagaccatgcatctcaacaagagctccttcgatagcatacccatgaagtaagctactgtaggtagtaatatcaggctttaggcccctcttgaccatagaatcaaaaatctttctagcttctgtgcatcttccgttcttgcagagatagtccataaacgagctataagtaacaacatttggttcaacaccattgctgcacatcttttctagaaatttaatagcctctgtcaactgccctgaagagcaaaatccatgcacaagactagtatacgtgaagcaattgggtgtaactccattcttaaccatcctatcgtgtacctccatggccttgtccattgcttgacccttgcatagggcagcaataatggagctgtaaatcacaacatttggcaaaatcctccggtcaagcatttcacggtatgtagcgtaggctttgtccggatcccctcctttcaagaggccatcgatgacggtgctgtatgacacaacattaggtaagcagcctcctccatcatcagccatcatgtggagcagctcgagagcttcttggcttctgttctcatgacagagtcccttgagaataatggtgtgggagaagacatttggcacgcagctgagctcggtcattccacggagcactatgtccattgcgtcgtccgtcctcttgtctgcacagaggcccttgagcagaggattaaagatgatgggttccactctgaatcccttcttaacgacatggcccaaggccgcgaaaccgaggtctaagcggcccgcactgcagcagcagccgatgaggatgccataggtgtgcacggtgggagttaccatgctggcaccagctcgtgccatgcggttgaagcgggacacagcggccgcggggttgtcgcgcgcgacgtcggcgagagcgccgttcaagctgcggatcggagcgccgatgcctcgccggagcaattcgtcgaacacgtcgagtgcgtcctcggcgccaccgctcccaacgcgtgctcggtcttggatcgtaccctccgagcgcgggacgccgccggcgcgggcgcgggcgcgggcagcgacgcggcgtgccatgtccggcctgacggacgggcaaggaaaggtggaaacctgcggcagcgctgaataaatcaccccgtggtttactaggaaactaggaaccagaggcaaaggaaggtggaactaaccagcgcgcgaaggaatggcgaacggatcagctgctggcggcggcggaggggcggcctcgacggcgacggccgacgagcgcggctgcacgggtgcgtccgttcgagcagttggcttcgcgaaaggcgcgggaagaagacgacgagaagagatcaatcagatcagcgtcttatttgttctttttttttttcttttttcggtttcacatacatcttgcttcaacgagtattacttgatttggggttactcttttttttttctatatgggaagcatgtttttatattccttaagttactttttttttctagctacgagtggcatgtttttacttgttttttttatactgcaaatatttccaactttctttgttgctaatgtggcataataatatttcacttgcaaaattttctcaattttttcatagactaaaaaaatgcccgtgcattacaatgggtaaagtctattttaatcttgttattattatatggtttagttaaaatgaaattcactatggagttcgcttggatatatatttttttataaaatcatgagctgcagttagaagtccgatcgtttaagttagcatgcgagttttttttaaacagatttcttatatgattctttctgtattgccaaaagtgaacaatgttaaaaaccgactcaaatacggatatgtatttctaaaagcaaacgaatttaaaaaccgtctcgtacccggatgacgtacgaaaataccagtaaaaatattttcaatttttataatagtagagaaaaatgatgccaacgagaatgtcactcttcggtctctctgcttcctatccctactcatcaatccaaattactgcatctccgtcgtgttttagtttctttttaaaatattccactttgatcacttgtttctcacaaaacatgtcctcaactattctaaactgaatcacaatttagaatttttcactacagcatgaaaactcaaatgcttatttatttggaaggcatatccaaaaagtctcagtttgttcatcagcaccaggccaaggcagagacaaatacttcagagttcagagttcaaaacgcttcaaaacaaacactccaaaatgttttcagaacaaggatgcaggcatgcacaacgatccatcgatcgatcgccgcaacagaaaaaaaaaaaagaactctttcttggcgtcgccgcggcagcggccttcactgcagctgctcgcggaacaccgtgagcacgtcggcgaacgtgacgatcccggcgaggcggcagtcgtcgtcctcgtcgagcacccacaggtagctggcgcggtgggcgagcgcctgcatcatcacggccaccagcgagctcgccgggctgcacaccaccggctcctccgtcgagcggcgcccgtagctccccgacgacggccgcctcagccgcgcggcgcggccgtgggcctcgtcgtcggaggacgacgaggtggaggaggaggagaacgcgaaggaggacaccgcctcgttctccaccagctcgagcatggcgtcgaggcccttgctcttcagcccggccttgaccgcgcgaaggatgtgctccggcggcgcgccgaagtagtcgacgtacgccatgaggtcggccaccgacagcgtcgcgatggccgcggccgccgtctcgtcgcaggacgcgaggagcgcgggggagatctcgccgacgaggtggccgccgtcgtcgacgacggcgaccgcggtctccgtggcgatggcgcggcggaggaggggcacggcggacagggctgcctcgtggggccgcaccgtgaggaggtcgtcggcgcgcacgaggccgagggaggagacggagcggccggcgacatgggagaagagggagatggagttgaggaagtagcggacgaggtcctcctgcgtcaaccagcagtagtcgccgccgccgccgccaccgccgccgccgccgagctgcttcctccggccgccggagcggagagggacggcgagcacctgcgcgccgctcaagacggcatcaagcgcctccaacacactgcaaagaacaacaccacattgattaattaaaaaatcacagtaattatactagtcaaagatttagttcatcaagatcctactattatccccaaataaaatttctaagatccaagtattattgcgccatctttgaaccacacaacgacgaaagaacagggaaaagatctcctggacttggtacgaggcgagctggaggcagctgaatcctatcaggaatggagcaaaacgacatggatgcaggtctcaatctctggtgcgccacgcagatcgccaccacaagattgtcccgatgagtcggacgatttgacccggatcgggcgcctttttctaaaccaagattacagccacttgttccaaacgccttcgtgttcgcatattccaatcggggatcaaaatttcaagtgctagtcactttgatcaaggaatatccgggatcaactgaatgtctcgtctttttctcacaaatcgcctcaatagtcaaagatcacagttttcttaactcgaaaaagtaaaatgtcatcatttaataatcgttttattccccaaactattatagaattttaatttttaccactaactcgtactagaaaaataccataaagatctacatcgtttattcattttattagagcaaataggaaagcatttgcgtatcctttaagcatctcaaccattttttaatcgaagattttagcggggattttggcctaaatcgcgttctttgcaacctaaacaacaacaaaatcatcaaagacgcgtcgtgtcccaaaaatctaaaaacaaatcggaacagggcgaaaagtgaagcgggggattttttttctttttacctggcgcgggggtcgacgcggcggacctcgccggcgccgtccttggggaggagcgcggaggcgggcttggagagcgcggcggtggggtgggcgagcgcgcccggcgcggcgcagaggaagcagagcacgtcggcgagcccgagcctccccgcgacggcgcgcccggggccgacgacggcgacgcacgcggccgcccctcccgctgcctgctgcggtcccctcctgagcgccgcggccaggtccccggcggcggcggagagcgggagcgacctcaccgccggcttgccgatgcacaggtccgacacctcattagccagtaggcgcactgccatgcactcgcggggcgaacccttgtcggtttcgagatcgaaaccctcacaaacgatgtcgaggaggaagaagagagacgagacgagacgaggttttttttgcaacggaaatcgcggaggaggaagaagacgagacgagacgggattttttttttgctttttttcgcttccgccgatttggcttggctttaaccgtggagcgggatgggaggcatatatataggctttgggggtggccgctacgcggttgggttcacgcgtggctcgatgacaggtggggcccggttttgtggggaccactcggcagtgggaggtggggggttacacgggtggtttggtttaatggttacccgttgtttttactctgtgctggtttgcgcgcggctcgggcctggtttctagaatcggctcaagccaagccgatctgagctggaaccgtaactccgtgtctccgtgagacggttatgttgtttgcagtttgctttgttttggcattgttcttacagtggtaaataagcgccctccacttcgagatatgatttttttggctctttatatatatatatatatatatatacaaatgtaaaaccaagaaaaataaaatatttttaccttatcaaattccaatggaattattattcattttatatactcatagtacatttagcccctagtttcataaactccggtacaataattacttaaagataaatttattttggaataaatgggatgggttaaaaatgttattatgagatacaggatgacagatcatcgaactaagatttttttagtggacaaactaagattattaaaagcactaaagcagtaaataaatccataatccattgtttacaagagccattatatttgcaaccaagtcacagactcacggtgaaaggaaaaaaaaaaggcaagaagccatgaagtgtgcagcacgaattgccagcaagaatgtcaactgtcaccagcttaacaacgggatgttgtgaaaaacgttgggaagttaattgtgcttactaaaagaactttgacctaatggtgtatgattatcttcttcactatcatgcaatgggtgcaatgctagctgcttcagaggggaagaatatatttcacaatagatgtatggaacatatagatccaatgctagctgtaacttgacaatatgataaatccaattgtgcctccagagttggtacacaggtcagaggagattcaattggaacctgaaaaatagtgcaaatgcatgaactagtaccgaatttgtttttaaaaaaaaaaacagaacaggagtaaccgccatgtgggatcattttgtaattatggtagatctcagatttgttttactaaacttttaattttgtcttgtttggttggctcgctcagccgccaccgctgatgtgctgaacaacactttggtcgaaacaggcagcagcaaagaggtttctgctcggtttaggctacgctttttgaccattccgtttgaccacttgcttcggtttccagcttggcggtagtagcatgctgggttttcttttatagtttttaaatggttattttgcaaacgtgtttccaaaaccaaattcttgtcacatcaatattgcttgcgcaatattttgactaagtattattttcatattttggacatttagaattcagtttgaccaaagtaggacaacaaccattatatatttttgtccgttcataccacatgatcattttcctctatctttacaaacctagtggatatttcggatattaggatagaactgtaaccttttacatgtggaagctttatcagaaatcttttacatgtggaagctttatcagaaatccactaaaacgatgtgctacgaacggaggatgattatggattatccacatgataaattggtatagttttcgtagagtaaagttaactattgtaatataagtccaagcaatcttcattcaagtgttcatccagcctcctcataggctcctagttactactccagtctccatcacgtcttcatgaacttgcattctctattgcccaaatttgacgagatggtttcccaaatttgacaagatggttggtgcagcaccaagtggttagatccatgcgtgacaaggactttctttgaatttttgcaccatttttctaatctaataaactatttcattcgaattttctttctttcattttccagtgtaaccatcatgtttttttagcatcatcttcttcttgttggcttcttccatgaaaagggaacacattaattcataaagatcaaggcagtataactactagctcgttcgttcgtacatgtggttgtaccataaatacgttccatcaagagattgggaggcttggataatcaaccccttttaaagacaaaaatgtgacacatgagctgatcacaacatgaaagcgacaaaaggaaaaaaggttacataaacctactacctccgttccaaaataggtgcagctttctagtttaaattttaactacagtgcggcacctatgttgggacggagagagtatttgattctatcacaaaattattatctttccccaactaaagtctttttccctgtttataattatcgactagttagcaatatctagtgttaaaattgatcgtgaatcacttaattgcaatacataaatggttaatggtattctccaaagcttcccaaatctaatcatttgcacaatggttttgtaggtgttatatgtcttccattaattaatggagaaaatgaaaatactatgcccatctcgtctacataacattcatgacattttcagttctagaaaaaaaaagacgacgctattgttgttgagcctcgcacagttgatcttgttacggctacgtgaacatgcttagcacgtcgattgtctactaactcatctaggaatatacatgtagcaccatactgttatagtggaattgatcaattgaagtacaatctctttggttaatatattgctcttaactgcgctggcaaatcagcattctaacatgtgaaaaacgctctccatttcggtgaggtcatttttaattactcttccggtttagtactatactccagtccagccagagcccgccgccgcagccatctccagaaccttccctgtttgcgcgttaaagcgaaaataaaaagataaacgttacaggtagtagtagtgaaaaggtgggtttcctctcaaccagaaggagccgaaaggcagaaagaaccctggctcgagccgtgaagccgatctgggccgagccggtttggttggcagaagaacgtgtaggcgacgtggcacccggccccaccacgtggacgcatgctgtacgcgtgggcccatgcggaccttccgtgccacggactccgggatcttctgcggccacagccgcgatcaggttgcggccacttcagctgcttctccagctcagctgcagcctgcatgccagattgccaatctgccgctgctgcactgcaatttgtctgatgaaaccttcgctatctgccaccgtgccactgtctgaaccagctggcaaaagagcacaactagtactagtagttcgtacacataacctgatttttcaatgacgagtcatgacaggcagacatggcctgtgtgtgtgtgtcttggggtgtccgtgcacgtagaacacagcttctcgccgtgcgaaaggccacttttagagcaagtgtggaggctgtaaggcccctgtttagatgagactaaaacttttaagtccctatcacatcggatgtttaaaaattaattataaatattaaacgtagactattaataaaacctatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtttatatttaatactctaaattagtgtctaaagacagggactaaagttaagtccctggatgtaaacaccacctaagttagctaaatgctgaggtgcaagagagaagagagagaaggagcaaactataaactaacttacagctggcttaaacataagaaccaaaaaaatcatgtaagagagacaagtggactatatattaattgtaaatagctaattataatatatatgagataagaaaagactgcaaatattacagtcaacaagtctgttatattattagccttgctcttatgagaccgcaacagtagtctgaatctacgtactatcgtgttattattatcttccgatctgaactgaaagaaacccgtcatctacccaacaaaaaatgaactaatctggtggtacgagtgggcgcgcgcgcgcgtgcggtcaaagtgtcaaacacggcaagcaccagttgctgctccctctcgtggactcgcggtctctcgcgcgcgcgccgaagaggaaactccttccacgcgagcgagccgcagtttcccttccccccgtggtgattatccacatccgccaccacgaggcggcgcgagcgacagcggcagcggatgcccttttttccgccgtggcgtcgcgggtgtgatccgctgatgtggcgccgcgcgtcgcggccagagtgcgcggtggcggcgtggcgctcgcatgctgtcacggtcgttggttgctttggctgattcattttcaggtgagcgcgccgcccgtgccaccgtatggtggtggtggtggtacgcgcgcgcgtgatatgtttggctttcgtccgcttcttcggcggcaagccgatggatgcatgggcgcctctcctgttcagcttagctctgcttaccacgtttttatttgacgaatccgcacgaaaaaaaatagttttatcctatagagtagaagtaaaacatatttaaggaaagcaaaaaggaaaaaaaaaaagactatacaagagtctcgaaggacaatatcgcactaggggaacatttccatgagtctcttttccgtagtatttctgttgaaacaatatgtctgtgtaagttatgatataattggaatatgtctgtataagttacaagagcctcagtagcatcttacgtcccaggttcgactccctataggactccaggatggatttacggggtgagtgtgtaattctcaaatgttcgactccctatgagagtccaggatggatttacgggggtgagtgtgtaattctctaaaaaagaaaagttaggatacaattattttttaaagtttggaattttttttatgtttatagagggtaaaaacatatcagttttgaaaacctcataatttacggtaatcgtgattttgcacgataatggtaactcccaccgaaaggtaagaacacctgtgagatatgcctatgggagtgcaggatggatttacggggtgagtgtgtaattctcaaaaaagaaaagttaggatacaattattttttgaagtttggtatttttttatgtttatggagggtaaaatcatgattttacccgataatggtagtaactcccataagaacacccgtgagatatggctagctgtcctggtgaagtgggtggaggatattgggagaagcaggagagtttgttggatcgggagaacgggggcgatccctaattccctatagttcctactgctgttatcggatttttcccaatatgctgctgtaagcctgtaacgagctggcttaggcgattagctacctgattttgtccttttgttcgagtaagtttacgtagacgtggttaatccatgaaaccacacctacgaacggacaggtggaccacatgcacgtagcgctgtcagtggttcacgcccgtttggaccggtataatttacagaggaggatcggattaattatttacagaagttactctggttccaattaaattttacaaaaatcaccggaggagagatcgatgagaaaattgctacgcatttgatccaattgtccggctcatatacgattaagtttgatcaatgactaccgtgcatataaacatctacttaattaattgatctccgtttgagcaaaggccataatattttatttcattataaaaaaaattaattgatttttttacgctttagttatacattagttttacaactaaactatgtataaaggttagtgctttgttgttgagtatcacccaatttagttgcacgatccgactaaaggcatacaaccatggatcaataaagattcttttgaaacataagatctgtgaagaaatttgtaggatttaaatgatcgtatatataggatttaaataatcaatagtaacaccaatgggagaacggacttgtctaacatggataggtaactactcagccaaaacagccaggaacaaccaccctgcaaacaccatggcagcaaattaaaactcgtgtggtccgatcctttggccgattcaagcaccggaagaataattgcttcaggatcaggagacaaagccacggcactgctgcactgatgcacagtgccatactgccattgccatgcatgtcagctgctactcactttgttggcacgcggccggcgagaaaaagatcccgtcccgatacagagaagaagaggaccgatacagagaagaagaggacgggttggctcccgtacgaacgaacgtagtactacgtggtggtctcccggcctccgaaatggttggcacgcagcagtgctgccttgggcggtgacatgacagccgctgcaagccacgatccctcacatggaacgcgacaggtggtgaaaccatgtagtaccagctgatgcatatctgaaggactcagctacagcctagtgcaggatatgcatgctggctgtgaggctgtgtttatttcatgccaaaatttgaagttgggttaaaattagaacgatgtgacggagaagttgaaagtttgtgtgtaggaaagttttggtgtgatgaaaaagttaaaagtttaaaaaaaaactttggatctaaacacggccgagtgaagtgagtgaagagagtggtgtggttgttggtgccgtttggattttttttttgtgagtgtgaggatgcatgcaaatgcaatgcagcaatggaaatggaatctgtagctctcctactaactgccaagagagagaggggtgtggtgtgtggtcctagatagctttggtgtaggacagtacaaggagtacaatgcatgttgctaccatgttgccctctgccactgtttgtttcggttttgcaatgattgaatggttgagcaatgggggcagttatatagggcgtgattgatccagatgctcgcttatcatatctctctaatggtaggagtagtactttattatctttgtcatggaggaaacgaaccaaccatgacgcggtcaagggcatcgtatgttttctattcgacgagacgatgccggccggcaaatctccgtttcttgggatgccatcgcccatcgctgggttacactgttttttccccctctactgtgaacccatacctctcctgcgtacgatcgcgccgtgctgtcgcgtatggcaaaccatcctgagacggccgcacgcgtgcagactgagatcatgtcacttaagtcacccgactttagagccactaaggcaatgtatgagaaatgtccatgggtttttcggctatctttacaaggtggtgggctagatgatctgggttctgagccttactccttctaattatttgatattaggcccttccctaatattcgagttttttactaaggcaatgtataacgctccactctgccctgtggtctcacggcttcacgtcggagccaagctgagctggcagtcgagctcgtggttccgtaggccggagcggttcttgcagagggaacggttgaagcgccggcctaggatcgggagccgcgaagccacgactcgaggactttgcgatggatgagcccggagcccagtgcatcacatcgtccggttggtccccccatgcacctaccctaagtccccatctcgtcgtggtcgttgtcgccgctcattgccgccgttgtggtcgcgtcgcctctcaccagatccgccaccaccgctgctccccgttgccaccagatccagcgagctcgtggtcggatctggtgagctcatggtcggatccgccgccgccggtggcccctcaccgttgcgagaagggggtgggaggggagaggccagccgatgcgacgctcgcgaagaagggagggggagaggccggcgagctcgcggctagatcctccatcgccgtggggatctgccattgctcgtgaaagaggaaggggagaggaaccgccgccaccgttgtggctgtgttgccgcttgctggcaaatccgccgccgttgtggcccgcgccgctagatccggcgagcacgaggctggatccgagacgcccaactctctctcatcgccggagagctcgagcgccgctgatcccgtcgctctctgcctcgcctagagtaaaggagagggggatggggagagggactaggagggaaggggtctcatcggcggggttgactgggagaaggagagcgccggtggtctcggtggagaaaaagaacgcgaggatggcgagagggctcgggagagagagagaaagaggggggagacagaggaaataaaaaggaggcggaagagactgacagtgggtccgcatgatgtttaggggtgtatatgtacttcttttggtttataaggtccaaaatataaagttttaatagatttgataataagatacaccataagggctgacatatatatagatgtgggctaaaatgtaaaatacgttttggagtggattccactgtggtttgtgtcatcatctttatgtggttctgtcctatgtgacgtcttgagatcaagatgtctgtgatctctaatgtacatgccctaataggtaggagtaacccataaagaaaactcatatctcagttactcaaaatcgtatgagataggtcagaggatctcggtgccacacttttaccaggtcacaaatctcagggaaaggctcggttggttttgccgggctgggcgccgtgctcgtggtattgtttggtggatcgagacgatgagatgagatgagatggtgaaatcgctggctgggctaaccagctgctggtgccaagggagaaggttaatggggtgggatcgcgagcatcattgcacgcggcaaagacggggagcaccggagcaggtgtgtggaccttggtggtcgtaggcacactgcatgtttccatcgttttctttgaaaggacgggcgatcgatgctgttgcgtgcatgcacttggtaacatgggatgtcagtgatggtgctgctagagtgctagtagtacgaatgtacgacggctttgttatgtttgcaatgaaaaaacattaactgtttcgtcttttaaatctttttaagaaaacattactagaacgaggaatctggaatgagcacggatcaggagttcaggactaaccttcgaattttccagaactccctctatcccattttaagtgtccaactttaatcatctgtcttcctcttatttaattttttttaattagtattttttattgttatgagatgataaaatatgaatagtactttatatgtgacttatgatttttaaaattttcaaataagacgaacaattaaaattgtgcacaggaaatcatggttacacttaaagggcactatacttaattgccgtacgcctcttgcatgtgtaggtctcgacgagtaataatttagtgtcacactcaggcgcgcctaaagcgtgttcttatacgattgtccttccgctaactgcatccaatattttctatcttgctcctcaatcagccacgtcactgcaaacgcaatcgatccattggtctgagtttggccatatagctcaatgctcctcccatcaaactggccactatttgtcctcttcatgacttcgacaggtctgatgtaattcttatcgattgaacttcagataaagataaatagaaaaagtggagtaatagaatgtttacacacatcaattcatatgaatttttccaaaaggtttaagtggataaaaaaattcctatgttttctctatataactcataggaaaaaaattcctttaatttttctatacttcaattctacaaaccaaatgatactcaaaagaattaatccttagaaatccaaattctttgtttttaaaacaaacaagcacttagggcagttctaactcacaatgtccataagtagtgtctatggtgccatgtcaataagacatcataataaaaactacactccacaatccatgatttcttaaagtgggtcattaataaatacatcatctctcttctctaccaatcatatctattcttcatctattatgaagacactattatctcccaatgcaaaacttgatagtgtctagcgcataggttctcatgttgaagctgggtcttgcatgagacctagtttttccctctcttcactctctctctctctctcttaattaatatagtgccacataagctaaaaatactacatggcaatgtagttaatgccatagaaaccatcttagatggagggttgacactgtccttaggattttagattgtttggaagggtattaatttttcttcaacataaccatgtctggtagcactaactaaatcatgtatagccccaataccgatagtagaggttcgagcccccgcttatggtaaatccaccaccagtactaataaagaaacagttgctcatgcattgcaggcagaggaacagctgcggtaacgcacattaactccatgtaaaatgcagtgccgttagtaactaatctcaaaagcaacaggtttgacactttgacggcagtttagcttcaatacatcttcttggaaattaataccccgagcatgtttggataatggagaataggggatgggattagaattgaaaaatgaatgaaggattaagattaaatggaaaaggaagaataaatggttaggatttaaagatgtatttcgattggtgagaaattattttccatatccattagcccaacgctgcccgagtgtgatatgaagcaaagccatggcactttctgcaaaatcacaccaagccattctctcgagcacacgatccgagccgcttgtgtcttatccaacggtcagaaaacacccatgaaggattcggatattcttctccgaaccccgaggcgcagtacggaataccccgacgtgattcggagttttcgggcctgtttggttgctgccctcgtgttcgtgcctgacctgagatgcttgcctgagacatgcctgtaccttgtttggttggcgtcctagccgctttgattagcctggctcaggcgacgaaattccaacgcctgactcaggcaagtgagaagctagcaagattaaggtgatgtgaaagctatgggtcccactattaattacattctttttctttttcttgcttttttcattcttcccaccgattgatcatgtttgttgagttaatatcatctgttaagagcaattattacagtttgacgttgcattattcttctcaggcacatggtttaaaccaaacaactcatctcacaggctgcctggtcaggcaaatgtcttcaaactttcaggctagcttcaggcatgagttttcatcaggcatgtgtgtcaggtcaccaaccaaacaggcccttcttctctgacccttccccaggaggttctgctcgtaaatagaacccaaaatgagggttccttttgcactagcaaatcttcagtaagaaccttctcttctctgatgaactagcaatcttcagtaagaactagcaagcatagctgatcatatctgagaggcactcgatcgcttgcttcgttttattatgataaatatgctctgatgaaatattttcggtaagttcaggaggatatgttagcttaacttggcactgttaagtttttcgaagtcctgtacttgaacaaatgtgtcctgtcaaaatttggacgagcatctcaaattttcaagcatagaagaatttattttcagaatgaaatgaagtatcacagaggcgtcagttcttaacaacattgtgctagtacaaaatttgcagatcaatgccaagcgtttctgaagtagtagaaacaatagatttttcaggtcaccttgaaagtagtactactagttgaaactaaaagcagagacattataacagcatgcagaattaacacttcgctgcattactgaattcactttaactgaagtttaacaacataactccccgcaaaaaaaaaagaaaagaaaagaaaagaagaagttcaacagcagataatcacagtagagtaatctcagaaaatatggaaccaacagaccatacatatcaatggaagcgccatagttgtcagtctatcaaaggctcacagcaaagctgaagctcaggagctcaacatactctgtcatggtcttagctgttgtatccattcttccattcctccagaagtgtcacattcagcgtgtgtaagttgcgcgattgttactggacagcgaagtctattagtcaccgtcaagctggattcacaatttcgttttggggtaaaaataatgcgagcctagtaagatgtcgaatttcgagtgaaattcatgaaagttgctgaaactttacaagaaccaagcgctttgagagacctctaagatttgggcgacaaaattcgagcgaaaattgtgaaaccatggcgtcaaaccaaccacacgagcaaccataacagtggaacctcagttcacatctcaaaagcaacgagaaagcttgtgcctgtgtttgcaccaaagcattcattccttccttcaaatacaactttattgtaaactgttccaaggaaacaggggcccaaaggccaaaggccaaagcccaacagtactcacagtgcacaaaagccacgaccaacaaaacaacgcaaaaccgcccgtgctctctcagaaaaagccagcagccaacaaacatgactccgttagctcttgtttagtaccacctcggctattcagccagctccacaccagcttaaatactcactcctcacctgctgactcgccgagccaggtagcgttggcttgtcacccgagcgggggcaataaggtggtgttggatgcctggtcgtttgcgcttggggtctgcgcctgtggtttgcactatgcggcccgcccgttccaagttgcgtagcgtgtgtggggcgcctgggcgaaggctcgagcgtccctgcacctagagtggcgggtattgcgtgaggctggtttcacagagcagcgagtaccgcccgcttccaacggtggaaggataacgggccgctgcagccctggcccgcttccggcccaagtgccttccatggcagaccaccacctttttttttagaaaaaagtacaccaaaggtcaaaggtccctcaacttgtcatcgagttacaaaattattcctcgaccacgaaaccagatataccacatcctttaactttgtaaaactgttcactttttttttagaaaaaagtacaccaaaggtcaaaggtccctcaacttgtcatcgagttacaaaattattcctcgaccacgaaaccagatataccacatcctttaactttgtaaaactgttcactttaggtcctttgcggcctgtttagttagagggagttggtgatggggaatgagatatatgggagtttaagtctgtagtttggttggaaaacttgggaattctagagggtttaggatggggaattaaaaggtcgaattcccaccaatctcttacttgggggaggcctgttaattcgtacaccaaaggtcaaaggtccctcaacttgtcatcgagttacaaaattattcctcgaccacgaaaccagatataccacatcctttaactttgtaaaactgttcactttaggtcctttgcggcctgtttagttagagggagttggtgatggggaatgagatatatgggagtttaagtctgtagtttggttggaaaacttgggaattcgagagggtttgggatggggaattaaaaggtcgaattcccaccaatctcttacttgggggaggcctgttaattcgtacaccaaaggtcaaaggtccctcaacttgtcatcgagttacaaaattattcctcaaccacgaaaccagatataccacatcctttaactttgtaaaactgttcactttaggtcctttgcggcctgtttagttagagggagttggtgatggggaatgagatatatgggagtttaagtctgtaatttggttggaaaacttgggaattcgagagggtttgggatggggaattaaaaggtcgaattcccaccaatctcttacttgggggaggcctgttaattcgtgagacttggagggaattcgatgtgaaaccaaacaagggatgaggactacaaatataactcccatgaccaattccaccatcaactccctccttaaaactcccattcctcttcccttctcttgccaaacagaccattggtggttttgtggccggttttctctaacgtggcagctgagtcaagatggaaccgagtcaagatggaacccacgtgtcaggtgaccacgtcatcttctctccctccctctctctatctcatttttctcctcagtctgggcaagccggctggcgacggcgacgacgtgggagcaggagggccgccccccacgccaccgccgccgccgacggtgcgggcgccatatttgcggccatggatgacgacggtggactcttgctctccccgccggctcctcttccaccgtgctctgcaacgacggcgcctcgggcgccggcgacgaagccgctgcccgttcgatctgaacctgctggcctcatccccgtcggccgccgccgaagccaacgagatggattggcgctgcgatatgctgctccacctctagcctgcacatcaccaaacgacagtagcaatcgccggcgaactctagcctcgacgacgacgacgacgatcaaccagcaaacagcaagaatcggcgaactggtactgggttgctgcgctccaatccaaccataaccattgctgctgctactgctactgcgaagaagctctacgaaccccattgctgctgctgcttattgaaattccatctaattaattaactatgtgggaagagaaagtttaaaaggaaatcgcaaacaagaaaaactgatagtgtggactcccatcagttgctaaccacacatcaagattacagtttgaagagttgtgtcttctgttcagcttcagtacttccaagcaactgcgacagtgagccaaatgcataaacaccttgatctgatcatcaacagatggaaaagacaccagatctatttgctattatcatcacacacagtacatctgaatgttacttttgaacgatgtacagatgcatccatggacacaattcgaatgctaggcctcttgtactccaaaggccttccggatttcagctatggctctgttcgctcgcaacatcagatcgaacatcctcggcaaatttgaagtcagatcggcggcggaggtggcggc

SEQ ID NO: 41645 - DNA, 12798 bp, Oryza sativa
  unsure (1)..(12798): unsure at all n locations
ccgcgtaggctcgcccagacggaggagccccacgccgccaccgccgccgcatcggcttgcccagacggaggagagagagagagagagaggaggaagggacagaagaggggaagaggggaaagagaaagagtgatgatatggccacctgacatgtgggtcccacgtgactcagctgccatgtcagagaaaaccgggcacaaaaccaccagaggacctaaagtgaacggttttacaagttgagagatgttttatatctggttttgtggttgagggatgattttataactcgatgacaagttgagggacctttggtgtactttttccttttttttaacacaatttcttttgagtttgattgggttagttttatttactcaatttcttttgagtttcattggatgcctggttaaaaatagtattttcattttggtctggggtatatagatatctttttttttactccatttcttttgagtttcattgggttaggacaaaattagaatttctattttcgtctggggtatatagatattgttttaactttagactaaggttttctttacattattgagccgtagatgcgtcgctgtccgtgcctccttaaaactacacaagtgaaccgctgctatccatgcctactagaaaaactacattcttctagtgaagcacaaaagagggccactgatgtgtactttagtgcggggagagatgtgtactatagcacatgtgagtgaccaatttcggtagagctcgacctagagggatgacggcgcatctaagtttgaactctgacaccacgttgataggcaaaactcaagcacaaggtgctgaatcatgacaagcttggtggaggcacgaaatctagcatggataccgatcaacggttgaagcagtcaagtaggctcaatcttgagcgtgagctccgcatagaaggaagtgtgcctatagggctataaagatagttggtctaaattgcaagaaaggtaatatgacctagtaaaaattagtttaaggtgttctggtcaaaattgaacataggaatatctgtgccgcaagatgcaactctttttttttttctcaaattgctctctcgttcttttcctcaaatcagtctcttttcttccagtttatttctcaaattagtatgaaatgttatcttagttagccaatttattataaatgcacatccgagctgccaacatgcttgcagaatagcaagaaatccatttacacaatttatagctgctaaaatattacttccgcggttgacaaatacttatcaactttgagcattaattttcaaccaatatcaacacgaatatatttgaatgtaagatgttagtaaaatacttctcattacaaatctactgatacgactttgaagctaaataattatgttattttttataaaaataatttttgtcaaaatagtactagacctcaaatgtcaaaatcaaatacagtagtagttactcctatttgtgaacggagcgagtatttaaattgtgagtgagttaaacaaatatccatgtaaaaaaataattacatttttcttcatcaaaattacaacagcttgagaagacatcaaaagcaacgggcaaaaaaaaaaggtgaaaaccgaacgcatttgcactatctgcattgggtccattcatcagttattattccagctaacaaaaaccacatgcccaactccttgacggctgtaccctgtacacacccacgaaacgcaaaacctcccaaaaattcaaattccccccgtcctcgcgaaattaccacatcacccccgccccgtcccaacggtcgaccagatccacccgtccatccaccaccccaccccacgatccagccgttgaaaccatgaacacgagggcagaatcgtccatggaaaagccgcctcccttttaatcccgctcctcctcctcctcccccaccaccaccgccgccgcattcgaaaacctcgtcgccgatctcctcctcctcctcgcgagatcttcgaggcttctctcttcttcgatctcttcgatccccgtggtggtggtgatctggttcgcggcggcggaggagatggcggcgagcaacatcgggatgatggacggggcctacttcgtggggcggaacgagatcctggcgtggatcaacaccaccctgcagctcggcctctccaaggtcgaggaggtaaatcgcgctcttcctcccccttgggttttgattcggttggttgtttgttggatttcttgatgcgcggggcgtggattttttttttctcggttcttgatgtggcgatttgatttgggtgtgggtttcgtgtaggctgcgtcgggggcggtggcgtgccagctgatggacgcggcgcacccgggggcggtgccgatgcacaaggtcaacttcgacgccaagacggagtacgagatgatccagaactacaaagttcttcaggacgtcttcaacaagctcaagatcaccaaggtgcggccggtttctgattcctacccccctaattcttctccccaccgtgagcaaatcttggttccgtacacctatcgtgtagctgatttgggcgcgtttgttcagttcgtgattgacttcagaagggaagggaagtagttttgcacaaataccacagattctagatcccctgctgttgctaattgatactatatgttgtgtgaatctgtagtgtttcatgatctggtgatgatagaaaaaaaaacctgggattgttgcttatattaatcattgctagtactggtactgcgactgtgttcttacaattttcttgtttgctttgctccttattatcgcagcacatcgaagtgaacaagcttaccaagggaaggccccttgacaatctggaattcatgcaatggatgaagcgatactgtgattcggtcaatggaggcttcatgaacaggtaatctgttacatactattctctaacctgtccaatttttgatttgtgagattttgtcaggttcaaaattctgtttgtgacaatttcatttaattgctcgtctaaaaccttatgtattgctgttctttgtgaattgattcacagttacaatgcttctgaaagaagggagagcagcaagggcggcaaagagaccaacagaaggacatcagtgccttctcaggcgccggccaaatcctcatccgccacccacaaagcacaggcatcatctcatggtgccaagaaggccaatgggcatgcgccgaacgcccctccgtcacggagcgcaaagccgtctcccgcaaactccgctggaccagcttatgatgaacaggtgggagaggttttgtgtgatgccatgatcggctggccttttttattctcatgctgctaaagggtgagagactcaatcttgacatcatttgcagatcactgagctgaagctgctcgtcgatagtctcgagaaagaaagagatttctatttctccaagctgagggatgtggagatcttgtgccagagccctgaagtcgagcatttgccggtaaaaccgtagcagaatgccttaacttttgcctgattattgttctacttggtgacaataagactatcctaaaaccgtttgcctgattattgttctacttggtgacaataagactatcctatcctaaaaccgtttgcctgattattgttctacttggtgacaataagactatcctaaaaccggaatactaaaactctaaaaggattgtgaacttgcttttagagttaaccattcagttttcggaaaataaacagtagcactggttcttaggttcttgatgtttattttgttgtcagttagggcgatgctgatcaagaaacttgtttatcttttctttctggagattgtcaacgcgattcataaggtactctacgctgcggaggatgacccctcgatggtggcggaggcgcaggcgatgatatcgcagcagcagcagagtgagcagccgatgctgagcccaatcctggaggcgtcggaggagaggccggcgaagcaggaggcgcacaagaggaagagcatctccgacctggagctggaggagttcggcatggcgtccagctcgaggcagaggctctccgacatctccgacgtgcagctgtgcggatcacctctgacgagcttcacttgaatgaatgactgaatgaatgaagaacacagcaattggggcacaatttgcagctgtgacattggattagtactagattgctctctatatctctttctttcttttgttggatttgtttgttggttttcctttgcgttgtattgttggtggtataatgtgtgtgctattttcttgccttcggatggtggttgtgccacagcatttgtggcacttttgagacaatattattatgcaaatagttcggtgatttatggttatgtttgctctgtttggtggtattggtggtttctttctcacttatcatattgaaggttatcatatattccagcatggaatattatgcaaatagttttgacttatcaaaaactatttgcatggaaagagttgggaatttgttttgagatttctgaaggagttggcaaagtacttgccggaaggttctcaattcctggaagggaaattgaatcaaagacacgccaatctaaagagattgatgattgtctgcaaggaaggatttagagggagatcatataatttaggacataattaactgggacaaaccatacaaatgacacaagacaatttgcttatcttgtttggaacttcacaatgcccgcatctgcattccttggaagaacattcaatctatttccctttttggtaaaaatgtgtctcgttacaatcggatataatcaattgtacaataaacaaaaaatacatcaactagaatacgcttgacgatatgtatatccctttctcagatgatgaaaacatgggggaacatctgtgtctgttttccaatgcagcgttgttctattctgcatcaacgaaaatctgcaggaaaaaaaacaagtaacccagccgtgcataagataccaatgcagcttcaggaaaggaatgaaaagagaacatgccgaaaagcttcacatgctcgagcacttatgttcaacaaatttatcatgagaactttaaagaactataatgctatcacgagaatgtagctttagcaaacaaacatgcagaacactacaagaaagagtaattgatagtaccgaatttgcttatctttacctctatgtctgacaaaggttcgtaaagcttcttttcctgcacggcatacagtgtaattccagaaattttttgcacgcctacttgagtagctaccatactctgcacagattcattccagatatagtcaaatacatttctttctgattcataagacaatgaatttgccactggctttgatggtcaaacacaagactaaattgtttcaactgttggttaacattcatataatagcacgaatgaggaaaatcagtatcgttgaggaaaattcacaaggcagtattgttgttatgattcatcaatagcgtcactggtcagataaaaaaccaagcaaaaagatgtgacacatcctaataccattccctccgtcccaaaatataaatgattttgggacggagggaatggtattaggatgtgtcacatcattttgcttggatatttatcagaccagtgacgctattgatgaatcataacaacaatactgccttgtgaattttcctcaacgatactgattttcctcattcgtgctattannnnnnnnnnnnnnnnnnnnnnnnnnnnnnnnnnnnnnntactcgaacnatatatctaaactgatgtacccataaagttatcttaccaagtcaaagttgatggattcaaaagcctcaactagtggcaaaacctgcgcatatcatgaaagcaaaatatcaaaagcatacccaacacatcattaatttcacccactgttacagaggagggaataaaaggcaccacatagagattagttgagaccagctgagtagtgtactccaacataaagattttcctggacgtttgactatctcttaagaaaaaaaaaaaactagatgtcaccaaagcgattaataagcagcgcacaaactcattgttaactcacaatctaatttccattggccagattgctggaaagttgtaacattagcctgaaatcaagtacccaatgaaaaatcctaacttcctgttttctcaaacaaagaaacctatagcctgacacgcttctacatgccacattagcataccatagaaacagagcaattaactatgcaaatatgttatggaacaccagggacaaatttcacaggacacctgtctaagcaactgtcagaacaccccagactagtatagcatttgtataacagcaaacataaaatagcaagtgaaacaactaaccaacttctgtaatccattgaccagaacatatttctcttcatcaagtacgcttggtgctaaaaatacttcaaaagggccaactgtcttgtctgattggtttgtaaggcataaattaacctgaggatataaatctaatcaaatatcgatagtaatgtgaagagcagctgttgttaatatttgcaatgcagtaatgcactaagtgcatggttcaacgaaaagcattagtgcatagcgattgacaacaagtcatgaaactgtatgaagaaaagacactaataaagcatgcgagatgtattaccatgattcctgcaaatttactcagtactgcatgtctcctgtggtaatgaattgaaaggggtagaatgatataggaagggaacttttgaaagcttggtgcacaacatgcttcgtggaaagttaaacacataacatgttaacaaattgaaaggggtgagtgatatggggaggaaattctagagagcctggagcataacagttttgaacagccagaacctcgttttttatgggaacaatagggcataaccctagtgtaatgctttaatgcatttttcttttttgaaatattcagagactatacaagggatccataggacctgacaaaaaagtctgcaagactgacccatttttgtccaaagatactaataaagagattcccttagctaaactattgaagggaaatatcagatagataccaaagcaggaacatattttatcttacaagttaaacaatacagaagcataaacatcaaaatattgtggaaaaagaacatgaacaaatttcttgctaaatatccgagccagatgttcaccaacgaatcacctaccataaatggtctttccagaaatatcacaggtggaactttcacagcacgaagatcaacatctttgcttgcagtgggctgctcaaaagaaagagttgccaaagttatagctaacacttatatatagagtaacttaacaggtatagccctcgacacttcatataaaatagttcaaaccataagtcaggaactttactgacagtgctatgtatgttttgagtttgcaaacggccaggctccccgagatttgtccgccatgtgatctgaaatttcccgagtatgctgcttccctctgcctttgtttgaccagactcaccagacgatggtctgagttgatataggtaattgtatattcctcctccagctctgatgagaatcggttgcttgcacaagtccctatatgaaaaatagaactcacattagcaatccttttgcatcgacatgatatatcaacatccttgcatcgagacactatgttccattctccaaatagggtttgttatcagagctcaacttacccgattatagacttcactgttgacggatgttcatcggcttctaatcttgtagctgcccattgttgggaaggttcaaaatcaacttggtccatataaagattagattttgtatgattctctatgcaggcttccagataagtggtatcctgtcaaagtggactagctatatagagttcaagactgccatgatgaataaataaatgcacagtaaagggataaataacattataacaaacagtagtacagtagaatatatactataatatcgaaggaaacaaggccaaccacatttacatagaagtttgttcaaccagtttggaataaaccaaggataaagtataatgaggttccccaaattttatttttggggaattcaagacgctgataaacttcttatggaaccaaaaggatgattctgcacagatagaatggcaagtaaagaaagaaatggctaactggtaactgctgcgatgacagaacatattctaaaaaaaatgcaaatgtgacagcgtaaagttttaaaggtttccacaaaagaaaccaacatttagttacaagacttacaatattgtttgcatttgtgaaacaagagggtacataccttgatggtgcgaacctgaaacaaaaggtgaacacagattatttatgtgacctactctgtaatccgaatatgctgggattacattctaagatagagggacatagagattatacatatggagtatagattagccatataaaaaatgagagaaataagtaccttcgttctaacagacaatggatttgaaacagtgaacttaaagaattgaggaagatatttacgctccccatcaccatcattatataaagcagtgcagacaagcctggattcaatcaccacatgagcaaatcaacaataaggtgtgcttcactaatgtctaatgcaaccaatttgtaaataaaataaaaaagaggatagtgtacgtatgtgctcccagttctttgacatcatgttccacaatgaaatcatatctacccccagatctgattgactcaacaggggccttagatgtatccaaaagaagtatcctctgtctctcggtttgtatttctgcctaatgtaaataaacttccggttaaaacttatgacataatatgaagaaatgaaggcttcaaggacagctaagtcctgcatgcatgccaccaaaggggtgtctaaagtatcaaatttgtcatagagcaacatgcaacccatcgacagaactagccaataagaactacagataaagtcaaggtcaattataattatttgcatcaaagctacttattagcttataatacctcataatttcttgcatgccttaataacaccttgttacatttttttcttaatgaggctctaatagaattggtctaatcactgaacacaccacattggtcaacaaatgtaaaaaaagatgaacaagcaactattccagtaattccacagcagagagtcaatcgagtaatcgaatttaacatcagttcatgactgcaacaataagaacttggtgatgtgagattctaacactgaaaaaaagaagaagagaaaaacatcaacctagcacactctaaccagatgcactgaaacaacagcatcaatgacaaactgggtgcaataataccgttctccagaaaacatccagaataatattttatggtaaacgatccagaatttcaaataatgttttccaactaatgcgatataatagaagaggatggtaatcatgcgatggttcgagaaccttaatggcgacgtccctggcctcgaagctggagctattgttgatgctgatgtagctgcagaaggtctcccccaaatagatcgccctatcgatgcgtccccgcacgatcacatcaacacaatcattcgctgcaatctactactggaatggaagcgagagagagagagagacgaacccgaaggattgcgggaggacgaggaggccggggagcgcgagggcgtcgacggggtcgcggaggaggaagcggtcgcggaaggtgaagtcgccggggacggtggtggccggcgagtcgagcgggtggaggaggccctggaggaaggcggcggcgtcggcggcggaggaggcggaggggtcgggccccgtgagggcgtcctcggggaggaagacgtcgcgcgggtcgaagcggagcgcggcggcctggtcgggctgcagcgaggggcgggacagccgcatcacgcggaacgccagcgagtggttctgctgcagcagcgcctgcgccggcggcggcggctggtgcgcccccgccggatacggcggctgcgcgccggtgtagggcgacgccatcgccggagaacgagggagatctggggggctcgctctcgcgggcagtcgagtcgagactagttgtagttcagtttgccggttaagtttgagcaatttttgtatatgtatttgggacatttaatcgagactagttgtagttcagtttgccggttaagtttgagcaatttttgtatatgtatttgggacatttaattgtttgtcacttttaagataagttaactaatgatttatcaatcgttgtctataacatgtgggcaggggcgtacctatgtgtatctacccggtgtccacggacgtgttttaggtcatattaagcattatattactcaaaaataaacctataaacatatcaagcatccccggtaatttttgttctgggttcgccactgcatgtgggttcatatgtatctatgacatgtattcgagactagtttgttgttttttaaacaaaatggggaaaaaaaaaagcttggcgaggtaacattattagggcgtcctatactacttattcccaacttctctctccctcattttccacacgcacgtttcccgcctttatacccccaacaagttaatcaaataactttggatcattgttttttttgcagacatatattgccctcatatcttgtatattatattgagatattgtatattgaagtgattatatataatttttgacggtcatgaattattattttcatgcaatatgatattattgttctttgtctaaatctctactattgtaaaaattgaagatatttttgctgagattttagtaagtcatccgtgtttaaatcggttttcagttttaattgaggaatcggttttaattgaatatgttttttttgtccgtctatttttctcgccagttttttatgtccgattaggcttctttttttttcatcatctggtttttttatcaccgtatttttccactcagtccgatccaatctcctttttttaccgctcttagggcccgggccaaaccctagcaccgccgcgatctgcctccctgtacgtttcctcctattatttattgcaaaaatcgattccctacttctaactcattattttctccataattttctctttcaatttggttttaatttgttggatttaatctccatcgaagatggctgaccgagctttgcctttttgtcccgtttttttgtgaattctctctgatattggggaaacggggagaagagatcgagtggatcaaaagccctcaaccaaatcaagaaagattggttggatttgatgacgaggaccggctccggcatcatgcatgcataggatatcttccgaaggttgaagatcgcagtaggctatgtaagttgggcctatgactccacttatgcttgtggcttgggcctgtttgtgtgttgggccaaagagatataggccgagcgtggggaggtattgaactgggttatggctaaaaacaaaggaaaaggtacaccgaaggtccctcaacttgtcgtcgaattacaaaatcatccttgaaccgcaaaaccggatacaatgcatcccccaatttacaaaaccagtgcaaattaggtccctcgacggttttaactccggttttatcctatgtggcggttgaatcagcgtggaacccacgtggaccccacatgtcagggtcgccacgtcataatcctccctccttcctcccttctctctatccctctctctctattcctcggctcctcccacgtccttaccgacgacctcggcgtcctctggatcgaccctatccgatacctacagaggccggccgtagggatctagcgctgtttctgatctcgccgggcatggattcgaggaggaagactaccctgtcgtcgactatgagtcagatcttcagaccgccatgtcgacaacaattagatatgctactccaaatattatactggtgtgattatggtgaataagagcaacgaccgcttcggccaacaggatgtagggttattacctgacaattcaggggcccgaacctgtataaaaatctctgtcttcgtctcttttacctcggtctcgcgtatatcctagtaccaacgatctccatactatgcaaataccggaatcgcgacatcaaacgtcgacaagtactaaatagtctgtcttttattaaaaagtaggaaagttgatttaaataatcatatcaatttatttctttaaattatttactaatatatttattagctatgcgctaatttgttgctctgttttgcgtgaaagggacaagttctaggtcactagcatccaacacacccttagcatttctttattacacgactgaaccatatgcacgaacgcacagcactacgcatacaacaccacacttgcacactcgcaaatgcttctctaacacaattagaaactagcggcaaatcctattttcacgatatttatattgaaaaccaaattacgcgtacataatattcgtgggtataagatttaaatattagaccaccacaccgctgatacttcccaatttttagcaaattttgtagtgtgtatatttcgagaatatattttgttaagtttaagcaaattctgtacactcgataatatttttaagcacttgtaaatttttgcaagtgttctaggatgacagtattacaggtagctctgtaaatatcagaaccaagcgcagtttgaatactttctacccttcgaaaagattcgaacagaaattcaaatttcgtctttattttgtcgaccacgtt

SEQ ID NO: 41646 - DNA, 8741 bp, Oryza sativa
agtgtttgggcatgtcctaatcctgttttttcctaccgttttacacagctgctggtgcaatctgctctgactgctgcaggtaaactatgataccataccagggagggcctgagaccaaacaatctaaagttagatacaaaattgtccaaaaaccgatggcgcctacacagatttggccgagaaagctattggcagagtggttagtacggtgaaggtgtcgcccggaggcgtcaaattcaaacgactttcacccatgtcccaccgcacattgggcaagcatgggtccatcggctgatccaccatgcctcaagctcattcgacgtgttcggagctagagcaccaggctgagcaaatgcacaggtttgcctcaaacatcgtatgcactgcaaaagatagcatgtctcggtgtcacggcaaatggtgaattggatagagtgcgtcgataattaattctgaaagaatactgaagttagagactactactatcaagtatgcttaccttgtaccattcaccttcgaggcctgttttccacacagctgtaataacatctctccgagaacccatcacacctagaaaagatcccagccccacggatgttttcagaccaaatgctgcatctctttcagacaaccggcgctttcttggccaaagattttgaatcccaaaggagctgtcgccatcctcttccatgtccgataagtggcgattggtagagccattgatttttagctgtcgcgtattatccaatggaccaagatcatctggttctgaccatggcccaccaaacatgttgcgtctatgccattcttcagcagggggctgcagttctaattctcgaagtagaaggccagcagcatcagctccacgtggacgaggcatattctgcaataaatattggaacaaatgggcaacattggtataaattctcgacagaaatgcgtgtacacagctcttgttggacatgtacatgctcactactcttaccaaagatgtacatgctgatgaaaatgagaactcctaaatggtgacaagagggcgctgaggccatgagtaataaattatataggcagatggagaacgtatgaacaaaagaaatcataaaaaccaattatgcacgtgtgcttgtataaatgaaaatttccataattaacttggacaacaatattcttttgctggatcaatccatcgttaacccaggtaagtagagtagaacttgcaaaatactatatctctatttctccaacacaattgagaattactataatgtattgctgagaagagaacattgaatgctctaatgagtacacagagaatacagaaataaacttccacaataaatctgtattgtacctgcatatgagggccaagagatgcttccactacctcagggagcacagtgtaattgccatcgatgtaatgcagccttataataatattgctcgaaccaacctgagaagaaggcaacggatgttgcaaggttgcagtccgtttacataggtcaactaatatgagaaaaaggactttcacctgcaagcatgaaacaaataattcagaaactagatgtattacagtgctacacaaataatactttcagaaaggcaactaataaaatcgggagaaacatgtcgggcaaatcaccgatcaaagattatactaggtaaattatccaatcatgtctaattacccttaatcatatggcacttgcaaacaatttagacacacacatgatatatgatatgcagacatataaccacactatataacagctctaatctaaatgttgattcagaaacaatacaggctagatattgatgtcgaagcgcacatacaaaaatactgttatatgtataactatcactattttcagattgaaaaaagttttcttattgaacaattcaggctgagaaaatccatatttatgggttatttgtttgttacctcgtctgaagtataaccttggccagcattgccagaacctatcctagcagatttgttgcccactggattttcttcagcaccctttgctccaaccatctgtccacgtgaagttgtgccatcttccaatttggcagcacctagaccagatctgactgccaaagtattatcctctgtcttactgttcatcaagtgttgtttctgcatgctagaatcagaacttttttgtgcatttgcaggtatccttggagattgccttctccgaaaaagcaaacaaaatagcaacagctgacataatctatgaaggaaatggcagtccccaataagtctaacagctggtgtgccagggaatgttcccgtatttatgctaataggcatgaatgatgacctcccgctaattggatttggtgcagcatttgcagcaccatcagtattgttactaatcttagcaatggcaccttggacccactcttgcatttgtgagctccctgttgtagacgctactccaccttgattacctgaaacattagcatcattgctaagtttgaaatgtgccagcaacttgtcattttccaaaaaattaaataaagaaacaaataattcataggtggttttatttagcaccaaaaaaaaaagcacaagctttagcaagatagacggaatcaaaattaaccttggttagttgaaggtgaaggagaactgttggttggacttgtaaccatattcctagaattgcctgaaccagaagatgctccaactgcatggctagccaaagttcggcagaagctcgcatagcgtcgcaagcgtgtgataaaatgtgacgctaaatctagaacagcatcaacgtacccctgcagtccatgttcaaaaaaaaattaaatccacaaaatagtaacatgaaagttcatatgcagaccgcttatgctgaaatgtgtgcacaaattgctaaggcattggaggcagttgatgggctgagcataattcctgcacacctaggagcaaagcttatgatgaaagctatctggaggctgtttgaatcgtagtcggtttggaacataaaaacagcaaaatactgctgtaaatactgtaaattccatacatggcatggttaatctgtggcatatcatgcctcatcctcatgcatgaataggttgtggtttacaaatagcttatcattcaaaaaggtttgcaacatcatttgcccatattaagtctatagccaaaaaaaggaaaacgagattagcaaattgaactgaaactgtggaccaggaaatcaaaagaacatgaaacacagtatacctggatgcttaaaagtagagctgggtcaacagtcattttgtcaggcccaatgctagataacatgtcactggaagcttgccacggttcaggtagcagagttgatggatttatcagggcagactcaattcccttgccaagcatatccagaagcaatcttgcttgcatgtccaacacaagtgctctgacatcttgagcatttgttccttccaacaatctacactttatcctatcaagattctgcaataagtaaaatagactaatcagtaacagaagaaagcaatagccttgcaacttcaagtcctcaaaatctgaagtaaaaggtaaacacacaattagaaaaacaaatcttgtccaactcacaaattacaatatattgcattatgaataaagtagcaaactacatactaccgtaaatggtctctgaccaatacatccagagatataatttatgttcatagaaaagtttggcaagcttcatgctaaaatgttcattcagaactgcaaagcagtgctagtgacttgtcacaagaatactaaaaaactatgtccaggaaagaaaaggaaaaaagtcatcttgattatattttgattcgtatccccctttcaactactggtggaataaagactggtgattggtgaatgtacaatctttaagaacccaaaaagatattgtgacatgcatgtcacatagtaatggcagtaggcagtagatgatgaaaaattgaaggcctgtgcttaaaactgcacataatgtactaaaagcacagcacacttacaggacagtgttgttgcctctgttgtatagttggaagacaatggaagtccgcgtccagcaaagctatcacactgttcagtgagactggaaggaaaagcaagagatttagtttatcatggacaaatataaatgttacaggtgctgaaatagttaaccaaccatatgtagaaaatgatgaaacttactgaaaagttctgtatcagcttaaaaagatgtattgcaactcacaccaggaaataatgttaacatattgagacatccaaatgggaaaaatgaagcaaaacacaattcatcatactgcagatgcacaatgctttcaaattgggagcataaatgtgcaatcagctctaaagtcttaacattataaacaaccaaacagagatttgcttggttacactgttcttaattactccctccgtttcacaatgtaagtcattctaacattttccacattcatattgatgttaatgaatctagacatatatatctatctagattcattaacatcaatatgaatgtggaaaaagctagaatgacttacattatgaaacggaggaagtatatactttaagaggttgagtgacagttgtggaaattctaccgtgtagcagataatccctacttttctaattgtgtggacagctagaacacaattgaaatgcaaatactatacacaaattttaaattgcatctgcataagcatccttaccaataccatcttcagcagcactttgtgtgcagccaacagcatcccaccaatccacaccagccaatagactccaccaaaatctgctaaaaagatcgcagttataaaaaaaaacattttcaacaaataaatcatttcaatcaacctctgttaacttgggtggatacctatctgctattgctcgttcccaaacagctgagctaacctttgtctgagcattaagaattgcaggaggaagcacacgtattatctttagtatggttcgatctttgagtgtgtcatgccatactgatgccaagcaacaaccactggaggagaaggctggtggagcaattgctgagccaacattgacatgatagctatcaacctgttcaaagtttggacctgaaaaaatgtgcacacctccacgcaggaatgcaactgcaacctcaccaccatgagcagaataaactatttgggccaattgtctgacatcatttggaagatcataagggtcaaagctaagtcggttcgccctgtcaacactgcactcagaagaactccgctcatctgaagttgttggcattggaacatatgattgagggttcttaaggtcctcagatggtgggatgcttttgttaactcttgtggaccaaacagtctgtgtaggtggctgtccaccaaagtttgcagggcttccaaatattggatgaagaacaacaggttggactgaagattcccagcactggactctccatccagtgatggaaggtccttcatcaggatcataaggagacatgtactgccctggaagtatgtggtttaacaattgtcagaaaaaataaataagcattagccaagagcctaagatcaaccgattcacttaataaatttcagagaccccaaaagtccttaaaagaatatgcatatagcatttacagacaagaacttttattaccatggcacaagctaccagagcaaatcaaagaaacaacaaaagcaactaaagggagctaaaacatgtataagcatgctctggacatacatagttagattaactctcctactattaaagctgttggatgatcataggattagtgtggtgattatgaatggcattgatgttcatgccattcatcagaaacaaatagtcatagtgagatgtgacaattgcatcatactaattcatttcccaggtgtcatatacgcaccttcaactattacaactgtaataactgatccccctcgagtgggatcaaaagcaactgaggtaaccccagatccccatgttgtggtagtggctgactgggcagcagcttcaggactgacgtaagctgaaaagttggaaactggacaacaatggatcgatgctacctcagtggtctcattatctacctgtgcctgtttttttgtctgtgcgccctcggaaacaaggtagtcttgcaaagagaagaggtaagatgcaagtggagcaaaaccagcccagagtgggggatttagtgatggaggaagagagcttgttgcatttatctttgcagttgcctgaataccattgccaaggcctggcatcacctcccaaaccactacagtagatggattaacaaggggaacaccagcaacatgtaatgctccagtttcagtaataatagcatcagcagccattatgccgcttggccctgctcctaaaagccctttgctagtagaaaaccatctaggttgtgctgagttttgagaaggccattgtgaccaatgaagctgaacagaacccgatgaaaaaactgaacagacacatagaatgtttggccacccagctgcagtaaacagcaatatgtcagagtagcgtaaagaagcatgcttgctttctcctccaaaaaaaatatatgctcagtaatatatgtgtttaaccaacccgaactttgaggctgctgggtaaggaacttttcctcaaaggttttcaagtttgatgaagtactagagtttgcaggaagccatctatactgcaaagtcaaagaaacaaaacaaatttagccgtggcaacagcttagtaattatattccttcgattctaagatccacttatttcaggccaaaagggtaatcaaacacaggtagtgtcatttgaaatagatcaaagtacttactcagacataaactgagccagaatcttttttacctaattgttgcaattgtttatgataaatgtccagtgaaaaaatcttagaacagtttaaactcaagtctattgtcactgctttataaaatattatattttaaaaaaataatgattaacaattgacactgaaaagtatataaatctcgaatgttaaattgtgaagcggactgtataaactgctgggtcaatcgtattgcatatttgcattccaagtgtaaagtgctaattatcaaaaacaagagaagcagactgtaagtttgcaaattggcaacaaaccggagaaattcctgacaaccacttagtcaccaccgaaagatcttgacgccattcgtgttcacattgccaggaactggcatcacgtacaagattagtaggacccttcaccatatcaagaaagaaacaagtattagagaaaaaacacaaaacagcatgatatgtatatagacttgaaatgaaaaaagaaaatcctgagtgtttcgcaaattaacaaagtaagttcaatggtactactaacaaaaaaaaatgatatgcataccgaaatttgcttaaggtagagatgtaccttagttggctgtgtccatatagtaatccttccatgaaaatttgccaccagtaatgcacgagggcatgatcgaggagaccattcaatgaattgaacaaagtcgcgtggagaatctgttcaaaattacagtgagttaggattggaggtagaaaaactcgtatataaacaaaagtgagtttgaatctcacccttcacctgactataaaatgcccaatggacagtgatttgcacatgcataacgtaatcacattaccaaaacaattgagatttagccatggattacctgctttcacattgaaaacagaacattctgttggtctctctggatttagaatgtgtatgggaatccaaaatggtgggcttgaattagagctgaaaatatacattagatcgttttacggcaaagaaaccttcataaccagaaactgtaagcaaacaattctaccaaatggttgaatatcccactaagacaagctaacagaacaaacttatttatggataactaaaggtcagaggaaagtaaattttcagggaaaggatggaaaaatgtataccttggtatgcgtgcacaagtctctgatgcgcatgcaattgcattgagcttcccgcaccaagcaactgcactgcaataaaaaaaaaaccatagataagatagttactagttgttcccgatatagtgtaggctaaagcagacaaggcaacctcatcctacaagatcaaagcagttttaaacaaaaaaaaataatgtggattttaaaaatggagttatcacgttcggtattttctaactggtgaacaaagtaaccagtttgacctgactaaacttagttatgtgaaataatgacactacatgttataactgtatttgatctagtatagtagaagcctgcacaggatacaatcattcaaagcaatcacaattccatgcccacgctaatgcttctgcaagtttgagtcactagattgttcatcccaatcattgaaacgccacccaaatttgaagaggaaaaaaaaagtaaacccagatcgtttgatttagattattgagtggattattgtcatggatatattatagggataaattagatattttgagagacaaacttaacaaatagcttaaaacaagtggtctaagcaatacagtagaggaaaatttctttcggggggaaaaaaaccatttcaataaatcgatgaataagctgaaacagatcagggtttaaattcatcacacctaagcttcccccaacatatttaaatcccagaaagaaaaaacacccccaaaaaaaccacaactaatctcgaaacgcacctg

SEQ ID NO: 41647 - DNA, 4039 bp, Oryza sativa
  unsure (1)..(4039): unsure at all n locations
gggggaggcttaggtcactggaagcgaccgcccgttgctgtcgcggggggagggtttcctcccctcctcgctttgctgctgcctcctgcgtgtgcgctgcggcggcgtcgctttcaggttgggtggggaatgggatgcggccgtggaaaggggagacgacgacgacgaacgacgatgacgatgacgacgacggggagagagtcagagggagggggggaggggaaacgagtgggtttggtcttttggtggcgtttcgggagtggtgagctctgggtatgtacgaattccgttgaattttggatcgaaattgctagaaaacttttgcaagttccgtggagtttagttccaaacttttttaaaaaaatttttaactttccatcgcatcaaaactttcctacacatacaaacttctaacttttctgtcacatcgtttcaatttcaaccaaacttctaattttagcgtgaactaaacacaccctttttctctcaaaactttcagatttatggtcatcgggttactggagatttgtacattcaagagataacattgctacaaaaatatcatacatgttatgtgcaagatctcggtgctagtcagccaaaccacggttaaatacatgttttatataagttataccgtagttacaatacagttacagtacaactatacttcaattataatataatttaatctcgaagttttacacttaaaaaatctacggcagttttttacacactccaatattactcttgtatagtacctagatgtactaacttgtaacgaaataaagagtgttgtctgtctatttaaaattggatacacgaatttcattgaaattggcatggaggcgggtaatcttggtgttgtggtcttgcggtggattgtaacttgtaagaaaatggggatagtcgtctatttatttgaaactgggtacataaatttcgttaaatttggcaccaaggcagataaaatgagtgaatgtatgcctttttgggaatttgaatgaatctttcgtcagatttatagtttgacaatttcagttaaaatttatctccctcggttacaaatttcatcaattgtttatgtatcgaatctttaattaaattgtattattccatcattttactttaaatgatatctctctaggccacaactttcattacatcattgtctcgatttttatgtacatatagaaattgtagtgtgctagcacatatatgtacataaaaattgagattatgaacttggagctagaaacttgaaacttaaccctttcagattatcatcagccgactaatcacaagcgtcttataagaatctttataagaatctctagctctctatttaggttattatcattgttgtcgtgatcgtcgatagcccatcctaactacgcatgttttctttgtttatacaatataaatatgttttttttccaatagatgcagcagagtcatgacctatgaaattgatgatacggcacggtaagattttattcgcaacaaataagtcgataaaacaacaagcccatcttaaaaataaatccaaagaaacccaacccaaaagaagggaaggtcaggcgatgggcccaaacacgagccaaacaggcccatgagcccttgtacggcccatatgcaggtgatcagcccaccatggaacggcccacgtagcccaccgcctctcctcgccaccgactcaattcacccaaaggtcccaaaccgtcacaaaatagttaaaccaattccacgattccgtattcttcctcacgacctcaaaaacccaaaccaatctactccgccgccgccgccgcgatggtgttcgtccgcgcgccggacgggaggacccaccacgtcgacctcgacccctccaccgccacgctcgccgacctcacggcctccgcctcccgcgtctgcggcggcgtcccgccggagcagctgcggctctacctcgcccaccgccgcctcctcccggccgagccgtccccgctgctgtcctccctccgggtctcggcctcctcctccctgctactccacctccccctgctcggagggatgaccggcccgacgacgacccccgcgggacccccgcccccgccgcctgcgtcggcgcagccgtccgcccgccccgcgcgctacgacttgctcaactgcaagccgcccccgaactacgtggccggtctggggcgtggcgccaccgggttcaccacccgttcggatatcgggccggcccgcgcggcgcccgatctgcctgaccggtccgccgccgccgccgccgcccccgccgtcgggcgcggccgtgggaagccacccggggacgacgacggcgacgacgatggcggcgacgaggagaaggggtacgacgagaaccagaagttcgacgagttcgagggcaacgacgccgggctgttctccaacgccgactacgacgacgacgaccgcgaggcggatgcggtctgggagagcatcgaccagaggatggactctcgccggaaggatcggcgggaggcgcggctgaagcaggagatcgagaagtaccgtgcttccaaccctaagatcaccgagcaattcgctgatttgaagcgtaagttggtcgatttgtcggcgcaggagtgggaaagcatacctgaaattggggactactcgctgcgcaacaagaagaagcgatttgagagcttcgttcccgtgccggacaccctgctcgagaaggctcggcaggagcaggagcatgtcacggcactggatcccaagagccgtgcagctggtggcaccgagacgccatgggcgcagactccggttaccgatctgacggctgtgggcgaaggtcgtggcaccgtgctctccttgaagctggacaggttgtcggattcggtatctggtcttactgttgttgatccaaagggttacttgacggacctgaaaagtatgaagattactagtgatgctgagatttctgacattaaaaaggcgcgattgttgcttaagtcagtgacacagacaaacccgaagcatccaccaggatggattgctgctgctaggcttgaagaggttgctggcaagcttcaggttgctcggcagcttatccagcgtggctgtgaggagtgccccacaaatgaggatgtttgggtcgaggcatgccggctggccagcccagacgaggcaaaggcagtgattgctaggggcgtgaaggcaattcccaattctgtgaagctgtggttgcaggcagcaaagttggaaactagtgatttgaataagagcagggttttgagaaaagggttggaacacattcctgattcagtcagactgtggaaagcagtagtagagcttgcaaatgaggaggatgcaagactgttgcttcacagggctgtggagtgctgcccactccatgtggaactgtggcttgccctagcaaggctggagacatatgaccaagcaaagaaggtacttaacaaggcaagagaaaagcttcctaaggaacctgccatctggattacagctgcaaagctggaggaagctaatggaaacacccagtcagtaatcaaggtgattgagagaagtataaaaactttacagagagaaggattggatattgacagggaggcatggctaaaggaagcagaagctgctgagcgtgctggatctgtattgacttgccaggctattgttaagagcactattggcattggtgttgatgaggaagacagaaaacgcacatgggttgccgatgctgaggaatgcaagaagcgtggttcaattgagacagcccgtgccatctatgcgcatgcactcagtgtcttcgtttccaagaagagtatttggctgaaagcggctcagcttgagaagagccatggaaccaaggagtctctttataatctcctcagaaaggctgttacctacaatccacgtgcagaagttttatggcttatgagtgcaaaggagaaatggctggctggagatgtcccggctgcccgagccattcttcaggnnnnnnnnnnnnnnnnnnnnnnnnnnnnnnnnnnnnnnnnnnnnnnnnnnnnnnnnn

SEQ ID NO: 41648 - DNA, 1169 bp, Oryza sativa
gtagttttgaaatcgactgggatactgcagcccgttcatatagagttatgcagtacggtctcagttccaacatcgtgcttggaacgctcttggtctcacccatcaattggaaatctgcatcacatgttcttgacaaaatatggtatcagctacccacgtgattaagcccttgaaaacatgtgtttgacattttgactaagctgaacctttgcatgtcaggcatcacatcagtagaaactgattcagttagaggtcatgcttatgggatgtgttgccgcgcaaatcatgattcacctgcaaatgcacaagactaaaacttaaaaaggttttaaaaaggcagctatattattcacccatatagttattaacagagacttaacaaaaggggaataaaccccaggtgatctcatgtctaatactcccagtaacaactaataataataagcactagcacctccagctccaggtcctatgtgctagtgcagattgcacatccaattacacaaattattgctgcaatggggattactggagtgttctaactttctttggcgccttcatcaggtgcagcagcggcaacagcatcctccttttcttttacttcctccgagcttacctccctcggcttctcttcggttgctggcgccttctctggctcagcggcagcggcggtttcagttgtttctggtgaagtgcttggggcaccatcttcaacagggacggtcttcttgacggtaccgaccttcacgtacttgcccataaacttgtactcccagtcctgcaatgcgtcgagttcaaatgggccaagaccagagatgtcaccggtcaaatcctggggctcgaaggacatcttagcgagtgctctgctggcatctttgccagcgaatagcgcataaggtccaccaggtccatagaacatcctgcatatggccgtcaaaatgtgaatggtaattagaaacacagttaaaaaatatttaagtatccactttcaaaacagaatattaggggcaatgcaacaattcctaacacaaataaacatgcatatcctgagactatgaatatattatgtagacatcatgtagcacaatccctcacctaaaaagccacaactgtccatgtgttttgaatgggaaacagtgtagcaaagaaatgattgtcattggaaaagt

SEQ ID NO: 41649 - DNA, 2088 bp, Oryza sativa
atgacgtttcactaagtatatatcaaatgttgcagtgaaattgaaacatcatttcgctatttgctgaaacattgtttttatatatggtgaaacaacacccgtttttttggaaaccgtttgttttatacgttgtagcaaaatattccatgaggtgatttggttgtgtttcaacttttcaaacgattgaaacattttcgatctacttagtgaaacaattctgatctacttgctgtaacagcgctcatttttttcaaacaaaaatcggacgcctgatttgtaggcacctcaagttttatagtaggggtagttaccacatctaattttgggccatttaccatacccccactgggtttggtagtagtgtataggggtgaaaacgatcggaaacggtcggaatcggtagcatctcttcggaagcgatgctcgatcggccggtgattgaccatatttattatttaaacaactcaatatcgacattaatatgatgtataaagaaattagaaaaagcaaaaatttaaaaatagccaaaaacgttacggtcggaaatggtaccccttaaacagaaatggcgcccagtcgatcggaaatttccgtaaccgttttacccctagtagtgtagtactaggaatcaactctaaccacccattgctatgggtattttagacttttaattgattgacgtggaggggcagtttagtctattccgatgatcccgagaggcaagacagccttgcatgttgactcgttcgattggcccaagcgtcctctgaaaaaacaagggatgcaagactgccgccgccgggccgcgctttctgccgtcgtcccctcgctctaatcggcgattccacatgcagcggcgaatcgacgtcctgtgcagcggcgcctcagtctggcgaccccgctgcgctcccaccggccactggccgtcttacacgaacccttgtgtgtgaagtcgccgcccctcttgcttttgattcagaaacgcggccgcctctgcatttgatccggaggaacgccccgtcgtcgtcgccgctgctaccttccagcacgagcacccgttaggatcttctagagctagattttctatttctcttctcgtttagttacttaactagtttaaggatttcctaattgctattaattagagaaagacaggatatttcgtggaggggatgcctgcaggtgatctgactcctatgtggttgtatttagcagcgttagtttaggctctagttttgagtttttggtttcacttgtatgtgcaatatgatgctgagaatcatatatattcttgaatgtattctaaagaaatgattttgtttaccttgttctttcaagtattcgagctaggagtgcttcctgatgtatttcatatataatcaggaattgtgcagaattgtgctgttgtgcgtgcatcgttgttgctaccgatggcgtggcagttgccgctgcataatttgcatgcaacttataatcagacttagttttactgcatatacatttgtatatgaaatcagtttctcttgctccatatacattaacaacactggatggcatacatacatacatacatacatggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatacttacaatttgaaaattttgaaaaatttgagtgatttgtgcattagataccatggtgccccatatatatatatatatatatatatatatatggattgtgctttcccacatgctcttattggttaagttgtacttgaggctatctactagacaggcctgcatttgtccaactttttcgtcacatcaaatgtttgaaatatgcatagagcattgggctgcag

SEQ ID NO: 41650 - DNA, 9152 bp, Oryza sativa
atttgacaatgtggtgctatagtaaacatttgctaataacggattaattaggttcaatagactcgtctcgcattttacaggcggaatctataatttattttgttattagtctacgtttaatacttcaaatgtatgtccgtacacgtcaaaattttttttgacaagtaactaaacatggcccttgtagaggccgtgtttagttgcaaaatttttcttcgaacttctaacttttccattacatcaaaacttttctatacacacaaacttctaacttttccatcacatcgttccaatttcaaccaaacttccaattttgtgtgaactaaacacacccagaggttcttctgcatgcgtatatactagactgacatgcgttgctatagcttcttctgcgtatatatatagcctttctttgatatatatgcctctttgtgtatagatcatatttttcaactaattagtcatcaatagtcgaccatatggtgagttttctgccaccaactcaatacggcgagaatgaattgtttctggtatatatggcgtctggtggtgtagagtcataggagcttttttttttaactagaatgagttcgcgcgctatgctgcgcggtattgtagcatgtaaggctataactcacagaaaaatgtttgtccaagaagattacataacaacaatactcaattcctcatgtacctacagcgtgataagaacaatatttaacctaaatagttctttttataaccaaagtccccagaagcagttccggatagatgataatttatacaacaatttcacgacgcatagtagggatggcaagcatagtatgattcatccaacatctatgggcacaagatgcagtttgttatgtaaaactaactgaaaatagtacatggttaagtttctcataatcttgtttgcgaggactgcagtattaaaatagtatctgtaaactctagcattggccaaaaactcagtcagatgaggcaatagtattgcattgatcaactatggtacgaaaaaccaactacatttcagattcattagttttaagtagggacttgactcttcactatgagaactttctactcaagaaacatatcccccttggcaattcagatcaccaaatgcaatacccagcatctgctaaaatcattcttaaagttaagagtttggagaattaactcagtatattagagatgttactaagtagaactcaaaagtttggagacttaagtcagcacatagagagatgttacaaaatcagtagaaggaactcaaattaatgaacagatcctcacttcagtctatgttatcctactaatcaaatcagcggactcttaaaatagccatgtaaaggaacttaaatataaaggttcctgaaaagagacatctaaatgcaataactgagtatccactgtgaatcaatggactgatataaatgctagaaacaaatatacatcacctatgtgattaattagctaccaaactaccatgagagccttcaatatttgtatttttctcttagatgcccctcgtattctagtatagctaaggcgttgacaaatatcgatctacctaccgtacagtatttaaaaaaaaatgatcatcatggttaatgcatgtttagggatatttccacaggtatttcaaatggttttcctgctgagcaggctacagagaccatattgtttaatttgcacattgcagcactcaactggcttggtgttggtaagtttatttggtaggcaaaagaattggaccggggtgctccagcctaacacagtgcagcctagagatattaagaccagctcatagaaaagcattaaccgttgatgtgcatggagtatttttcctgtatggtttagaaaatgatcagatggagtgctcgtttttttggtcaaaatggtaattacatataattaatgaataaaaagaaataataggaaggattaaccttttttttttctctttctctctaaggagaacatcagagagcaaatcacagaaaggatctccaatgcatatttaccttgtatttgtttgtcaataagatgctggcagctccattcctgaagatccatgagctgagcatagtgggttgcctctcccaatattaacatgagacatgaattatcatgaagtaaacctattccttgaagattgagcggggatcttgggcctatcaagattgactaaggcgacatcaagcacacatcataagcatctcagttgaaagaacttttttttggtaaacttctcttaaggtaaaactaaatatttaccatttaaacttaaaaagctacttgcacagaggctgtaaaactacaattctcttttattgtaccatatatgttattcatgtgtatgaagagaacacggggagactatagtagcagttcgtaatggtgtcgcatatataaactcatgtataatcagataaatttaatatatatcaaattatagataatatcacagaatatacacatctagaaatcctcatgattttgtattgacaaaaccgaaccaaactaacatgttgtacccatccaagaatacctcttgtaggtaaattgggagtgctaggattaattttgtagatcgactatccaacaaaccataggacaatacatcaataaagattaaagcatctcctggttccccaaagaaacttcaatgcaagcatatgtagttcctgtacaaaacttgccatgttaattctgcaaagcaataatagtgagaaagccaaattttataggggactttttcacatgataagataaaaacaaggaaatactactattatgcaattactggactgagtgattgatgtctacgcctgtcatttacaaagaatggcaatatatgggcatatggcgatctgtttgcaaagttacacaaaaatataattgaatttcagaaccatctgtggccatcagacatgcaaatggcatatcataaaaaggtacaaacaatgaaaggcaaatgtttaatggtgaggtaaaaagagaaattcctgcagcttacctttttccgttgcctttgcctggctgtcatggctatcgtgttctgaatggctacataagaacatgaatcagaggttggcaaggaagtagcacaagaagctcatgcgatggataaaagtatgaaatgattgctcttaatttgggtatataataatttcattaataagcaacactaatattttacaaagctagtaaatgttgaactctaaaaatggggcaagtctagccgtctgttcacccatatgctgaaaacccacaaataatttgtgtaaaaggattctttgtagtgcatcattgtagagctacttggcctagtgatcatgagaaccatcataaattacatggtaggatgatttgcaaaacaacatagagttcaatttaatagtacttgcttacaatttttttttaaaaaaatatttcattatagcacgtggttggccagtgagctatgcaattacaactttaaaattattagcagtcaacatcttaaactacaatcttataccaaataatttgaactcagatattgtaattttaaattcatacccaccatagtattagcctcgccttgagttgtactaagcaagccccttttaacacatccttatctaccaatgataagtttctgcaatgtaaatgaaagttaagcctgcaacaagtaaatcttttgatcccaaaagatcttatagtaactattcaaattgttgtcccatttacattgaagagcttagttttttactgaaactgaaaacaggtaacaatggaaaacttcagaagaattcattgccctctgaagcactgttaaaaagataggaaaaatttgtattaaatacagtagaatcagcaatcagcaattcacatcaccctggcttagttatccaacaatcaaagaaatgaatagtctttacctaaaagccagatataatgggaggagccatgtaagcgacgcaaaaggtccagcaagcaaactgcttcatgaccatgtaaatggaaccagtgggaacaaaaacagaaggaactctttagagatgattcaacataatatagttatcatttagaacattattcttttatttagaggtaacaacaaaaattctattgaaatatatttttgaattctgtcacacatcttagcaaactcctcgggccatattaaacatctaggacactcatctagccaatacaacaagatagtacaatttgccaaaagctatttcactaagggaacaaaagctatcactgctacaacaagatagctgtttcactaagggaacaaatgctatcactgctgttgaacaaccaagaagatgcaatgtaaaaaggaaatataacctccagctgttgaatatcaactaattaggctcaattcataggacaacaacccaaaaggtaataaatgcaaccagagcagtgacgggtctggggaagaaccaccaccacctcatcctgccagtctatcttctgcatgtgctagctgcatgacagcatacataaatcatttcattaggcaccatgtttgctctgagatagaacaaattttcagtgcaaagcgatcctgtttggcacacacctatttgcaaaaaaatcaatcaaagagaactcattatttgctccaaaaactcacctacagacaatatgatagtagtatgttgggctgtacaggagaggcaacagagaggacagcttcttctcgtcctaatcctcctctatgccattggcctacccagtagacagtagaaactcgaaatccacatttaaatcaatgtaatcgcttgaatcacaagcccattgatgaaaggggaaaacacagggagctgctaatcacgcacctaaccgccagcggcgacagtgacccgtcgaactcgatgcgtcgtcaccacgtcgaagacctccaaaaaactgttgggagagccgcagcgaccttaaatcgctgggacctccagcagcagccgccgctgccaaacccctgtgctagaggctccgacgccgccgccaggtccccgacctcaaggctatgttgaaaccgccgttgagcccctccatcgagcgcagccaccaccgtacactttagggaagcactgttggaggacgggtaaaacgatggcgctggaaaggccatggaagaggaggaggaggcggcgccgcggcggaggagcatcggcgccgccggtcaaagaagcgagaagcgagatggggattgggatgcgacgtggagagacgagagatcgtggattccacgtctgggtaaggacggaaccatctagataggagacgaacgatcagattatgtccacgggtgagatcgaacggctctgattcgatggactcaatcgtaaataccaaaattataagggcttttctgcaaaaattaatggcgtggatcaactaggtttgcagatacgtgtcacgatacgattagttgacggagtccaaatcgccctggttgcggcaaagctaggagctttaagatatctagtatttgagaggagagtcataggagctttctggtcgcagcccacaggggagacgcaagcgagcgcgactgcaggaaggcaagggcggccagtgatggcatgggacacggtgatttctgtgtctcacgctttgctcgatgaagaggacggcggcggcgggagcgatctatggcctccacatcacgacggcgtctcgacggaagcctagcatccgcccctgaaccaactgggccaagtgccaggcttgctcccgtgattaaattacggattacaccctctattaactgcaaagttaaacagtcccacgaattccttttccacatttacccttttactacacctactacacttgctaccatctgtagtacaaattgatctcctccgtacgatctcatctcatagacagccaacatccacccaaaggtactcttaaaaaatccctaattttctatatgtaatgtaagataagaggtgatataaacgatacaccacatctacactatctctagtatactaatccaaatgattttattttatttgtttctccaatcccctttttctttcatcttctttcatcttctttctcaatattatcgctttggactagttaaatttactctctctttttttttcactttggaccacctcgattctcttttctagccatatccaactacgcctccgacaaagatattttatagtacttaccgtaagccaactagtataaacttatgtggaagggaaagataaagaaaagtgaatagtgttggctctcaaagcgagtacaatagcaagctacaagtcggctgtaagcacatatagaggagagaagagaagagaaggaaggaaagcgggcaacagatttatagccaactgtaacagggattctaaacgttgtgtgtgtatgagacaggactatatattattggtgtagtatatatttgtaggaaactattgtattaatgggctattaaattggctatagatgatttggagctagtagttggctatactattaaacttgaaatctcatgcagaaattagctatgcacttactccaagaaatttatattaaattcatagtgaaaaaaagagagaggagagggaaaaaatagagtgaaccttatagttaacccattatatatgttagctttagttagctatactattaaacttgctttaaggcttaagggtctctaccctaggactgggttgtagtaacataaggccatccccaaccctcgatgtcatatagtgcccatagtattaaatacattgtcacataagcaaaaatctaatatagcaaaagagttaatgagaagagagataaaaagatgaagaaaccatctctacacaagaaccaagaatgaaaacaaggggatagatggataaaaggagagaaaagagagatgattggatgataatttaattttgagacaccatccattagatacatagtttttatgtagtgtctatataacatggtaagtatgaaaactacttgatagtttctggattggggatgggctaagcatgtgctactatacatataactaaaaaagtgttattgtagtttatgctactatatatataactaaagaggtgttattgtagtttccagtaacacaaccaataagtattcttataggtcatgttactgcaagagtatctagtagtacgtaaccagtgtttagcatgccaaaaagtgttacaacatttttagtaacacaaacaagatgttacaatccacacccttcctttttctttcttttcttgtcgaggtcaccttccacaccctctctctcctttctagatgagatcgtcgtcctctccttagccctaggcggtgagcccttgtcaagagcgatgacccgagatcgtcgtgggcaagctcaacatccaaatctggtgggggcaaagccaacaacctcgaagacctctcactttctcctccttgtcgatgacagcggcgagggccatggctacaccagcaatcatggatagcgagctcctctcctgacggtagcaccagtcactgagcccctctttggagtggcagccccagttcatcatgggcgtgcaggagatgaggttgttatctagatctgacgggggaaaagcaggcaacctcaacacactcccaattcctccttctcggtggcaatggtgacgacaagggtcaaggctgtgctggtggccatgatgtacgatgatgatgacatctggaagtggcggtggcaagggccaagaggttgcgctggtggccatcactacaacaaaaaaccttatataaagacacttttgtagaggtgttttgcatattgcctctaagatcaggagttttatagtgtagagacactttaaaaattgtctagaaaacttttactctagagacactttagaaatatttttagcacattttattagattttatcttgtagacgcattctttcggcactttaaaatgtgcttaacatgtaaagacatttgcttgagacactttaaactatgtagagatacttcttagaataaaaatatatactaaatgactaaatatataagtaagttaaggcacaaacatacaatgaatgacatggggttgagttggttaatgccttgaagataagaatgatttgtttaacaggtcatgagttcaaggattggcaaaaacaagggaaactattttattctcatttttacattggtttcatatggttgtgatacaatttaatgtctctagaaaatgcctctaccatgttatagacattttataaaatgcatcttcgtttgtagagacaattcaccataaggcacttattgggcacttttaaaatgcctccacagtattgtaaaggaatttgaaaagtgtgtctatagtactcgaaaaatgtttctacaaagcatttttcttgtggtgcatggtgttcaacacacatgacatctttggtgcggtcccccagttgaggccaagatccaatttgggaaatggattaaatttatctgatgttacgtgtatatgcaatcaatgcaacatcgagttagcaatgcaaggaacaataatactataatcaataaatgacccatcgtaataattatatgattaagtgctaaacaacatacatgatgtccataatataaaatatactccctccgggctgataatacttgtagttttagataagggtgaggtcaaactttataatctttgattatgaatcattttcaaaatatttgtctttcaaatatggtgactacttgtatagattagtcttaaaaagtactttaataaaatcatatatttgttaacactttcatacatattataatggaaaataattgtcaaagttgctttttggagaccgtgtccttgtccaaaacgacaagtattatcaacctggagggagtagctacgcgagtgtgatatgagacgataaaagccttagactaaaaaaactatgttaattgatgaattagcccattggatgtaccaacttatgttatatacaatagatagagtggttgcatatgttgataatttcggattatttggcaaacgacctatcggataatccgaccaaaatgtcggataatccacatctgccggattttagagataccatatccgcatccgcatcatactatccgcatccacat

SEQ ID NO: 41651 - DNA, 763 bp, Oryza sativa
ggcttttgacatgtgtggcctgtgaagcccacaaggtccaaagaccatacctaaaccctaaatcctccatccccattccccactcgtgcagtctccacttctcccggcggctgtgacatagagtggcggcaggggcagtgattgcgaccggcgacggcggggctattgcgaccagcgacggtagtggctcttgcccccaagcagcagcggtgactcctacccctaacccatacttttactacccaaataagtcagatattgagcatgatggatcctttagagaaggtgtgattacatgtgtttcaaagatggttaaggatgaggcaacccaagacattataattacagaactcaacatgtatcaagaacaacaagggacatttggaaaggaaattgccatgaggcagaggagaaacaagaattttaatccaagtgaagaactgaacctaatatgattgccggaaatcatcttttttttttgtcttcgttgtttaactttaacttgttgtgcagcaaagtggtggttgaaccatggcacaatcattcccaatttgaggatattggtgtcaaggattttgaatttgacatgtagctcctcaggttgtgagaggaattggtttgtatttgaacaggtaaaagcttagaactcaccatgacatgacatttagatttgttgatagtttagctgtttatatgtttgagaaataatttcagattggtatgattgcttgagaattgagttacctgctacttgttgccccaa

SEQ ID NO: 41652 - DNA, 9010 bp, Oryza sativa
ttcttggccggcgtcggcacgggggtcgtcgagcttggtggggatggtggcgggcgcttcggcaacgggggaaagaggcgaggcaacgggaacctcgaccgggggagaggaggccggcggcggggtggccttgggccttgggcgccgggacggatgccttagtggacttgatgggtgacgcggtggccgaagccggggtaatgggcgcctgcggagggggccggggtggcgggggtggtcggcacagcggcgggtgtgggcgcgtcttcttggaggagaccagtggcatggtagtcagttctgccccgggggcgggcggagatggcggcatcgatgtcgagagcaacctcgtcctctgctccaacctcgccatctccgcccctccatcgtcgccaacaatagagctcctcacttgggacgacagcggagagacggtggcctggatctgcggggactagaacggcgcgcgacggacgggcgggtgggtgaagaatggcggagcatgcaagcgaggcaggaggcgggtgttaacaccaaaattcctgcactggagctaagtagatctcccaggccagtgtgtgtttttcgcgtcaacagcgggtagcgacctcggcttggcggggagaccgtggccgccgtgaggggcggcgatgcggtggttggccacctcgggtgccgctgtcccgagctcccccgcccggtggcccaagcggtgaacaagttccatgagcttgcccgccaccgctttgctccacctgccgccccctttgctctgcttgttgcttgccgcgactccgcctgccgtcggtccacgcaccgcccctctgctccgcccgccgcccctttgctccgccttgccgccgctccgctcatcacccctatgcgccgcccacccccgctcgccctcctccttcagtgcagaactgcaggggagagagagagggggataaagagaagagggaggatgacatgtgagatcacatgggcctacccttttttattattttgtgtgtaattgacatatgggttctagggtttttttttaattatttttccgggatccaattgccacataagtgccacgtcaatgccacataggacgaggacctagttaaaggagccacgtagatgccacgttattcaaaaccgggcacaatactgtcgagggatctcatctgcatggttttataagttaggggatgcttatgtccggttttcaggagcgaggacgaaaattagaccggcgacaaattgaaggacctaaagtgaacttattccactataaacccctttctacgacgaagttaaaagggaggccgtgcatgatttacggtagtgtaatcattaaagccttgtttggttaatctcatctacatgtaaattagaagatttggggaagaataattcgacacctattgagaattaatctctctgaatactctttaatccctccctcacgggaattgacataataaggtccaaaagaaagcggttcacaattttctaattgtaggatgaactaatgtggtcatattatatagtcattataaattacatagttcagaatttccatcatgattaccgaattccaacggcacccaaaaaatagttcctttttattttttccaatatttttgatatcattttcgtttcagcggcacctctttataaaaaaaaaagttattgaaatggtagaggctattttcctatcgttttcaacactttatgtaccctcatcctaggcgggccatggttcaatgtttttggagacgtacgtattttgtcctttgttttatttcatgcggtaatttggacaaagtgtgttacaaatgcaatatacatctgtaaatacttggggacgagttcctgctgaaaagaaagggagatagcaacctaagagaagatgagcttcttattatgttattccagagaaaattaatcagaaacggtgatgaacatctttccaagaatggtggggggagacccctctcgatctccctctcctttcactctttccctcctcaccttctccatctttatgggtaatttccagggatcttttcgaccacaaaacagaaaagatcccctaaaacaatacaatacctactgaaaaccaccaaaagaaaaaaaaaagaaacaagaaaaaaaaagcagcagaagaacccatcctgtcggccatgcttgtacacttgagtgtacactcatcccatgatctctgaaactgccatcaatcgactgttctttccgttcatcatcttcagggattcctctgctcagatgattggttactcacactgttgaatcacgagttgtatcttgtatctatatatatatgtgctgcttgtgttcaagagtgcaaagttgttgttgggcattatgttccttcagttcagaactttgcactccagatggcgctgtcgttctccccacatcgttgatggacctccttcatccgatccgccgatttgcagatgccgctgcagctccagtcgaacgacgcggcgcacacgttgcctgcctgcgccttccattcgcaatctgcagtagtgcgaaccatttgaaaaatttgtaaccaacagttggctaaaatatgatcagaagttgacaaaagaaaaaaaaatgatttgaaatttcatcatgcatgtcaatcagcagggtgattgatcacgtcagtccagaactctaagctcatctgacaacgacaacatttcccctgtaacagtttgctaattgtcctgtaacacctaccagtctctgaaactaatcaattgtgtacgtgagcatacatgactaaatgacgagcgcaatggccaatttagtccattacagtatttaaggtgaaatgaaatatctatctaagagcagctgtgacaccttcagagagaagagaagtggccttgttagaaaaaggtccgatgtctagtgtcctgacaggatgcttcatgattacaaaaaacaattgacaagcacatgtttgtgacagcagatagcatacctacttagtgaagttgactgacaaccaccccaaactacaaacgcaactgcactgtttcaccaaatgattcgatacatttcgtaatataaaatatgataaatacagatcaagtaagctgtattcagtccgactaccccatactatgaagagttgactgacatgtcaagaccaaacaaggatctggaagagcaaggaaatcagttcaaaagatggtaaggattttaactatacctggttgtgtaccgcagcaaagcctgcgatcatcgacgtgttcgacgtctagacctatgaaccatgctcctaatgatacatcctcattagcatatttgtggagaacatgcctgaaacatcaccatcatccatggtcaatgatgggtagaggttagataaaacatattatggtgtaatcaacaaagaaaaaccaaatctgaagaaatttcttactggttgattgatatataagaagctagatccttggagattgcatataactggccggttgcatgacggaagtacttgttcccccattcgccgaatttccagtactcgggctcatggtatcttacacccctgagaataaaaaacaaattggtatttggtcagctgtttaaaacatcaaggaagacatgacaacaacatgggacttacttctgagccaggactggaccagatttcatgcaaccaatgtaagctcgaggcttcgaccgatgcttagccaatatgttaccaagagttgctgcaacatttttatatctgattattatagtatcactataacaatatctaaaaaaattatagtatcacaataattgagatggaattttccagtaaaagggttttaagcttgtgctttgggagtaacatctctgaagattacagcatatacgatattttatcaactttgagtgtacaatttgtaagccaaatacatagcagaaatttaatgtaagtaaaatatatgaactaatcaaaattttagcagaaaaaacacttaatgaagggatatgatgttagatcagagggtagtaatgcacacctatatttacatgtacatcatcatccactttaatgtagtactctgcatcccacatggacaaggctgtcacaaagaacgatttcgtctttgcagccaattccagatacccttcaacatgatcctgagtgatcaaaaaatattccaagatatttcagctttacagacaaataaacaagccagtaatactgtactatatgccagctagagtaagtcctatggtaattaccaatctcatgaagtcaccatgtttcctatgcttctgcgtctatagctctatcgagtatgccaccagatgttgcgctgtcaatttagaaaggttaaaatttcagattctgtgagctcaagatatcgtcttctgacattgctgaatcataactggtactaactcttttgtctaatataatagaaactctcccttaactattgtccatacagatcgcccaaagtacatgttttcttgcactaacctatgaccaatgacgaatcggatgataattcccttttcttcctcaagcttccttcttttttcacctgtcgcaaacacagaaacaatatcaggtaacatgttttactgtgggaaaaaaaattctccatgcaaaagaatgtacaaccttgaggcatccacgtagcacgaagtgaatctcttcgtttccggctgctgaatgcggtgttgatgccaatgaccatgaagtatctccgtttccccgtagattctgatagcggcgctccattgagctcagactcctcctgtgacgcctttgctgatgctaactccatttctaagtttgatattgttttgtccaatgccctgataacaaaacagattcttatgaaccttggacttataaatttgaggttaaaatcagcagcataaaagtaggctatcattctctcaacccttttggtacttactgtatagcatcctgagttcttgggacctctccaattatatctttttgctccataacctgcataatatgcaggaaaaataacgatgctcgtgaaaatgcattgacgacatttgttaattttctcattcttcttactaacagtagaggtcactgtaaatgatgtttgcaaagtaatctgaaaatatttgtgtgacagttaatgcttacacttttcggagcacagtcaccagacaacaggttcatcttgttcacttctagagccgatctcctgatgatctcttttggttctggcattgtccacatcctgcaacaaatatttttttcttatttcctctgctccaaaatataatcatttttagaatagtgttaagtcaaacatttttaactttaactattaatagcaaaagaataaaaaagattaatcacgtaaaattgatgtactagatttatcattaaacaaactatcataatatataactctttttatttaaaacatcttaatgttataaatattattggttataatagcattttgaagactacgtcaaaatctaaaaatgtttatattttaggacggagagaatagcattttttaggacggttgcggtacttgtttatagtgacacatagagtaacaaccgcaacagagtaagcatttagtaaaagactgcaaattaatgattattctcatctcatttctttcgaaaaaatattattcgcatttcacagaaagatactaagtgcataaacttcagtgtaaaaaaaacagaggttgttgtttgctccatgcttggctgctggctgcgacctctgctgacgtttctgtagccatgacgtttccaactgtatttttcactgtacaaactacccaaggaaggccaaaaaagaaacaaagggcaatgatgccatttttaaccttaccaaattttaataaagttgtcaaaaaaatggctacatttagtttgttgtcaaattttgataactacataagaaatcctactaaaattttggccactatgctaaaattttggtattgtcaaaatttggtaagattttttttggcatcaaagtgaacaggtccaaaatttactgacctccactaatggggccatggcaactgtaactttcgtccaggtaaaaaagcagaagtgtactggtagcaggagtatacgttgctactgtgttgtcggcgacaggtatacgttgtatatcaggtagttagcgataaatgtactcagtatccagttttacccacccgtgccgtcggatcttctcgaaataaagaagcgtcacatcgaccaggcaagtacgctacgagcttccaagaactcacccacatttagcacgagcaaagcaggatcgagcctttaattcgagagagattttgcccttttaaatttcttccagagagctgcttcttctgtaggagtacgctacagcaacagcttagagcagaggagaggagatgagagtacagtacgccagctacagttgtttgttgttctttgggggtgtactctccattgaccaggagaggatgagaaaaaagagcagcagaggaacgcaagaaagaaaccaatagaattcagagaatttttggctgaacgaaccgaacggagaggaggaggcaaagagagaaaagcgaattgctggtaggatccgatcaccgcgggacaggatcaattttgcttttcttttcctttttggaatggaatggaagatgaaaaaaaggcgtctaaattcacccgtacacgaatggacgaagcaaaaaagcatgcagaaaacgaaggcgatcaaactgattgcatcacgcaagattattcaacaccaaaccaggacaaacctgcaggagcaagaagaagacgatggaggaagcaggggggcgtacctgttggtgaagatgaggccgatgcagaagctggcgaggcagaggaggagggtccatttcttggagatggtgccacggagcaccagctcgtcccctccgccgagcaccgctgctccccccctgctcttgttgaagctcatcttcacctgatctcttcttcctcctcgctcgcctagctctctaatcagtctccaattcacacgccctcacctatggatcctgtctccccgatctcggagacctcatgatcacactccaagaaccagaaatatggtccctccaccctcctgctcctcctgctgctcctctaacttttgtcaagatcaagtcactactcactactactaatattacctttaatttcctctctctctatctctgtgtgtcaagattctttggttcttgaagccgcctgctgccagtggcaggtgcctttggggtgaaggggaaggctgatatggagatggagacgagggaaaggatgcaccaactgcgtgcgtgctcgcgcgcgtgaagggtgtagagtggagtccgggggagggaagggatctcggcgattcttggtggcgctgctccagatttattcggccttcgccacttggtccggtctggacatctccggccagcttagcttagcttagctagtttagcttcttttaagctttagctgaagtagtaggtggttaagttaggtttaaactttggtctcctcttgtggggattattgtagtggaagcgccattaatgagctgatgtggtaattaagccaggctaaggtgagtttggagggtgaaatggctgttttgcccccttattttgtgtggtcaagtcaatggcatgttcaccttgcgagggtcagtagtactcagtagatcaccacccccatgtgttgagggaattagatacagttgtggtgctacaccccatgaggattctcttgtcatgttcagttcaaaaatggatacctcttctatagagcatgcgaccaaacttctgcagttcttgaaaaaaaaaagagcaatcatgcaatgctgttatgtgaaaatagtgtcatcaaaatttatcacaaaaaatattttagtattaatttgaaagcagtactacctctatcccaaaataagcgcagccataagtttccgtgtccaattgtaattgtccgtcttgtttgaaatatttttatgattagtatttttattattactagaatataaaacatgaatagtattttatctgtgatttatatttttttagttttttaaaacaatttaaaataagatgaacgattaaagttaaacacgaaaaatcatgtatgcatttattttgagacggatggagtatcaatttgtgccatcatcttttactacgcctctccattatcttttactccatgacttgactgataagccatgaaaatgaacgaaggaaccaaaatagtttgataatttatatgagaaaacttttgtatctgtgttgattttaaaagtaaatacttaaaaaaaataaactaatatggaaaacccttaaaattaactctaacttaattagattttcaaattcaaattttcgctatgactaataagccaaaagtaaacagatgcgaccgtattcatgagcaagctaagacttgcggactcaacgtgttgccagcgtgcctaaaaggatggtcaataattcgattaaattcactaaaaaaatatatgacgataattttctaacaaaaccgtgccaattattcactacaattaacgtaaatgtaaatggtaggatgcaggatagtgcatctatataaaagttaatcaatttatatattatatattcaccctttaaaaacatgtacaaagttggtgtctaacgggtcatgtatatgtccttggacaggtagactaatcataaattcgtagtcaagtcacctgtagaaattgtacaaacagtgttttcttgtggcgtactttttgcccatgttagcaagttcaggccacacatatatgctagctagtgaggagtatataacaatgtacagtaataaagagccatcgaccattaattgtttatctctacttttctttgtaatggagcaaggtatcttctttgttgcaattgtttttggtaaattatggacaaagggatctagttcctttcttcaccgcttgcaaagtatttattcttggggctgcaggaat
